United States Patent 12,747,451 (RNA ENCODING AN ANTIBODY) - sequence listing, part 11

SEQ ID NO: 56541 - RNA, 375 nt, synthetic construct
  misc_feature 1..375: note = derived and/or modified sequence opt11 from anti-HIV-1_HeavyChain
  source 1..375: mol_type = other RNA
caagcacacctggaacagagcggaagcggagtaaaacgcccgggcgcaagcgtacgcgtgagctgctggacgagcgaagacatattcgagaccacagaactaatccactgggtacgacaggccccgggccaaggcctggaatggatcggatgggtaaaaacagtcacaggcgcagtcaacttcggaagcccgaacttccgacaccgcgtgagcctgaccagagacagagacctattcacagcccacatggacatcagaggcctaacccaaggcgacaccgcgacctacttctgcgccagacaaaaattcgaacgcgggggccagggctggtacttcgacctgtgggggcgcgggaccctaatcgtagtctcaagc

SEQ ID NO: 56542 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatcttgcgcaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctaatagtcgtgagctcg

SEQ ID NO: 56543 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgagtgagctgttggacgagcgaggacatattcaagaccgagctcatacactgggtcaggcaagcgcccgggcaagggctcgagtggataggctgggtcaagaccgtgaccgggaccgtgaactttggctcgctcaatttcaggcaaagggtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56544 - RNA, 375 nt, synthetic construct
  misc_feature 1..375: note = derived and/or modified sequence opt11 from anti-HIV-1_HeavyChain
  source 1..375: mol_type = other RNA
caggcacacctagagcaaagcggaagcggagtgaaaaagctaggggcaagcgtaagggtaagctgctggacaagcgaagacatattcgaaaggacagagctgatacactgggtaaggcaggcgccggggcaagggctggagtggataggatgggtaaaggcagtgagcggggcagtgaactacggaagcctagacttcaggcacagggtaagcctgacgagggacagagacctgttcacagcgcacatggacataagagggctgacgcaagacgacacggcgacgtacttctgcgcgagacagaaattcgcaaggggagaccaggggtggttcttcgacctgtggggaagggggacgctgatagtagtgagcagc

SEQ ID NO: 56545 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaaggactcgagtggataggctgggtcaagaccgtgaccggggccgtgaactttggctcgagcgatttcagacaaagggtctcgctcacgcgcgatcgcgatctctttaccgcgcacatggacatacgcggactcacgcaaggggacacggccacgtacttttgcgcgcgccagaaattttacgcgggagggcaagggtggtatttcgatctctggggcaggggcacgctaatagtcgtgagctcg

SEQ ID NO: 56546 - RNA, 375 nt, synthetic construct
  misc_feature 1..375: note = derived and/or modified sequence opt11 from anti-HIV-1_HeavyChain
  source 1..375: mol_type = other RNA
caggtccagctcgtgcaatcgggcgcggaagtgaaaaagcccggggcctcggtcagggtctcgtgctggacctcggaagatatctttgaaaggagcgagctcatatactgggtcaggcaagcgcccgggcgcgggctcgagtggataggctggatcaagctcgtgagcggggccgtgaactttggctcggtcgatttcagggacagggtctcgctcacgcgcgatcgcgatctctttaccgcgcacatggacatacgcgggctaacgcaagatgacacggccacgtacttttgcgcgcgccagaaatttgccaggggcgatcaagggtggtttttcgatctctggggcaggggcacgctcatagtcgtgagctcg

SEQ ID NO: 56547 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcaggagcggggtcaagaaaccgggcgcgagcgtgcgcgtgagctgttggacaagcgaggacatattcgagcgcacggaattgatccattgggtgcgccaggccccgggccagggcttggaatggatcgggtgggtgaaagcggtctcgggcgcggtcaatttcgggagcccgaactttcgccatcgcgtgagcctgaccagggacagggacttgagcacggcccatatggatatcaggggcttgacccaggacgatacagcgacctatttctgtgccaggcaaaagttcgcgcgcggggaccagggctggttctttgacttgtgggggcgcgggaccttgatcgtggtctcgagc

SEQ ID NO: 56548 - RNA, 375 nt, synthetic construct
  misc_feature 1..375: note = derived and/or modified sequence opt11 from anti-HIV-1_HeavyChain
  source 1..375: mol_type = other RNA
cagagctatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcgctatcgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56549 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagacagagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttacagcgcacatggacatacgcgggctcacgcaagatgacacggccacgtacttttgcgcgcgccagaaatttgccaggggcgatcaagggtggtttttcgatctctggggcaggggcacgctaatagtcgtgagctcg

SEQ ID NO: 56550 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggagcgagcgtgcgcgtgagctgttggacgagcgaggacatattcaagagcgagctcatacactgggtcaggcaagcgccagggcaagggctcgagtggataggctgggtcaagaccgtgaccggggccgtgaactttggctcgagcgatttcaggcaaagggtctcgctcacgcgcgatcgcgatctctttaccgcgcacatggacatacgagggctaacgcaaggggacacggccacgtacttttgcgcgcgccagaaattttacgcgggcgggcaagggtggtacttcgatctctggggcaggggcacgctcatagtcgtgagctcg

SEQ ID NO: 56551 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccagggcaggggttggagtggatagggtgggtgaagacggtgagtggggcggtaaatttcgggagcccgaactttaggcatagggtgagcttgacgagggacagggacttgttcacggcgcatatggatataagggggttgacgcaggacgatacggcgacgtatttctgtgcgaggcagaagttcgcgaggggggaccaggggtggttctttgacttgtgggggagggggacgttgatagtggtgagtagt

SEQ ID NO: 56552 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaatagtatcgggcgcggtcaatttcgggagcccgaactttcgccagcgagtgagcttgaccagggacagggacttgttcacggcccatatggatatcaggggcttgacccagggcgataccgcgacctatttctgtgccaggcaaaagttcgcgcgcggggaccagggctggttctttgacttgtgggggcgcgggaccttgatcgtggtctcgagc

SEQ ID NO: 56553 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctaacgcgcgatcgagatctctttaccgcgcacatggacatacgcgggctcacgcaaggggacacggccacgtacttttgcgcgcgccagaaattttacgcgggcgggcaagggtggtatttcgatctctggggcaggggcacgctaatagtcgtgagctcg

SEQ ID NO: 56554 - RNA, 375 nt, synthetic construct
  misc_feature 1..375: note = derived and/or modified sequence opt11 from anti-HIV-1_HeavyChain
  source 1..375: mol_type = other RNA
cagagccatctagagcaatcgggctcggccatgaaaaagcccggggcctcggtcagggtatcatgctggacctcggaagatatctttgacacgaccgagctcatatactgggtcaggcaagcgcccgggcaagggctagagtggataggctgggtcaagatcgtgagcgggaccgtgaactttgcctcgctagatttcaggaacaggatctcgctctcgcgcgatcgcgatctatcgaccgcgcacatggacatacgcgggctcacgcaaggggacacggccacgtacttttgcgcgcgccagaaatttgaaaggggcgggcaagggtggtatttcgatctctggggcaggggcacgctcatagtagtgagctcg

SEQ ID NO: 56555 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggatgggtcaagatcgtgagcgggaccgtgaactttgcctcgctcgatttcaggcaaagggtatcgctaacgcgcgatcgcgatctctttaccgcgcacatggacatacgcgggctcacgcaaggggacacggccacgtacttttgcgcgcgccagaaatttgaaaggggcgggcaagggtggatattcgatctatggggcaggggcacgctcatagccgtgagctcg

SEQ ID NO: 56556 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgaacggaattgatccattgggtgcgccaggcaccgggacagggcttggaatggatcgggtgggtaaaaacggtcacgggcacggtcaatttcgggagcttgaactttcgccagcgcgtgagcttgaccagggacagggacttgttcacggcccatatggatatcaggggattgacccagggcgataccgcgacctatttctgtgccaggcaaaagttcgagcgcgggggccagggctggatctttgacttgtgggggcgagggaccttgatcgcggtctcgagc

SEQ ID NO: 56557 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacaagcgaggacatattcgagcgcacggaactgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcagaggcttgacccagggcgataccgcaacctatttctgtgccaggcaaaagttcgagcgcgggggccagggctggtactttgacctgtgggggcgcgggaccttgatcgtggtctcgagc

SEQ ID NO: 56558 - RNA, 375 nt, synthetic construct
  misc_feature 1..375: note = derived and/or modified sequence opt11 from anti-HIV-1_HeavyChain
  source 1..375: mol_type = other RNA
aggcatacagtggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgagtggggcggtgaatttcgggagcccgaactttaggcatagggtgagcctgacgagggacagggacctgttcacggcgcatatggatataagggggttgacgcagggggatacggcgacgtatttctgtgcgaggcagaagttcgagaggggagggcaggggtggtactttgacttgtgggggagggggacgttgatagtggtgagtagc

SEQ ID NO: 56559 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaagagtgagttgatacattgggtgaggcaggcgccggggcaggggttggagtggatagggtgggtgaagacggtgacgggggcggtgaatttcgggagcagtgactttaggcagagggtgagcttgacgagggacagggacctgttcacggcgcatatggatataagggggctgacgcagggggatacggcgacgtatttctgtgcgaggcagaagttcgagaggggggggcaggggtggtactttgacttgtgggggagggggacgttgatagtggtgagtagc

SEQ ID NO: 56560 - RNA, 375 nt, synthetic construct
  misc_feature 1..375: note = derived and/or modified sequence opt11 from anti-HIV-1_HeavyChain
  source 1..375: mol_type = other RNA
aggcatacgtgggagcagagcgggagcggggtgaagaagttgggggcgagcgtgagggtgagctgttggacgagcgaggacatattcgagaggacagagttgatacattgggtgaggcaggcgccggggcaggggttggagtggatagggtggatgaaggcggtgagtggggcggtgaattacgggagcttggactttaggcatagggtgagcttgacgagggacagggacttgagcacggcgcatatagatataagggggttgacgcaggacgatacggcgacgtatttctgtgcaaggcagaagttcgcgaggggggaccaggggtggttctttgacttgtgggggagggggacgttgatagtggtgagcagc

SEQ ID NO: 56561 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacgagcgaggacatattcgagcgaacggaattgatccattgggtgcgccaggccccgggccagggcttggaatggatcgggtgggtgaaaacggtcacgggcgcggtcaatttcgggagcccgaactttcgccatcgagtgagcttgaccagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56562 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgataccgcgacctatttctgtgccaggcaaaagttcgagcgagggggccagggctggatctttgacttgtgggggcgcgggaccttgatcgcggtctcgagc

SEQ ID NO: 56563 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagccaggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcacagggtctcgctcacgcgcgatcgcgatctctttaccgcgcacatggacatacgcgggcttacgcaaggggacacggccacgtacttttgcgcgcgccagaaatattacgcgggcgggcaagggtggtatttcgatctctggggcaggggcacgctcatagtcgtgagctcg

SEQ ID NO: 56564 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctaacgcgcgatcgcgatctctttaccgcgcacatgggcatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56565 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacatcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctttctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggaacgctcatagtcgtgagctcg

SEQ ID NO: 56566 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctaacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtagtgagctcg

SEQ ID NO: 56567 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgcaagatttcagggacaggttctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcagaggcacgctcatagtcgtgagctcg

SEQ ID NO: 56568 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcggaagatatctttgacgcgaccgggctcatatactgggtcaggcaagcgcccgggcaagggctcgagtggataggctgggtcaagatcgtgagcgggacagtgaactttgcctcgctcgatttcaggcaaagggtctcgctcacgcgcgatcgcgatctatttaccgcgcacatggacatacgcgggctcacacaaggggacacggccacgtacttttgcgcgcgccagaaattttacgcgggcgggcaagggtggtatttcgatctctggggcaggggcacgctcatagtcgtgagctcg

SEQ ID NO: 56569 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctcgaccgcgtacatggacatacgcgggctcacgcaagatgacacggccacgtacttttgcgcgcgccagaaatttgccaggggcgatcaagggtggtttttcgatctctggggcaggggcacgctaatagtcgtgagctcg

SEQ ID NO: 56570 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctagagtggataggctgggtcaaggccgtgagcggggccgtgaactatggctcgctcgatttcaggcacagggtctcactcacgcgcgatcgcgatctctttaccgcgcacatggacatacgcgggctaacgcaagatgacacggccatatacctgtgcgcgcgccagaaatttgccaggggcgatcaagggtggtttttcgatctctggggcaggggcacgctcatagtcgtgagctcg

SEQ ID NO: 56571 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagagtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56572 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggccagggcctggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56573 - RNA, 375 nt, synthetic construct
  misc_feature 1..375: note = derived and/or modified sequence opt11 from anti-HIV-1_HeavyChain
  source 1..375: mol_type = other RNA
caggcccatcccgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56574 - RNA, 375 nt, synthetic construct
  misc_feature 1..375: note = derived and/or modified sequence opt11 from anti-HIV-1_HeavyChain
  source 1..375: mol_type = other RNA
agggcccatctcgagcaatcgggctcgggcgtgcgcaagcccggggcctcggtcagggtatcgtgctggacctcggaagatatctttgaaaagagcgagctaatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttacagcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56575 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgagcggggccgtgaactttggctcgcccaatttcaggcacagggtctcgctaacgcgcgatcgcgatctctttaccgcgcacatggacatacgcgggctaacgcaaggggacacggccacgtacttttgcgcgcgccagaaatttgaaaggggagggcaagggtggatattcgatctctggggcaggggcacgctcatagccgtgagctcg

SEQ ID NO: 56576 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgacagaaattttacgcgggcgggcaagggtggtatttcgatctctggggcaggggcacgctcatagtcgtgagctcg

SEQ ID NO: 56577 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaaggactagagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgcacatagtagtgagctcg

SEQ ID NO: 56578 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagttgttggacgagcgaggacatattcgagaggacggagttgatacattgggtgaggcaggcgccggggcaggggttggagtggatagggtgggtgaagatagtgagcggggcggtgaatttcgggagcccgaactttaggcagagggtgagcttgacgagggacagggacttgttcacggcgcatatggatataagggggttgacgcagggggatacggcgacgtatttctgtgcgaggcagaagttcgagaggggggggcaggggtggatatttgacttgtgggggagggggacgctgatagcggtaagtagc

SEQ ID NO: 56579 - RNA, 375 nt, synthetic construct
  misc_feature 1..375: note = derived and/or modified sequence opt11 from anti-HIV-1_HeavyChain
  source 1..375: mol_type = other RNA
cagagccatctagagcaatcgggctcggccatgaaaaagcccggggcctcggtcagggtctcgtgctggacctcggaagatatcttcgacacgaccgagctaatatactgggtcaggcaagcgcccgggcaagggctcgagtggataggctgggtcaagatcgtgagcgggaccgtgaactttgcctcgagcgatttcaggcacagggtctcgctcacgcgcgatcgcgatctctcgaccgcgcacatggacatacgcgggctcacgcaagatgacacggccacgtacttttgcgcgcgacagaaatttgccaggggcgatcaagggtggttcttcgacctctggggcaggggcacgctcatagtcgtgagctcg

SEQ ID NO: 56580 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtaaagatcgtgagcggggccgtgaactttggctcgccaaatttcaggcaaagggtctcgctcacgcgcgatcgagatctatttaccgcgcacatggacatacgcgggctcacgcaaggggacacggccacgtacttttgcgcgcgccagaaattttacgcgggcgggcaagggtggtatttcgatctatggggcaggggaacgctcatagtcgtgagctcg

SEQ ID NO: 56581 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtaaagaagccgggggcgagcgtgagggtgagctgttggacgagcgaggacatattcgagaggagtgagttgatacattgggtgaggcaggcgccggggcaggggttggagtggatagggtgggtgaagacggtgacgggggcggtgaatttcgggagcccgaactttaggcagagggtgagcttgacgagggacagggacttattcacggcgcatatggatataagggggttgacggagggggatacggcgacgtatttctgtgcgaggcagaagttctatgcgggggggcaggggtggtactttgacttgtgggggagggggacgttgatagtagtgagtagc

SEQ ID NO: 56582 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgcgaactatggctcgctcgatttcaggcacagggtctcgctaacgcgcgaccgcgatctctttaccgcgcacatggacatacgcgggctcacgcaagatgacacggccacgtacttttgcgcgcgccagaaatttgccaggggcgatcaagggtggtttttcgatctctggggcaggggcacgctaatagtcgtgagctcg

SEQ ID NO: 56583 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggccagggcttggaatggatcgggtgggtgaaaacggtctcgggcgcggtcaatttcgggagcccgaactttcgccatcgcgtgagcttgaccagagacagggacttgttcacggcccatatggatatcaggggcctgacccagggcgataccgcgacatatttctgtgccaggcaaaagttcgagcgcgggggccagggctggtactttgacttgtgggggcgcgggaccttgatcgtggtctcgagc

SEQ ID NO: 56584 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggagcgagcgtgagggtgagctgttggacgagcgaggacatattcgagagaacggagctgatacattgggtgagacaggcgccggggcaggggttggagtggatagggtgggtgaaggcggtgtcgggggcggtgaatttcgggagcccgaactttaggcatagggtgagcttgacgagggacagagacttgttcacggcgcatatggatataagggggttgacgcagggggatacggcgacgtatttctgtgcgaggcagaagttcgagagaggagggcaggggtggtactttgacttgtgggggagggggacgttgatagtggtgtcgagc

SEQ ID NO: 56585 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggagtgaaaaagccaggggcatcggtcagggtctcgtgctggacctcagaagatatctttgaaaggaccgagctcatacactgggtcagacaagcgcccgggcaagggctcgagtggataggctgggtcaagatcgtgagcggggccgtgaactttggctcgcccaatttcaggcaaagggtctcgctcacgcgcgatagagatctctttaccgcgcacatggacatacgcgggctaacgcaaggggacacggccacgtacttgtgcgcgcgccagaaatttgaaaggggcgggcaagggtggatattcgatctctggggcaggggcacgctcatagccgtgagctcg

SEQ ID NO: 56586 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggagctcggaagatatatttgaaaggaccgagctcatacactgggtaaggcaagcgccagggcaagggctcgagtggataggctgggtcaagacagtgagcggggccgtgaactttggctcgcccaatttcaggcacagggtctcgctaacgcgcgatcgcgatctctttaccgcgcacatggacatacgagggctcacgcaaggggacacggccacgtacttttgcgcgcgacagaaatttgaaaggggcgggcaagggtggtatttcgatctctggggcaggggcacgctcatagtcgtgagctcg

SEQ ID NO: 56587 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggcaccgggccagggcttggaatggatcgggtgggtgaaaacggtcacgggcacggtcaatttcgggagcttgaactttcgccagcgcgtgagcctgaccagggacagggacttgttcacggcccacatggatatcaggggcttgacccagggcgataccgcgacctatttctgtgccaggcaaaagttctatgccggaggccagggctggtactttgacttgtgggggcgcgggaccttgatcgtagtctcgagc

SEQ ID NO: 56588 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgcgagcggggtgaagaggccgggggcgagcgtgagggtgagctgttggacgagcgaggacatattcgagaggagtgagttgatatattgggtgaggcaggcgccggggcaggggttggagtggatagggtgggtgaagacggtgagtggggcggtgaatttcgggagcacggactttagggagagggtgagcttgacgagggacagggacttgttcacggcgcatatggatataagggggttgacgcagggggatacggcgacgtatttctgtgcgaggcagaagttcgcgaggggggaccaggggtggttctttgacttgtgggggagggggacgttgatagtggtgagtagc

SEQ ID NO: 56589 - RNA, 375 nt, synthetic construct
  misc_feature 1..375: note = derived and/or modified sequence opt11 from anti-HIV-1_HeavyChain
  source 1..375: mol_type = other RNA
caggtccatctcgagcaatcgggctcgggcgtgaaaaagcccggggcctcggtcagggtctcgtgctggacctcggaagatatctttgaaaggagcgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatattacgcgggcgggcaagggtggtatttcgatctctggggcaggggcacgctaatagtcgtgagctcg

SEQ ID NO: 56590 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagagtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatatgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56591 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccgaggcctcggtcagggtctcgtgctggacctcagaagatatctttgaaaagagtgagctcatacactgggtcaggcaagcgcccgggcaagggctcgagtggataggctgggtcaagaccgtgaccggggccgtgaactttggctcgagcgatttcaggcaaagggtctcgctcacgcgcgatcgagatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56592 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccagcgcgtgagcctgaccagggacagggacttgttcacggcccatatggatatcaggggcttgacccagggcgataccgcgacctatttctgtgccaggcaaaagttcgagcgcgggggccagggctggatctttgacttgtgggggcgcgggaccttgatcgcggtctcgagc

SEQ ID NO: 56593 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgcgagcggggtcaagcgaccgggcgcgagcgtgcgcgtgagctgttggacgagcgaggacatattcgagcgcacggaattgatctattgggtgcgccaggcaccgggccagggcttggaatggatcgggtgggtgaaaacggtctcgggcgcggtcaatttcgggagccaggactttcgcgatcgctttagcttgaccagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56594 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagttgttggacgagcgaggacatattcgagaagagtgagttgatacattgggtgaggcaggcgccggggcaggggttggagtggatagggtgggtgaagatagtgagcggggcggtgaatttcgggagcccgaactttaggcagagggtgagcctgacgagggacagggacttgttcacggcgcatatggatataagggggttgacgcagggggatacggcgacgtatttctgtgcgaggcagaagttcgagaggggggggcaggggtggatatttgacttgtgggggagggggacgttgatagcggtgagtagc

SEQ ID NO: 56595 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagagacagggacccgttcacggcccatatggatatcaggggcttgacccagggcgataccgcgacctatttctgtgccagacaaaagttcgagcgcgggggacagggctggtactttgacttgtgggggcgcgggaccttgatcgtagtctcgagc

SEQ ID NO: 56596 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgggctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcacacatggacatacgcgggctcacgcaaggggacacggccacgtacttttgcgcgcgccagaaattttacgcgggcgggcaagggtggtatttcgatctatggggcaggggcacgctcatagtagtgagctcg

SEQ ID NO: 56597 - RNA, 375 nt, synthetic construct
  misc_feature 1..375: note = derived and/or modified sequence opt11 from anti-HIV-1_HeavyChain
  source 1..375: mol_type = other RNA
caggcacacctagagcaaagcggaagcggagtgaaaaagccaggggcaagcgtaagagtgagctgctggacaagcgaggacatattcgaaaagagcgagctgatacactgggtaaggcaggcgccagggcaagggctggagtggataggatgggtaaaggcagtgagcgggacagtgaactacggaagcctggacttcaggcacagggtaagcctgacgagagacagagacctattcacagcgcacatggacataagagggctgacgcaagacgacacggcgacgtacttctgcgcgagacagaaattcgcgaggggagaccaagggtggttcttcgacctatggggaaggggaacgctaatagtagtgagcagc

SEQ ID NO: 56598 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtatcgtgctggacctcggaagatatctttgaagggagcgagctaatacactgggtcaggcaagcgcccgggcaagggctcgagtggataggatgggtcaagaccgtgaccggggccgtgaactttggctcggcctatttcaggcacagggtctcgctcacgcgcgatcgcgatctctttaccgcgcacatggacatacgcgggctcacgcaaggggacacggcaacgtacttttgcgcgcgccagaaattttacgcgggcgggcaagggtggtatttcgatctctggggcaggggcacgctcatagtcgtgagctcg

SEQ ID NO: 56599 - RNA, 375 nt, synthetic construct
  misc_feature 1..375: note = derived and/or modified sequence opt11 from anti-HIV-1_HeavyChain
  source 1..375: mol_type = other RNA
caggcacatctcgagcaatcgggctcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgagatctatttaccgcgcacatggacatacgagggctcacgcaaggggacacagccacgtacttttgcgcgcgccagaaattttacgcgggcgggcaagggtggtatttcgatctctggggcaggggcacgctcatagtcgtgagctcg

SEQ ID NO: 56600 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggagctcggaagatatctttgaaagaaccgagctaatacactgggtcaggcaagcgcccgggcaagggctcgagtggataggctgggtcaaggccgtgagcggggccgtgaactatggctcgctcgatttcaggcacagggtctcgctcacgcgcgatcgagatctctcgaccgcgcacatggacatacgcgggctcacgcaagatgacacggccacgcacttttgcgcgcgccagaaatttgccaggggcgatcaagggtggtttttcgatctctggggcagaggcacgctcatagtcgtgagctcg

SEQ ID NO: 56601 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaagggaccgagctcatacactgggtcaggcaagcgcccgggcaagggctcgagtggataggatgggtcaagatcgtgagcggggccgtgaactttggctcgcccaatttcaggcaaagggtctcgctcacgcgcgatcgagatctatttaccgcgcacatggacatacgcgggctcacgcaaggggacacggccacgtacttttgcgcgcgccagaaatttgaaaggggagggcaagggtggatattcgatctatggggaaggggaacgctcatagccgtgagctcg

SEQ ID NO: 56602 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcaggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagacagtgaccggggccgtgaactttggctcgcccaatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacactcatagtcgtgagctcg

SEQ ID NO: 56603 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgaggggagtgagttgatacattgggtgaggcaggcgccggggcaggggttggagtggatagggtgggtgaagacggtgacgggggcggtaaatttcgggagcccaaactttaggcatagggtgagcttgacgagggacagagacctgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56604 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcacccgggcaagggctcgagtggataggctgggtcaagaccgtgagcggggccgtgaactttggctcgcccaatttcaggcacagggtctcgctcacgcgcgatcgcgatctctttaccgcgcacatggacatacgagggctcacgcaaggggacacggccacgtacttctgcgcgcgccagaaatttgccaggggcgatcaagggtggtttttcgacctctggggcaggggcacgctcatagtcgtgagctcg

SEQ ID NO: 56605 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtaagggtctcgtgctggacctcggaagggatctttgaaaggaccgagctcatacactgggtcaggcaagcgcccgggcaagggctcgagtggataggctgggtcaagatcgtgagcggggccgtgaactttggctcgcccaatttcaggcaaagggtctcgctcacgcgcgatcgcgatctctttgcagcgcacatggacatacgcgggctaacgcaaggggacacggccacgtacttttgcgcgcgccagaaatttgaaaggggcgggcaagggtggatattcgatctatggggcaggggcacgctcatagcagtgagctcg

SEQ ID NO: 56606 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagagggcggagttgatacattgggtgaggcaggcgccggggcaggggttggagtggatagggtgggtgaaggcggtgagtggggcggtgaattacgggagcttggactttaggcatagggtgagcttgacgagggacagggacttgttcacggcgcatatggatataagggggctgacgcaggacgatacggcgatatatttctgtgcgaggcagaagttctatgcgggggggcaggggtggtactttgacttgtgggggagagggacgttgatagtggtgagtagc

SEQ ID NO: 56607 - RNA, 375 nt, synthetic construct
  misc_feature 1..375: note = derived and/or modified sequence opt11 from anti-HIV-1_HeavyChain
  source 1..375: mol_type = other RNA
caggcgcacctggagcagagcgggagcggggtgaagaagttgggggcgagcgtgagggtgagctgttggacgagcgaggacatattcgagaggacggagctgatacattgggtgaggcaggcgccggggcaggggttggagtggatagggtgggtgaaggcggtgagtggggcggtgaattacgggagcccgaactttaggcagagggtgagcttgacgagagacagggacttgttcacggcgcatatggatataagggggttgacgcagggggatacggcgacgtatttctgtgcgaggcagaagttcgagaggggagggcaggggtggatatttgacctgtgggggagggggacgttgatagcggtgagcagc

SEQ ID NO: 56608 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggctggagtggatagggtgggtgaagacggtgacgggggcggtgaattacgggagcttgaactttaggtcgaggataagcttgacgagggacagggacttgttcacggcgcatatggatataagggggttgacggagggggatacggcgacgtatttctgtgcgaggcagaagttctatgcgggggggcaggggtggtactttgacttgtgggggagggggacgttgatagtggtgagtagc

SEQ ID NO: 56609 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgagcggggccgtgaactttggctcgcccaatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctatggggcaggggcacgctcatagccgtgagctcg

SEQ ID NO: 56610 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagaggacggagctgatacattgggtgaggcaggcgccggggcaggggttggagtggataaggtgggtgaaggcggtgagtggggcggtgaattacgggagcttggactttaggcatagggtgagcttgacgagggacagggacttgagcacggcacatatggatataagggggttgacgcaggacgatacggcgacgtatttctgtgcaaggcagaagttcgcgaggggggaccaggggtggttctttgacttgtgggggagggggacgttgatagtggtgagtagc

SEQ ID NO: 56611 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatatttgaaaggaccgagctcatacactgggtcaggcaagcgcccgggcaagggctcgagtggataggctgggtaaagaccgtgaccggggccgtgaactttggctcgagcgatttcaggcaaagggtctcgctcacgcgcgatcgcgatctctttaccgcgcaaatggacatacgcgggctcacgcaaggggacacggccacgtacttttgcgcgcgccagaaattttacgcgggcgggcaagggtggtatttcgatctatggggcaggggcacgctcatagtcgtgagctcg

SEQ ID NO: 56612 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggccagggcttggaatggatcgggtgggtgaaaacggtcacgggcgcggtcaatttcgcgcaccagatctcggacagggtctcgctcacgcgcgatcgcgatctctttaccgcgcacatggacatacgcgggctcacgcaaggggacacggcaacgtacttttgcgcgcgccagaaattttacgcgggcgggcaagggtggtatttcgatctctggggcaggggcacgctcatagtcgtgagctcg

SEQ ID NO: 56613 - RNA, 375 nt, synthetic construct
  misc_feature 1..375: note = derived and/or modified sequence opt11 from anti-HIV-1_HeavyChain
  source 1..375: mol_type = other RNA
caggcgcacttagagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaaggtggtgagtggggcggtaaatttcgggagcccgaactttaggcagagggtgagcttgacgagggacagggacttgttcacggcgcatatggatataagggggttgacgcagggggatacggcgacgtatttctgtgcgaggcagaagttcgagaggggggggcaggggtggatatttgacttgtgggggagggggacgttgatagcggtgagtagc

SEQ ID NO: 56614 - RNA, 375 nt, synthetic construct
  misc_feature 1..375: note = derived and/or modified sequence opt11 from anti-HIV-1_HeavyChain
  source 1..375: mol_type = other RNA
caggtgcatttggagcagagcgggagcggggtgaagaagccgggggcgagcgtgagggtgagctgttggacgagcgaggacatattcgagaagagtgagttgatacattgggtgaggcaggcgccggggcaggggttggagtggatagggtgggtgaagacggtgacgggggcggtgaatttcgggagcagtgactttaggcagagggtgagcttgacgagggacagggacttgtttacggcgcatatggatataagggggttgacgcagggggatacggcgacgtatttctgtgcgaggcagaagttctatgcgggggggcaggggtggtattttgacttgtgggggagggggacgctgatagtggtaagtagc

SEQ ID NO: 56615 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagtgggagcggggtgaagaagccgggggcgagcgtgagggtgagctgttggagtagcgaggacatattcgagaggacggagttgatacattgggtgaggcaggcgccggggcaggggttggagtggatagggtgggtgaagacggtgacgggggcggtgaatttcgggagcttggactttaggcataggataagcttgacgagggacagggacttgttcacggcgcatatggatataagggggttgacgcagggggatacggcgacgtatttctgtgcgaggcagaagttcgagaggggggggcaggggtggatatttgacctgtgggggagggggacgttgatagcggtgagtagc

SEQ ID NO: 56616 - RNA, 375 nt, synthetic construct
  misc_feature 1..375: note = derived and/or modified sequence opt11 from anti-HIV-1_HeavyChain
  source 1..375: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctccctcgacttccgcaaccgcatctccctctcccgcgaccgcgacctatcaaccgcctacatggacatccgcggcctaacccaagacgacaccgccacctacttctgcgcccgccaaaaattcgcccgcggcgaccaaggctggttcttcgacctctggggccgcggcaccctcatcgtcgtctcctcc

SEQ ID NO: 56617 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacaagcgaggacatattcgagcgcacggaactgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgataccgcgacctatctctgtgccaggcaaaagttcgagcgcgggggccagggctggtactttgacttgtgggggcgagggaccttgatcgtggtctcgagc

SEQ ID NO: 56618 - RNA, 372 nt, synthetic construct
  misc_feature 1..372: note = derived and/or modified sequence opt11 from anti-HIV-1_HeavyChain
  source 1..372: mol_type = other RNA
cgccatacctgggaacagagcgggagcggggtcaagaaaccgggcgcgagcgtgcgcgtgagctgttggacgagcgaggacatattcaagagcgagctcatacactgggtcaggcaagcgcccgggcaagggctcgagtggataggctgggtcaagaccgtgaccggggccgtgaactttggctcgagcgatttcaggcaaagggtctcgctaacgcgcgatcgcgatctatttaccgcacacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56619 - RNA, 375 nt, synthetic construct
  misc_feature 1..375: note = derived and/or modified sequence opt11 from anti-HIV-1_HeavyChain
  source 1..375: mol_type = other RNA
caggcgcacctggagcagagcgggagcggggtgaagaagccgggggcgagcgtgagggtgagctgttggacgagcgaggacatattcgagaggacggagctgatacattgggtgaggcaggcgccggggcagggattggagtggatagggtgggtgaagacggtgacgggggcggtgaatttcggaagcccgaactttaggcatagggtgagcttgacaagagacagggacttgttcacggcgcatatggatataagggggttgacggagggggatacggcgacgtatttctgtgcgaggcagaagttctatgcgggagggcaggggtggtactttgacttgtgggggagggggacgttgatagtggtgagtagc

SEQ ID NO: 56620 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaagaacagagctcatacactgggtcaggcaagcgcccgggcaagggctcgagtggataggatgggtcaagacagtgaccggagccgtgaactttggctcggcctatttcaggcacagggtctcgctcacgcgcgatcgcgatctctttaccgcgcacatggacatacgcgggctcacgcaaggggacacggccacgtacttttgcgcgcgccagaaattttacaagggcgggcaagggtggtatttcgacctctggggcaggggcacgctaatagtcgtgagctcg

SEQ ID NO: 56621 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggcccgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccacgtacttctgcgcgcgccagaaatttgccaggggcgatcaagggtggtttttcgatctctggggcaggggcacgctcatagtcgtgagctcg

SEQ ID NO: 56622 - RNA, 375 nt, synthetic construct
  misc_feature 1..375: note = derived and/or modified sequence opt11 from anti-HIV-1_HeavyChain
  source 1..375: mol_type = other RNA
agggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagatagtgagtggggcggtgaatttcgggagcccgaactttaggcagagggtgagcttgacgagggacagggacttgttcacggcgcatatggatataagggggttgacgcagggggatacggcgacgtatttctgtgcgaggcagaagttcgagagaggggggcaggggtggatatttgacctgtgggggagggggacgttgatagcggtgagtagc

SEQ ID NO: 56623 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaagaccgtgacaggggccgtgaactttggctcgagcgatttcaggcaaagggtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56624 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggagtagcgaggacatattcgagaggacggagctgatacattgggtgaggcaggcgccggggcaggggttggagtggatagggtgggtgaaggcggtgagtggggcggtgaattacgggagcttggactttaggcatagggtgagcttgacgagggacagggacttgttcacggcgcatatggatataagggggttgacgcaggacgatacggcgatatatttctgtgcgaggcagaagttcgcgaggggagaccaggggtggttctttgacttgtgggggagggggacgttgatagtggtgagtagc

SEQ ID NO: 56625 - RNA, 375 nt, synthetic construct
  misc_feature 1..375: note = derived and/or modified sequence opt11 from anti-HIV-1_HeavyChain
  source 1..375: mol_type = other RNA
caggcccatctagagcaatcgggctcaggcgtgaaaaaggtcggggcctcggtcagggtctcgtgctggacctcagaagatatctttgaaaggaccgagctcatacactgggtcaggcaagcgcccgggcaagggctcgagtggataggctgggtcaaggccgtgagcggggccgtgaactatggctcgctcgacttcaggcacagggtctcgctcacgcgcgatcgagatctctttaccgcgcacatggacatacgagggctcacgcaagatgacacggccatatacttttgcgcgcgccagaaattcgccaggggcgaccaagggtggtttttcgatctctggggcaggggcacgctcatagtcgtgagctcg

SEQ ID NO: 56626 - RNA, 375 nt, synthetic construct
  misc_feature 1..375: note = derived and/or modified sequence opt11 from anti-HIV-1_HeavyChain
  source 1..375: mol_type = other RNA
caggtccagctcgtgcaatcgggcgcggaattgaaaaagcccgggagctcggtcagggtctcgtgctggacctcggaagatatctttgaagggagcgagctcatacactgggtcaggcaagcgcccgggcaagggctagagtggataggctgggtcaagaccgtgaccggggccgtgaactttggctcggcctatttcaggcacagggtctcgctcacgcgcgatcgagatctctttaccgcgcacatggacatacgcgggctcacgcaaggggacacggccacgtacttttgcgcgcgccagaaattttacaagggcgggcaagggtggtatttcgatctctggggcaggggcacgctcatagtcgtgagctcg

SEQ ID NO: 56627 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggtctcggtcagggtctcgtgctggacctcggaagatatctttgaaaggaccgagctcatacactgggtcaggcaagcgcccgggcaagggctcgagtggataggctgggtcaagatcgtgagcggggccgtgaactttggctcgcccaatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56628 - RNA, 375 nt, synthetic construct
  misc_feature 1..375: note = derived and/or modified sequence opt11 from anti-HIV-1_HeavyChain
  source 1..375: mol_type = other RNA
caggcgcacctggagcagagcgggagcggggtgaagaagttgggggcgagtgtgagggtgagctgttggacgagcgaggacatattcgagaggacggagttgatacattgggtgaggcaggcgccggggcaggggttggagtggatagggtgggtgaaggtggtgagtggggcggtgaattacgggagcttggactttagacatagggtgagcctgacgagggacagggacttgttcacggcgcatatggatataagggggttgacgcaggacgatacggcgacgtatttctgtgcgaggcagaagttcgcgagaggggaccaggggtggttctttgacttgtgggggagggggacgttgatagtggtgtcgagc

SEQ ID NO: 56629 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagaggacggagttgatacattgggtgagacaggcgccggggcaggggttggagtggatagggtgggtgaaggcggtgtcgggggcggtgaattacgggagcttggactttaggcatagggtgagcttgacgagggacagggacctgttcacggcgcatatggatataagggggttgacacaggacgatacggcggcgtatttctgtgcgaggcagaagttcgcgagaggggaccaggggtggttctttgacttgtgggggagggggacgttgatagtggtgagtagc

SEQ ID NO: 56630 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgcgcaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctaacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56631 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcaggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccgggaccgtgaactttggctcgctaaatttcaggcaaagggtctcgctcacgcgcgatcgcgatctctttaccgcgcacatggacatacgagggctcacgcaaggggacacggccacgtacttttgcgcgcgccagaaattttacaagggcgggcaagggtggtatttcgatctctggggcaggggcacgctaatagtcgtgagctcg

SEQ ID NO: 56632 - RNA, 375 nt, synthetic construct
  misc_feature 1..375: note = derived and/or modified sequence opt11 from anti-HIV-1_HeavyChain
  source 1..375: mol_type = other RNA
caatcgcacttggaacagagcgggagcgcgatgaagaaaccgggcgcgagcgtgcgcgtgagttgttggacgagcgaggacatattcgagcgcacggaattgatccattgggtgcgccaggccccgggccagggcttggaatggatcgggtgggtgaaagcggtctcgggcgcggtcaattacgggagcttggactttcgccatcgcgtgagcttgaccagggacagagacttgttcacggcccatatggatatcaggggcttgacccaggacgataccgcgacctatttctgtgccaggcaaaagttcgcgcgcggggaccagggctggttctttgacctgtgggggcgcgggaccttgatcgtggtctcgagc

SEQ ID NO: 56633 - RNA, 375 nt, synthetic construct
  misc_feature 1..375: note = derived and/or modified sequence opt11 from anti-HIV-1_HeavyChain
  source 1..375: mol_type = other RNA
caggcccatctagagcaatcaggatcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcactcgatttcaggcacagggtctcgctcacgcgcgatcgcgatctctttaccgcgcacatggacatacgcgggctcacgcaaggggacacggccacgtacttttgcgcgcgccagaaatttgccaggggcgatcaagggtggtttttcgatctctggggcaggggcacgctcatagtcgtgagctcg

SEQ ID NO: 56634 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaggcccggggcctcggtcagggtctcgtgctggacctcggaagatatctttgaaacgaccgagctcatacactgggtcaggcaagcgcccgggcaagggctcgagtggataggctgggtcaagaccgtgagcggggccgtgaactttggctcgctcaatttcaggcacagggtctcgctcacgcgcgatcgagatctctttaccgcgcacatggacatacgcgggctcacgcaaggggacacggccacgtacttttgcgcgcgccagaaattttacaagggcgggcaagggtggtatttcgatctatggggcaggggcacgctcatagtcgtgagctcg

SEQ ID NO: 56635 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagtgcgagtggggtgaggaggccgggggcgagtgtgagggtgagttgttggacgagtgaggatatatttgagaggagtgagttgatatattgggtaaggcaggcgccggggagggggttggagtggatagggtggataaagctggtgagcggggcggtgaattttgggagtgtggattttagggatagggtgagcttgacgagggacagggatttgtttacggcgcatatggatataagggggttgacgcagggggatacggcgacgtacttttgtgcgaggcagaagttttatgcgggggggcaggggtggtattttgatttgtgggggagggggacgttgatagtggtgagtagt

SEQ ID NO: 56636 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagatcgtgagcggggccgtgaactttggctcgcccaatttcaggcaaagggtctcgctcacgcgagatcgagatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56637 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggagtgaaaaagctaggggcctcggtcagggtctcgtgctggaccagtgaagatatatttgaaaggacagagctaatacactgggtcaggcaagcgccagggcaagggctcgagtggataggctgggtaaagacagtgagcggggcagtgaactttggctcgccaaatttcaggcacagggtctcgctaacgcgcgatagagatctctttacagcgcacatggacataagagggctcacgcaaggggacacggcaacgtacttttgcgcgcgccagaaatttgaaaggggcgggcaagggtggtatttcgatctctggggcagaggaacgctcatagtagtgagctcg

SEQ ID NO: 56638 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaggccaggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagagtctcgctcacgcgcgatcgcgatctctttaccgcgcacatgggcatacgcgggctcacgcaaggggacacggccacgtacttttgcgcgcgccagaaattttacgcgggcgggcaagggtggtatttcgatctctggggcaggggaacgctcatagtcgtgagctcg

SEQ ID NO: 56639 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctagatttcaggcacagggtctcgctcacgcgcgatcgcgatctctttaccgcgcacatggacatacgcgggctcacgcaagatgacacggccatatacttttgcgcgcgccagaaatttgccaggggcgatcaagggtggtttttcgatctctggggcaggggcacgctcatagtcgtgagctca

SEQ ID NO: 56640 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagctcggggcctcggtaagggtcccgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56641 - RNA, 375 nt, synthetic construct
  misc_feature 1..375: note = derived and/or modified sequence opt11 from anti-HIV-1_HeavyChain
  source 1..375: mol_type = other RNA
caggtgcacttggagcagagtgggagcggggtgaagaagccgggggcgagcgtgagggtgagctgttggacgagcgaggacatattcgagaggacggagttgatacattgggtgaggcaggcgccggggcaggggctggagtggatagggtgggtgaagatagtgagtggggcggtgaatttcgggagcccgaactttaggcagagggtgagcctgacgagggacagggacttgttcacggcgcatatggatataagggggttgacgcagggggatacggcgacgtatttctgtgcgaggcagaagttcgagaggggggggcaggggtggatatttgacttgtgggggagggggacgttgatagcggtgagtagc

SEQ ID NO: 56642 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaagaaccgagctcatacactgggtcaggcaagcgcccgggcaaggactcgagtggataggctgggtcaaggccgtgagcggggccgtgaactatggctcactcgatttcaggcacagggtctcgctcacgcgagatcgcgatctctttaccgcgcacatggacatacgcgggctcacgcaagatgacacggccacgtacttttgcgcgcgacagaaatttgccaggggcgatcaagggtggttcttcgatctctggggcaggggcacgctcatagtcgtgagctcg

SEQ ID NO: 56643 - RNA, 375 nt, synthetic construct
  misc_feature 1..375: note = derived and/or modified sequence opt11 from anti-HIV-1_HeavyChain
  source 1..375: mol_type = other RNA
caggcccatctagagcaatcggcctcgggcgtgcgcaggcccggggcctcggtcagggtctcgtgctggacctcggaagatatctttgaaaggagcgagctcatatactgggtcaggcaagcgcccgggagagggctagagtggataggctgggtcaagaccgtgagcggggccgtgaactttggctcgcccaatttcaggcacagggtctcgctcacgcgcgatcgcgatctctttaccgcgcacatggacatacgagggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56644 - RNA, 375 nt, synthetic construct
  misc_feature 1..375: note = derived and/or modified sequence opt11 from anti-HIV-1_HeavyChain
  source 1..375: mol_type = other RNA
caagcgcacttagaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccagcgcgtgagcttgaccagggacagggacctgttcacggcccatatggatatcaggggcttgacccagggcgataccgcgacctatttctgtgccaggcaaaaattcgagcgcgggggccagggctggtactttgacttgtgggggcgcgggaccttgatcgtggtctcgagc

SEQ ID NO: 56645 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcaggctcggccatgaaaaagcccggggcctcggtcagggtctcgtgctggacctcggaagatatctttgaaaggaccgagctcatatactgggtcagacaagcgcccgggcgcgggctcgagtggataggctgggtaaagaccgtgagcgggaccgtgaactttggctcgagcgatttcaggaacaggatctcgctcacgcgagatcgcgatctctcgaccgcgcacatggacatacgcgggctcacgcaagatgacacggcaacgtacttttgcgcgcgccagaaattttacgcgggcgggcaagggtggtatttcgatctctggggcaggggcacgctcatagtcgtgagctcg

SEQ ID NO: 56646 - RNA, 375 nt, synthetic construct
  misc_feature 1..375: note = derived and/or modified sequence opt11 from anti-HIV-1_HeavyChain
  source 1..375: mol_type = other RNA
caggtccagctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56647 - RNA, 375 nt, synthetic construct
  misc_feature 1..375: note = derived and/or modified sequence opt11 from anti-HIV-1_HeavyChain
  source 1..375: mol_type = other RNA
caagcccacctcgaacaatccggctccggcgtcaaaaaacccggcgcctccgtacgcgtcagctgctggacctccgaagacatcttcgaacgcaccgaactcatccactgggtccgccaagcccccggccgcggcctcgaatggatcggctgggtaaaagccgtctccggcgccgtcaactacggctccctcgacttccgacaccgcgtctccctaacccgagaccgcgacctattcaccgcccacatggacatcagaggcctaacacaagacgacaccgccacctacttctgcgcccgccaaaaattcgcccgcggcgaccaaggctggttcttcgacctctggggccgcggcaccctcatcgtcgtctcctcc

SEQ ID NO: 56648 - RNA, 375 nt, synthetic construct
  misc_feature 1..375: note = derived and/or modified sequence opt11 from anti-HIV-1_HeavyChain
  source 1..375: mol_type = other RNA
caatcgcacttggaacagagcgggagcgcgatgaagaaaccgggcgcgagcgtgcgcgtgagctgttggacgagcgaggacatattcgagcgcacggaattgatccattgggtgcgccaggccccgggacagggcttggaatggatcgggtgggtgaaaacggtcacgggcgcggtcaatttcgggagcccgaactttcgccatcgcgtgagcctgaccagggacagggacttgttcacggcccatatggatatcaggggcttgacccagggcgataccgcgacctatttctgtgccaggcaaaagttcgagcgcgggggccagggctggtactttgacttgtgggggcgagggaccttgatcgtggtctcgagc

SEQ ID NO: 56649 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgcgagcggggtcaagcgcccgggcgcgagcgtgcgcgtgagctgttggacgagcgaggacatattcgagcgctcggaattgatctattgggtgcgccaggccccgggccagggcttggaatggaccgggtgggtgaaaacggtctcgggcgcggtcaatttcgggagcacggactttcgcgagcgcgtgagcttgaccagggacagggacttgttcacggcccatatggatatcaggggcttgacccagggcgataccgcgacctatttctgtgccaggcaaaagttcgcgcgcggggaccagggctggttctttgacttgtgggggcgcgggaccttgatcgtggtatcgagc

SEQ ID NO: 56650 - RNA, 375 nt, synthetic construct
  misc_feature 1..375: note = derived and/or modified sequence opt11 from anti-HIV-1_HeavyChain
  source 1..375: mol_type = other RNA
caggtgcacttggagcagagcgggagcggggtgaagaagttgggggcgagcgtgagggtgagctgttggacgagcgaggacatattcgagaggacggagttgatacattgggtgaggcaggcgccgggaagggggttggagtggatagggtgggtgaaggcggtgagtggggcggtgaattacgggagcttggactttaggcatagggtgagcttgacgagggacagggacttgttcacggcgcatatggatataaggggattgacgcaggacgatacggcgacgtatttctgtgcgaggcagaagttcgcgagaggggaccaggggtggttctttgacttgtgggggagggggacgttgatagtggtgagtagc

SEQ ID NO: 56651 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggagcgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatattacgcgggcgggcaagggtggtatttcgatctctggggcaggggcacgctcatagtcgtgagctcg

SEQ ID NO: 56652 - RNA, 375 nt, synthetic construct
  misc_feature 1..375: note = derived and/or modified sequence opt11 from anti-HIV-1_HeavyChain
  source 1..375: mol_type = other RNA
caggcacacctagagcaaagcggaagcggagtgaaaaagccaggggcaagcgtaagggtaagctgctggacaagcgaagacatattcgaaaggacagagctaatacactgggtaaggcaggcgccagggcaagggctagagtggataggatgggtaaagacagtgacaggggcagtgaacttcggaagcccaaacttcaggcacagggtaagcctgacgagggacagggacctattcacagcgcacatggacataagagggctgacgcaaggggacacggcaacgtacttctgcgcgagacagaaattctacgcgggagggcaagggtggtacttcgacctatggggaaggggaacgctaatagtagtgagcagc

SEQ ID NO: 56653 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagcgggagcggggtgaagaagccgggggcgagtgtgagggtaagctgttggacgagcgaggatatatttgagaagagtgagttgatacattgggtgaggcaggcgccggggcaggggctggagtggatagggtgggtgaaaacggtgacgggggcggtgaattttgggagcagcgactttaggcagagggtgagtttgacgagggacagggacttgtttacggcgcatatggatataagggggttgacgcagggggggacggcgacgtatttctgtgcgaggcagaagttttatgcgggggggcaggggtggtattttgacttgtgggggagggggacgttgatagtggtgagtagc

SEQ ID NO: 56654 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgagcggggccgtgaactttggctcgcccaatttcaggcacagggtctcgctcacgcgcgatcgcgatctctttacagcgcacatggacatatgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56655 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaggaaagtgggcgcgagcgtgcgcgtgagctgttggacgagcgaggacatattcgagcgcacggaactgatccattgggtgcgccaggccccgggacagggcttggaatggatcgggtgggtgaaagcggtctcgggcgcggtcaattacgggagcttggactttcgccatcgcgtgagcttgaccagggacagggacttgttcacggcccatatggatatcaggggcttgacccaggacgataccgcgatctatttctgtgccaggcaaaagttcgcgcgcggggaccagggctggttctttgacctgtgggggcgcgggaccttgatcgtggtctcgagc

SEQ ID NO: 56656 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggatcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcacagggtctcgctcacgcgagatcgcgatctctttaccgcgcacatggacatacgcgggctcacgcaaggggacacggccacgtacttttgcgcgcgacagaaatattacgcgggcgggcaagggtggtatttcgatctctggggcaggggcacgctcatagtcgtgagctcg

SEQ ID NO: 56657 - RNA, 375 nt, synthetic construct
  misc_feature 1..375: note = derived and/or modified sequence opt11 from anti-HIV-1_HeavyChain
  source 1..375: mol_type = other RNA
caggtccagctcgtgcaatcgggagcggaagtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgccaaatttcaggcacagggtctcgctaacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56658 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagtgggagcggggtgaagaagccgggggcgagcgtgagggtgagctgttggacgagcgaggatatattcgagaagagtgaattgatacattgggtgaggcaggcgccggggcaggggttggagtggatagggtgggtgaagacggtgacgggggcggtgaatttcgggttgagtgattttaggcagagggtgagcttgacgagggacagggggttgttcacggcgcatatggatataagggggttgacgcagggggatacggcgacgtatttttgtgcgaggcagaagttttatgcgggggggcaggggtggtattttgacttgtgggggagggggacgttgatagtggtgagtagc

SEQ ID NO: 56659 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggatcgggcgtgaaaaagcccgggacctcggtaagggtatcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcaaagggtctcgctcacgagagatcgcgatctctttaccgcgcacatggacatacgagggctcacgcaaggggacacggcaacgtacttttgcgcgcgccagaaatttgaaaggggcgggcaagggtggatattcgatctctggggcaggggcacgctaatagccgtgagctca

SEQ ID NO: 56660 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcagaagatatctttgacacgaccgagctcatatactgggtcaggcaagcgcccgggcaagggctcgagtggataggctgggtcaagatcgtgagcgggaccgtgaactttgcctcgctagatttcaggaacaggatctcgctctcgcgcgatcgcgatctctcgaccgcgcacatggacatacgcgggctaacgcaagatgacacggccacgtacttttgcgcgcgccagaaatttgaaaggggcgggcaagggtggtatttcgatctctggggcaggggcacgctcatagtcgtgagctcg

SEQ ID NO: 56661 - RNA, 375 nt, synthetic construct
  misc_feature 1..375: note = derived and/or modified sequence opt11 from anti-HIV-1_HeavyChain
  source 1..375: mol_type = other RNA
caggtccagctagtgcaatcgggcgcggaagtgaaaaagcccggggcctcggtaagggtctcgtgctggacctcggaagatatctttgaagggagcgagctcatacactgggtcaggcaagcgcccgggcaagggctcgagtggataggctgggtcaagaccgtgaccggggccgtgaactttggctcggcctatttcaggcacagggtctcgctcacgcgcgatcgagatctctttaccgcgcacatggacatacgagggctaacgcaaggggacacggccacgtacttttgcgcgcgccagaaattttacaagggcgggcaagggtggtatttcgatctctggggcagaggcacgctcatagtcgtgagctcg

SEQ ID NO: 56662 - RNA, 375 nt, synthetic construct
  misc_feature 1..375: note = derived and/or modified sequence opt11 from anti-HIV-1_HeavyChain
  source 1..375: mol_type = other RNA
cagagtcacttggagcagagcgggagcgcgatgaagaagccgggggcgagcgtgagggtgagctgttggacgagcgaggacatattcgatacgacggagttgatatattgggtgaggcaggcgccggggcaggggctggagtggatagggtgggtgaagatagtgagtgggacggtgaatttcgcgagcagtgactttaggaatagaataagtttgagcagggacagggacttgagcacggcgcatatggatataagggggttgacgcaggacgatacggcgacgtatttctgtgcgaggcagaagttcgagaggggagggcaggggtggatatttgacttgtgggggagggggacgttgatagcggtgagcagc

SEQ ID NO: 56663 - RNA, 375 nt, synthetic construct
  misc_feature 1..375: note = derived and/or modified sequence opt11 from anti-HIV-1_HeavyChain
  source 1..375: mol_type = other RNA
caggtacagctcgtgcaatcgggcacggaagtgaaaaagcccggggcctcggtcagagtctcgtgcaaggcctcgggctatacatttgaaaagagcgagctcatacactgggtcaggcaagcgcccgggcaagggctcgagtggataggctgggtcaagaccgtgaccggggccgtgaactttggctcgagcgatttcaggcaaagggtctcgctaacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56664 - RNA, 375 nt, synthetic construct
  misc_feature 1..375: note = derived and/or modified sequence opt11 from anti-HIV-1_HeavyChain
  source 1..375: mol_type = other RNA
cagagtcacctggagcagagcgggagtgcgatgaagaagccgggggcgagcgtgagggtgagctgttggacgagcgaggacatattcgagagaacggagttgatatattgggtgaggcaggcgccggggagggggttggagtggatagggtgggtgaagacggtgagtgggacggtgaatttcgggagcagtgactttaggaataggataagcttgacgagggacagggacttgagcacggcgcatatggatataagggggttgacgcaggacgatacggcgacgtatttctgtgcgaggcagaagttcgagaggggggggcaggggtggatatttgacctgtgggggagggggacgttgatagcggtgagtagc

SEQ ID NO: 56665 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggagtagcgaggacatattcgagaggacggagttgatacattgggtgaggcaggcaccggggcaggggttggagtggatagggtgggtgaaggcggtgagtggggcggtgaattacgggagcttggactttaggcatagggtgagcttgacgagggacagggacttgagcacggcacatatggatataagggggttgacgcaggacgatacagcgacgtatttctgtgcgaggcagaagttcgcgaggggggaccaggggtggttctttgacttgtgggggagggggacgttgatagtggtgtcgagc

SEQ ID NO: 56666 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggagcgagcgtgcgagtgagctgttggacgagcgaggacatattcgagaaatcggaactgatccattgggtgcgccaggccccgggccagggcttggaatggatcgggtgggtgaaaacggtcacgggcgcggtcaatttcgggagctcggactttcgccagcgcgtgagcttgaccagggacagggacttgttcacggcccatatggatatcaggggcttgacacaggacgataccgcgatctatttctgtgccaggcaaaagttcgcgcgcggggaccagggctggttctttgacttgtgggggcgcgggaccttgatcgtggtctcgagc

SEQ ID NO: 56667 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctaacgcaaggggacacggccacgtacttttgcgcacgccagaaattttacgcgggcgggcaagggtggtatttcgatctctggggcaggggcacgctcatagtagtgagctcg

SEQ ID NO: 56668 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcgtgcactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctaacgcaaggggacacggccacgtacttttgcgcgcgccagaaatttgaaaggggcgggcaagggtggatattcgatctctggggcaggggcacgctcatagccgtgagctcg

SEQ ID NO: 56669 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagaggacggagttgatacattgggtgaggcaggcgccggggcaggggttagagtggatagggtgggtgaaggcggtgtcgggggcggtgaattacgggagcttggactttaggcatagggtgagcttgacgagggacagggacttgttcacggcgcatatggatataagggggttgacgcagggggatacggcgacgtatttctgtgcgaggcagaagttcgcgagaggggaccaggggtggttctttgacctgtgggggagggggacgttgatagtggtaagtagc

SEQ ID NO: 56670 - RNA, 375 nt, synthetic construct
  misc_feature 1..375: note = derived and/or modified sequence opt11 from anti-HIV-1_HeavyChain
  source 1..375: mol_type = other RNA
caggcgcatagggagcagagcgggagcggggtgaagaagccgggggcgagtgtgagggtgagttgttggacgagcgaggatatatttgagaggacggagttgatacattgggtgaggcaggcgccggggcaggggctggagtggatagggtgggtgaagacggtgacgggggcggtgaattttgggagcagtgactttaggcagagggtgagtttgacgagggacagggacttgtttacggcgcatatggatataagggggttgacgcagggggatacggcgacgtatttctgtgcgaggcagaagttttatgcgggagggcaggggtggtattttgacttgtgggggagggggacgttgatagtggtgagtagc

SEQ ID NO: 56671 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgagtgagctgtctcgcgagcgaggacatattcaagaccgagctcatacactgggtcaggcaagcgcccgggcaagggctcgagtggataggctgggtcaagatcgtgagcggggccgtgaactttggctcgccaaatttcaggcaaagggtctcgctaacgcgcgatcgcgatctctttaccgcgcacatggacatacgcgggctcacgcaaggggacacggccacgtacttttgcgcgcgccagaaatttgaaagaggcgggcaagggtggatattcgatctctggggcaggggcacgctcatagccgtgagctcg

SEQ ID NO: 56672 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaaggtgggggcgagcgtgagggtgagctgttggacgagcgaggacatattcgagaggacggagttgatacattgggtgaggcaggcgccggggcaggggttggagtggatagggtgggtgaaggcggtgagtggggcggtaaattacgggagcttggactttaggcatagggtgagcttgacgagggacagggacttgttcacggcgcatatggatataagggggttgacgcaggacgatacggcaatatatttctgtgcgaggcagaagttcgagaggggagggcaggggtggatatttgacttgtgggggagggggacgttgatagcggtgagtagc

SEQ ID NO: 56673 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctaatacactgggtcaggcaagcgcccgggcaagggctcgagtggataggatgggtcaagaccgtgacaggggccgtgaactttggctcgagcgatttcaggcaaagggtctcgctcacgcgcgatcgagatctctttaccgcgcacatggacatacgcgggctaacgcaaggggacacggccacgtacttttgcgcgcgccagaaatttgccaggggcgatcaagggtggtttttcgatctctggggcaggggcacgctcatagtcgtgagctcg

SEQ ID NO: 56674 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgcgagcggggtgaagaggccgggggcgagcgtgagggtgagctgttggacgagcgaggacatattcgagaggagtgagttgatatattgggtgaggcaggcgccggggcaggggttggagtggatagggtgggtgaagacggtgacgggggcggtgaatttcgggagcagtgactttaggcagagggtgagcttgacgagggacagggacttgttcacggcgcatatggatataagagggttgacgcagggggatacggcgacgtatttctgtgcgaggcagaagttctatgcgggggggcaggggtggtactttgacttgtgggggagggggacgttgatagtggtgagtagt

SEQ ID NO: 56675 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgacagaaatattacgcgggcgggcaagggtggtatttcgatctctggggcaggggcacgctcatagtcgtgagctcg

SEQ ID NO: 56676 - RNA, 375 nt, synthetic construct
  misc_feature 1..375: note = derived and/or modified sequence opt11 from anti-HIV-1_HeavyChain
  source 1..375: mol_type = other RNA
caggtccagctagtgcaatcgggctcgggcgtgaaaaagcccggggcctcggtcagggtctcgtgctggacctcggaagatatctttgaaaggaccgagctcatacactgggtcagacaagcgcccgggcaagggctcgagtggataggctgggtaaagatcgtgagcggggccgtgaactttggctcgccaaatttcaggcaaagggtctcgctaacgcgcgatcgcgatctctttaccgcgcacatggacatacgcgggctcacgcaaggggacacggccacatacttttgcgcgcgccagaaatttgaaaggggcgggcaagggtggatattcgatctctggggcaggggcacgctcatagccgtgagttcg

SEQ ID NO: 56677 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggatcgggagtgaaaaagccaggggccagtgtcagggtatcgtgctggacaagcgaagatatatttgaaaggacagagctaatacactgggtcaggcaagcgccagggcaagggctagagtggataggctgggtaaagatagtgagcggggccgtgaactttggctcgccaaatttcaggcaaagggtaagtctaacgagagatagagatctatttacagcgcacatggacataagagggctaacgcaaggggacacggccacgtacttctgcgcgagacagaaatttgaaaggggcgggcaagggtggatattcgacctatggggcaggggaacgctaatagccgtgagctcg

SEQ ID NO: 56678 - RNA, 372 nt, synthetic construct
  misc_feature 1..372: note = derived and/or modified sequence opt11 from anti-HIV-1_HeavyChain
  source 1..372: mol_type = other RNA
cgccatacctgggaacagagcgggagcggggtcaagaaaccgggcgcgagcgtgcgagtgagctgttggacgagcgaggacatattcgagcgcacggaattgatccattgggtgcgccaggccccgggccagggcttggaatggatcgggtgggtgaaaacggtcacgggcgcggtcaatctagcgcccaatttcaggcacagggtctcgctcacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtagtgagctcg

SEQ ID NO: 56679 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaagggagcgagctaatacactgggtcaggcaagcgcccgggcaagggctcgagtggataggctgggtcaagaccgtgaccggggccgtgaactttggctcgagcgatttcaggcaaagggtctcgctcacgcgagatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56680 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgagcgatttcaggaacaggatctcgctctcgcgagatcgcgatctctcgaccgcgcacatggacatacgcgggctcacgcaaggggacacggccacgtacttttgcgcgcgccagaaatattacgcgggagggcaagggtggtatttcgatctctggggcaggggcacgctcatagtcgtgagctcg

SEQ ID NO: 56681 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatcttcgaaaggaccgagctcatacactgggtcaggcaagcgcccgggcaagggctcgagtggataggctgggtcaagatcgtgagcggggccgtgaactttggctcacccaatttcagacaaagggtctcgctcacgcgcgatcgcgatctctttaccgcgcacatggacatacgcgggctcacgcaaggggacacggccacgtacttctgcgcgcgacagaaatttgaaaggggcgggcaagggtggatattcgatctctggggcaggggaacgctcatagccgtgagctcg

SEQ ID NO: 56682 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggatgggtcaagaccgtgaccggggccgtaaactttggctcgagcgatttcaggcaaagggtctcactcacgcgcgatcgcgatctctttaccgcgcacatggacatacgcgggctcacgcaaggggacacggccacgtacttttgcgcgcgccagaaattttacaagggcgggcaagggtggtatttcgatctctggggcaggggcacgctcatagtcgtgagctcg

SEQ ID NO: 56683 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagagtctcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcacagggtctcgctcacacgcgatcgcgatctctttaccgcgcacatggacatacgagggctcacgcaaggggacacggccacgtacttttgcgcgcgacagaaatttgccaggggcgatcaagggtggtttttcgatctctggggcaggggcacgctcatagtcgtgagctcg

SEQ ID NO: 56684 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagctgggggcgagcgtgagggtgagctgttggacgagcgaggacatattcgagaggacggagttgatacattgggtgaggcaggcgccggggagggggttggagtggatagggtgggtgaaggcggtgagtggggcggtgaattacgggagcttggactttaggcatagggtgagcttgacgagggacagagacttgttcacggcgcatatggatataagggggttgacgcagggggatacggcgacgtatttctgtgcgaggcagaagttcgagaggggagggcaggggtggtactttgacttgtgggggagagggacgttgatagtggtatcgagc

SEQ ID NO: 56685 - RNA, 375 nt, synthetic construct
  misc_feature 1..375: note = derived and/or modified sequence opt11 from anti-HIV-1_HeavyChain
  source 1..375: mol_type = other RNA
caggcgaggccggggacgagcgggagcggggtgaagaagccgggggcgagtgtgagggtgagctgttggagtagcgaggacatattcgagaggacggagttgatacattgggtaaggcaggcgccggggcaggggttggagtggatagggtgggtgaagacggtgacgggggcggtgaatttcgggagcttggactttaggcagagggtgagtttgacgagggacagggacttgttcacggcgcatatggatataagggggttgacgcagggggatacggcgacgtatttctgtgcgaggcagaagttcgagaggggggggcaggggtggatatttgacttgtgggggagagggacgttgatagcggtgagtagc

SEQ ID NO: 56686 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgagacaggcgccggggcaggggttggagtggatagggtgggtgaagacggtaacgggggcggtgaatttcgggagcccgaactttaggcatagggtgagcttgacgagggacagggacttgttcacggcgcatatggatataagggggttgacggagggggatacggcgacgtatttctgtgcgaggcagaagttcgagaggggggggcaggggtggatatttgacttgtgggggagggggacgttgatagcggtaagtagc

SEQ ID NO: 56687 - RNA, 375 nt, synthetic construct
  misc_feature 1..375: note = derived and/or modified sequence opt11 from anti-HIV-1_HeavyChain
  source 1..375: mol_type = other RNA
caagcgcacctggaacagagcgggagcggggtcaagaaaccgggcgcgagcgtgcgcgtaagctgttggacgagcgaggacatattcgagcgcacggaactgatccattgggtgcgccaggccccgggccagggcctggaatggatcgggtgggtgaaagcgatatcgggcgcggtcaattacgggagcctggactttcgccatcgcgtgagcttgaccagggacagggacttgttcacagcccatatggatatcaggggcctgacccaggacgataccgcgacctatttctgtgccaggcaaaagttcgcgcgcggggaccagggctggttctttgacttgtgggggcgcgggaccctaatcgtggtctcgagc

SEQ ID NO: 56688 - RNA, 375 nt, synthetic construct
  misc_feature 1..375: note = derived and/or modified sequence opt11 from anti-HIV-1_HeavyChain
  source 1..375: mol_type = other RNA
caggcacacctggagcaaagcggaagcggagtgaaaaagccgggggcaagcgtaagggtaagctgctggacaagcgaagacatattcgaaaagagcgagctaatacactgggtaaggcaggcgccggggcaagggctggagtggataggatgggtaaagacagtgacaggggcggtgaacagcggaagcccgaacttcaggcacagggtaagcctgacgagagacagagacctgttcacagcgcacatggacataagagggctgacgcaaggggacacggcgacgtacttctgcgcgagacagaaattcgaaaggggagggcaggggtggtacttcgacctatggggaagggggacgctaatagtagtgagcagc

SEQ ID NO: 56689 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagagggcggagttgatacattgggtgagacaggcgccgggacaggggttggagtggatagggtgggtgaagacggtgagtggggcggtaaatttcgggagcctgaactttaggcatagggtgagtttgacgagggacagggacttgttcacggcgcatatggatataagggggttgacgcagggggatacggcaacgtatttctgtgcgaggcagaagttcgcgagaggggaccaggggtggttctttgacctgtgggggagggggacgttgatagtggtaagtagc

SEQ ID NO: 56690 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtcaattacgggagcttggactttcgacatcgcgtgagcctgaccagggacagagacttgagcacggcccatatggatatcaggggcttgacccaggacgatacagcgacctatttctgtgccaggcaaaagttcgcgcgcggggaccagggctggttctttgacttgtgggggcgagggaccttggtcacggtctcgagc

SEQ ID NO: 56691 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcttgaactttaggcatagggtgagcttgacgagggacagggacttgttcacggcgcatatggatataagggggttgacgcagggggatacggcgacgtatttctgtgcgaggcagaagttcgagagaggagggcaggggtggtactttgacttgtgggggagggggacgttgatagtggtgtcgagc

SEQ ID NO: 56692 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatacattgggtgcgacaggccccgggccagggcttggaatggatcgggtgggtgaaaacggtcacgggcgcagtcaatttcgggagtccgaactttcgccatcgcgtgagcttgaccagggacagggacttgagcacggcccatatggatatcaggggcttgacccaggacgataccgcgacctatttctgtgccaggcaaaagttcgcgcgcggggaccagggctggttctttgacttgtgggggcgcgggaccttgatcgtggtctcgagc

SEQ ID NO: 56693 - RNA, 375 nt, synthetic construct
  misc_feature 1..375: note = derived and/or modified sequence opt11 from anti-HIV-1_HeavyChain
  source 1..375: mol_type = other RNA
caatcacacctcgaacaatccggctcagccatgaaaaaacccggcgcctccgtccgcgtctcctgctggacctccgaagacatcttcgacaccaccgaactcatctactgggtccgccaagcccccggccaaggcctcgaatggatcggatgggtcaaaaccgtcaccggcgccgtcaacttcggctcacccaacttccgccaccgcgtctccctcacccgcgaccgcgacctcttcaccgcccacatggacatccgcggcctcacccaaggcgacaccgccacctacttctgcgcccgccaaaaatactacgccggcggacaaggctggtacttcgacctctggggccgcggcaccctcatcgtcgtctcctcc

SEQ ID NO: 56694 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagagaacggagttgatacattgggtgaggcaggcgccggggcaggggttggaatggatagggtgggtgaagacggcgtcgggggcggtgaatttcgggagcccgaactttaggcatagagtgagcttgacgagggacagggacttgttcacggcgcatatggatataagggggttgacgcagggggatacggcgacgtatttctgtgcgagacagaagttcgagaggggggggcaggggtggtactttgacttgtgggggagggggacgttgatagtggtgagtagc

SEQ ID NO: 56695 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagtgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagagacagggacttgttcacggcgcatatggatataagggggttgacgcaggacgatacggcgacgtatttctgtgcgaggcagaagttcgagaggggggggcaggggtggtactttgacttgtgggggagggggacgttgatagtggtgagtagc

SEQ ID NO: 56696 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgcgagcggggtcaagcgaccgggcgcgagcgtgcgcgtgagctgttggacgagcgaggacatattcgagcgctcggaattgatctattgggtgcgacaggccccgggccagggcttggaatggatcgggtgggtgaaaacggtctcgggcgcggtcaatttcgggagcacggactttcgcgagcgcgtgagcttgaccagggacagggacttgttcacggcccatatggatatcaggggattgacccagggcgataccgcgacctatttctgtgccaggcaaaagttcgagcgcgggggccagggctggtactttgacttgtgggggcgagggaccttgatcgtggtctcgagc

SEQ ID NO: 56697 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacatcggaagatatctttgaaaggaccgagctcatacactgggtcaggcaagcgcccgggcaagggctcgagtggataggctgggtcaaggccgtgagcggggtcgtgaactatggctcgctcgatttcaggcacagggtctcgctcacgcgagatcgcgatctctcgaccgcgcacatggacatacgagggctcacgcaagatgacacggccacgtacttttgcgcgcgacagaaatttgccaggggcgatcaagggtggtttttcgatctctggggcaggggcacgctcatagtcgtgagctcg

SEQ ID NO: 56698 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaaggtgggggcgagcgtgagagtgagctgttggacgagcgaggacatattcgagaggacggagttgatacattgggtgaggcaggcgccggggcaggggttggagtggatagggtgggtgaagacggtgagtggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56699 - RNA, 375 nt, synthetic construct
  misc_feature 1..375: note = derived and/or modified sequence opt11 from anti-HIV-1_HeavyChain
  source 1..375: mol_type = other RNA
caggcctatctcgagcaatcgggctcgatcatgaaaaagcccggggcctcggtcagggtctcgtgctggacctcggaagatatctttgacaggaccgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctatttaccgcgcacatggacatacgcgggctcacgcaaggggacacggccacgtacttttgcgcgcgccagaaattttacgcgggcgggcaagggtggtatttcgatctatggggcaggggcacgctcatagtcgtgagctcg

SEQ ID NO: 56700 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggctcgcgcccgggcaagggctagagtggataggctgggtcaagaccgtgaccggggccgtgaactttggatcgagcgatttcaggcaaagggtctcgctcacgcgcgaccgcgatctctttacagcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56701 - RNA, 375 nt, synthetic construct
  misc_feature 1..375: note = derived and/or modified sequence opt11 from anti-HIV-1_HeavyChain
  source 1..375: mol_type = other RNA
gaggcccatctagagcaatcgggctcgggcgtgaaaaagcccggggcctcggtaagggtctcgtgctggacctcggaagatatctttgaaaggaccgaactcacgcactgggtcaggcaagcacccgggcaagggctcgagtggataggctgggtcaagaccgtgaccggggccgtgaactttggctcgcccaatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggaacgctcatagccgtgagctcg

SEQ ID NO: 56702 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtaaagaagccgggggcgagcgtgagagtgagctgttggacgagcgaggacatatacgagaggacggagttgatacattgggtgaggcaggcgccggggcaggggttggagtggatagggtgggtgaaggcggtgtcgggggcggtgaattacgggagcttggactttaggcatagggtgagcctgacgagggacagggacttgttcacggcgcatatggatataaggggattgacgcaggacgatacggcgatatatttctgtgcgaggcagaagttcgcgagaggggaccagggatggttctttgacttgtgggggcgagggacgttgatagtggtgtcgagc

SEQ ID NO: 56703 - RNA, 375 nt, synthetic construct
  misc_feature 1..375: note = derived and/or modified sequence opt11 from anti-HIV-1_HeavyChain
  source 1..375: mol_type = other RNA
caagtgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtaaatttcgggagcccgaactttcgccatcgcgtgagcttgaccagggacagagacttgttcacggcccatatggatatcaggggcttgacccagggcgataccgcaacctatttctgtgccagacaaaagttcgagcgcgggggccagggctggtactttgacttgtgggggcgcgggaccttgatcgtggtctcgagc

SEQ ID NO: 56704 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaaggtgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagggacagggacttgagcacggcgcatatggatataagggggttgacacaggacgatacggcgacgtatttctgtgcgaggcagaagttcgcgagaggggaccaggggtggttctttgacttgtgggggagggggacgttgatagtggtgagtagc

SEQ ID NO: 56705 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggacagagctcatacactgggtcaggcaagcgcccgggcaagggctcgagtggataggctgggtcaagaccgtgagcggggccgtgaactttggcccgcccaatttcagacacagggtatcgctcacgcgcgatcgcgatctctttaccgcgcacatggacatacgcgggctaacgcaaggggacacggccacgtacttttgcgcgcgccagaaatttgaaaggggcgggcaagggtggtatttcgatctctggggcaggggcacgctcatagtcgtgagctcg

SEQ ID NO: 56706 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagtgtgagggtgagttgttggacgagcgaggacatattcgagaggacggagttgatacattgggtgaggcaggcgccggggcaggggttggagtggatagggtgggtgaaggcggtgagtggggcggtgaattacgggagcttagactttaggcatagggtgagtttgacgagggacagggacttgagcacggcgcatatggatataagggggttgacgcaggacgatacggcgacgtatttctgtgcgaggcagaagttcgagaggggggggcaggggtggatatttgacttgtgggggagggggacgttgatagcggtgagtagc

SEQ ID NO: 56707 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggagtgcgcaagcccggggcatcggtcagggtctcgtgctggacctcggaagatatctttgaaaggacagagctcatacactgggtcaggcaagcgcccgggcaagggctcgagtggataggctgggtaaagacagtgaccggggccgtgaactttggctcgagcgatttcaggcaaagggtatcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56708 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagaggacggagttgatacattgggtgaggcaggcgccggggagggggttggagtggatagggtgggtgaaggcggtgagtggggcggtgaattacgggagcccgaactttagacatagggtgagcttgacgagggacagggacttgttcacggcgcatatggatataagggggttgacgcagggggatacggcgacgtatttctgtgcgaggcagaagttcgagaggggagggcaggggtggtactttgacttgtgggggagggggacgttgatagtggtgagtagc

SEQ ID NO: 56709 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcaggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgagcggggccgtgaactttggctcgcccaatttcaggcacagggtctcgctaacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcgcgctcatagtcgtgagctcg

SEQ ID NO: 56710 - RNA, 375 nt, synthetic construct
  misc_feature 1..375: note = derived and/or modified sequence opt11 from anti-HIV-1_HeavyChain
  source 1..375: mol_type = other RNA
caggcacacctggagcaaagcggaagcggagtgaaaaagccgggggcaagcgtaagggtaagctgctggacaagcgaagacatattcgaaaagagcgagctgatacactgggtaaggcaggcgccggggcaagggctggagtggataggatgggtaaagacagtgacaggggcagtgaacttcggaagcgcatacttcaggcacagggtaagcctgacgagagacagagacctattcacagcgcacatggacataagagggctgacgcaaggggacacggcaacgtacttctgcgcgagacagaaattctacaagggagggcaggggtggtacttcgacctgtggggaagggggacgctaatagtagtgagcagc

SEQ ID NO: 56711 - RNA, 375 nt, synthetic construct
  misc_feature 1..375: note = derived and/or modified sequence opt11 from anti-HIV-1_HeavyChain
  source 1..375: mol_type = other RNA
caatcgcacttggaacagagcgggagcgcgatgaagaaaccgggcgcgagcgtgcgcgtgagctgttggacgagcgaggacatattcgagcgcacggaattgatctattgggtgcgacaggccccgggcaggggcttggaatggatcgggtgggtgaaaacggtctcgggcacagtcaatttcgggagcttggactttcgccatcgcgtgagcttgaccagggacagggacttgagcacggcccatatggatatcaggggcttgacccaggacgataccgcgacctatttctgtgccaggcaaaagttcgcgcgcggggaccagggctggttctttgacttgtgggggcgcgggaccttgatcgtggtctcgagc

SEQ ID NO: 56712 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagagtctcgtgctggacctcggaagatatctttgacacgaccgagctcatatactgggtcaggcaagcgcccgggcaagggctcgagtggataggctgggtaaagatcgtgagcgggaccgtgaactttgcatcaagcgatttcaggaacaggatctcgctctcgcgcgatcgcgatctctcgaccgcgcacatggacatacgcgggctcacgcaagatgacacggccacgtacttttgcgcgcgacagaaattttacgcgggcgggcaagggtggtatttcgatctatggggaaggggcacgctcatagtcgtgagctcg

SEQ ID NO: 56713 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgaccggggccgtgaactttggctcgagcgatttcaggcaaagggtctcgctcacgcgcgatcgcgatctctttacagcgcacatggacatacgagggctcacgcaaggggacacggccacgtacttttgcgcgcgccagaaattttacgcgggcgggcaagggtggtatttcgatctctggggcaggggcacgctcatagtcgtaagctca

SEQ ID NO: 56714 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacatcggaagatatctttgaaaggaccgagctcatatactgggtcaggcaagcgcccgggcgcgggctcgagtggataggctgggtcaagaccgtgagcggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctaatagtcgtgagctcg

SEQ ID NO: 56715 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagtggggtgaaaaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttagacatagggtgagcttgacgagggacagggacttgttcacggcgcatatggatataagggggttgacgcagggggacgcggcgacgtatttctgtgcgaggcagaagttcgagagaggggggcaggggtggtactttgacttgtgggggagagggacgttgatagtggtgagtagc

SEQ ID NO: 56716 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctaggggcctcggtcagggtctcgtgctggacctcggaagatatctttgaaaggaccgagctcatacactgggtcaggcaagcgcccgggcgcgggctcgagtggataggatgggtcaaggccgtgagcggggccgtgaactatggctcgctcgatttcaggcacagggtctcgctaacgcgcgatcgcgatctctttaccgcgcacatggacatacgagggctcacgcaagatgacacggccacgtacttttgcgcgcgccagaaattttacgcgggcgggcaagggtggtatttcgatctctggggcaggggcacgctcattgtcgtgagctcg

SEQ ID NO: 56717 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagatagtgagtggggcggtgaatttcgggagcccgaactttaggcagagggtgagcttgacgagggacagggacttgttcgcggcgcatatggatataagggggttgacgcagggggatacggcgacgtatttctgtgcgaggcagaagttcgagaggggagggcaggggtggatatttgacttgtgggggagggggacgctgatagcggtgagtagc

SEQ ID NO: 56718 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcacagggtctcgctcacgcgcgatcgagatctctttaccgcgcacatggacatacgcgggctcgcgcaaggggacacggccacgtacttttgcgcgcgccagaaatttgaaaggggcgggcaagggtggtatttcgatctctggggcaggggcacgctcatagtcgtgagctcg

SEQ ID NO: 56719 - RNA, 375 nt, synthetic construct
  misc_feature 1..375: note = derived and/or modified sequence opt11 from anti-HIV-1_HeavyChain
  source 1..375: mol_type = other RNA
caatcgcacttggaacagagcgggagcgcgatgaagaaaccgggcgcgagcgtgcgcgtgagctgttggacgagcgaggacatattcgataccacggaattgatctattgggtgcgccaggccccgggccagggcttggaatggatcgggtgggtgaaaatagtctcgggcacggtcaatttcgcgagctcggactttcgcaatcgcataagcctgagcagggacagggacttgagcacggcccatatggatatcaggggcttgacccaggacgataccgcgacctatttctgtgccaggcaaaagttcgagcgcgggggccagggctggtactttgacttgtgggggcgcgggaccttgatcgtggtctcgagc

SEQ ID NO: 56720 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggctgggtcaagatcgtaagcgggaccgtgaactttgcctcgctcgatttcaggaacagggtctcgctcacgcgcgatcgcgatctctttaccgcgcacatggacatacgcgggctcacgcaaggggacacggccacgtacttttgcgcacgacagaaattttacgcgggcgggcaagggtggtatttcgatctctggggcaggggcacgctcatagtcgtgagctca

SEQ ID NO: 56721 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggctggagtggatagggtgggtgaagatagtgagtggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56722 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcgcgcgcccgggcaagggctcgagtggataggctgggtcaagaccgtgaccggggccgtgaactttggctcgagcgatttcaggcaaagggtctcgctaacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56723 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagttgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagcttggactttaggcagagggtgagcttgacgagggacagggacttgttcacggcgcatatggatataagggggttgacgcagggggatacagcgacgtatttctgtgcgaggcagaagttcgagaggggagggcaggggtggatatttgacttgtgggggagagggacgttgatagcggtgagtagc

SEQ ID NO: 56724 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcagtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaattttacaagggcgggcaagggtggtatttcgatctctggggcaggggcacgctaatagtcgtgagctcg

SEQ ID NO: 56725 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccgggacctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgacctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56726 - RNA, 375 nt, synthetic construct
  misc_feature 1..375: note = derived and/or modified sequence opt11 from anti-HIV-1_HeavyChain
  source 1..375: mol_type = other RNA
cagagccatctcgagcaatcgggatcggccatgaaaaagcccggggcctcggtcagggtctcgtgctggacctcggaagatatctttgacacgaccgagctcatatactgggtcaggcaagcgcccggacaagggctcgagtggataggctgggtcaagatcgtgagcgggaccgtgaactttgcctcgctcgatttcaggaacaggatctcgctctcgcgcgatcgcgatctctcgaccgcgcacatggacatacgcgggctcacgcaagatgacacggccacgtacttttgcgcgcgacagaaattttacgcgggcggacaagggtggtatttcgatctctggggcaggggcacgctcatagtcgtgagctca

SEQ ID NO: 56727 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgagtgagctgttggacgagcgaggacatattcgagcgcacgggcttgatccattgggtgcgccaggccccgggacagggcttggaatggatcgggtgggtgaaagcggtctcgggcgcggtcaattacgggagcttggactttcgccatcgcgtgagcttgaccagggacagggacttgttcacggcccatatggatatcaggggcttgacccaggacgataccgcgacctatttctgtgccaggcaaaagttcgcgcgcggggaccagggctggttctttgacttgtgggggcgcgggaccttgatcgtggtctcgagc

SEQ ID NO: 56728 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccggggacgagcgtgagggtgagctgttggacgagcgaggacgtgttcgagaggacggagttgatacattgggtgaggcaggcgccggggcaggggttggagtggatagggtgggtgaagacggtgataggggcggtgaatttcgggagcccgaactttaggcatagggtgagcttgacgagggacagggacttgttcacggcgcatatggatataagggggttgacgcagggggatacggcgacgtatttctgtgcgagacagaagttcgagaggggagggcaggggtggtactttgacctgtgggggagggggacgttgatagtggtgagtagc

SEQ ID NO: 56729 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcggggccggggtcaagaaaccgggcgcgagcgtgcgcgtgagctgttggacgagcgaggacatattcaagaccgagctcatacactgggtcaggcaagcgcccgggcaagggctcgagtggataggctgggtcaagatcgtgagcggggccgtgaactttggctcacccaatttcaggcaaagggtctcgctaacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56730 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacaaagcggaagcggggtcaagaaaccgggcgcgagcgtgagagtgagctgttggacgagcgaggacatattcgagcgcacagaattgatccactgggtacgccaggccccaggccagggcttggaatggatcgggtgggtaaaaacggtctcgggcgcagtcaatttcgggagcccggactttcgacatcgcgtgagcctgaccagagacagggacctgttcacagcccatatggatatcagaggcctgacccagggcgataccgcgacctatttctgtgcaaggcaaaagttcgcgcgcggggaccagggctggttctttgacctgtgggggcgcgggaccttaatcgtggtctcgagc

SEQ ID NO: 56731 - RNA, 375 nt, synthetic construct
  misc_feature 1..375: note = derived and/or modified sequence opt11 from anti-HIV-1_HeavyChain
  source 1..375: mol_type = other RNA
caggcacatctcgagcaatcgggctcgggcgtaaaaaggcccggggcctcggtaagggtctcgtgctggacctcggaagatatcttcgaaacgaccgagctaatacactgggtcaggcaagcgcccgggcaagggctcgagtggataggctgggtcaagaccgtgagcggggccgtgaactttggctcgctaaatttcaggcacaggatctcgctaacgcgcgaccgcgatctctttaccgcgcacatggacatacgcgggctcacgcaaggggacacggccacgtacttctgcgcgcgccagaaatttgccaggggcgatcaaggatggtttttcgatctctggggcagaggcacgctcatagtcgtgagctcg

SEQ ID NO: 56732 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagctgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagtttggactttaggcatagggtgagtctgacgagggacagggacttgagcacggcgcatatggatataagggggttgacgcaggacgatacggcgatatatttctgtgcgaggcagaagttcgcgaggggggaccaggggtggttctttgacttgtgggggagggggacattgatagtggtgagtagc

SEQ ID NO: 56733 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacaagcgaggacatattcgagcgaacggaattgatccattgggtgcgccaggccccgggccagggattggaatggaccgggtgggtgaaagcggtctcgggcgcggtcaattacgggagcctggactttcgccatcgcgtgagcttgaccagggacagagacttgagcacggcccatatggatataaggggcttgacccaggacgataccgcgacctatttctgtgccaggcaaaagttcgcgcgcggggaccagggctggttctttgacttgtgggggcgcgggaccttgatcgtggtctcgagc

SEQ ID NO: 56734 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctaggggcctcggtcagggtctcgtgctggacctcagaagatatctttgaaaggaccgagctcatacactgggtcagacaagcgcccgggcaagggctcgagtggataggctgggtcaaggccgtgagcggggccgtgaactatggctcgctcgatttcaggcacagggtctcgctcacgcgcgatcgcgatctatttaccgcgcacatggacatacgcgggcccacgcaagatgacacggccacgtacttttgcgcgcgccagaaatttgccaggggcgatcaagggtggtttttcgatctctggggcaggggcacgctcatagtcgtgagctcg

SEQ ID NO: 56735 - RNA, 375 nt, synthetic construct
  misc_feature 1..375: note = derived and/or modified sequence opt11 from anti-HIV-1_HeavyChain
  source 1..375: mol_type = other RNA
caggcccatctagagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctcgaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56736 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggtcgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcacatatggatataagggggttgacgcagggggatacggcgacgtatttctgtgcaaggcagaagttcgagaggggagggcaggggtggtactttgacttgtgggggagagggacgttgatagtggtgagtagc

SEQ ID NO: 56737 - RNA, 375 nt, synthetic construct
  misc_feature 1..375: note = derived and/or modified sequence opt11 from anti-HIV-1_HeavyChain
  source 1..375: mol_type = other RNA
aggcacacgtggaatgaatcgggctcgggcgtgaaaaagcccggggcctcggtcagggtctcatgctggacctcggaagatatctttgaaaggaccgagctcatacactgggtcaggcaagcgcccgggcaagggctcgagtggataggctgggtcaagaccgtgaccgggaccgtgaactttggctcgctcaatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctaatagtcgtgagctcg

SEQ ID NO: 56738 - RNA, 375 nt, synthetic construct
  misc_feature 1..375: note = derived and/or modified sequence opt11 from anti-HIV-1_HeavyChain
  source 1..375: mol_type = other RNA
caagcacacctagaacaaagcggagccggagtcaaacgcccaggcgcaagcgtacgcgtaagctgctggacaagcgaagacatattcgagaccacagaactgatccactgggtacgacaggccccgggccaaggcctggaatggatcggatgggtaaaaacagtctcaggcgcagtcaacttcggaagcccaaacttccgccaccgcgtaagcctgaccagagacagagacctattcacagcccacatggacatcagaggcctgacccaaggcgacaccgcgacctacttctgcgccagacaaaaattcgaacgcggaggccagggctggtacttcgacctgtggggacgcgggaccctaatcgtagtctcaagc

SEQ ID NO: 56739 - RNA, 375 nt, synthetic construct
  misc_feature 1..375: note = derived and/or modified sequence opt11 from anti-HIV-1_HeavyChain
  source 1..375: mol_type = other RNA
caggcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtcaatttcggaagcccgaactttcgccatcgcgtgagcttgacaagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56740 - RNA, 375 nt, synthetic construct
  misc_feature 1..375: note = derived and/or modified sequence opt11 from anti-HIV-1_HeavyChain
  source 1..375: mol_type = other RNA
caggcccatctcgggaccatactcgggctcgagagcaagaaaccgggcgcgagcgtgcgcgtgagctgttggacgagcgaggacatattcgagcgcacggaattgatccattgggtgcgccaggccccgggccagggcctggaatggatcgggtgggtgaaaacggtcacgggcgcgagcatactcgcgcccaatttcaggcacagggtctcgctcacgcgagatcgcgatctctttaccgcgcacatggacatacgcgggctcacgcaaggggacacggccacgtacttttgcgcgcgccagaaatttgaaaggggagggcaagggtggtatttcgatctctggggcaggggcacgctcatagtagtgagctcg

SEQ ID NO: 56741 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttagaatggatcgggtgggtgaaaacggtcacgggcgcggtcaatttcgggagcccgaactttcgccatcgagtgagcttgaccagggacagggccttgttcacggcccatatggatatcaggggcttgacccagggcgataccgcgacctatttctgtgccaggcaaaagttcgcgcgcggggaccagggctggttctttgacttgtgggggcgcgggaccttgatcgtggtctcgagc

SEQ ID NO: 56742 - RNA, 375 nt, synthetic construct
  misc_feature 1..375: note = derived and/or modified sequence opt11 from anti-HIV-1_HeavyChain
  source 1..375: mol_type = other RNA
cgagtgcacttggaacagagcgggagcggggtcaagaaaccgggcgcgagcgtgcgcgtgagctgctggacgagcgaggacatattcgagcgcacggaattgatccattgggtgcgccaggccccgggccagggcttggaatggatcgggtgggtgaaaacggtcacgggcgcggtcaatttcgggagcccgaactttcgacatcgcgtgagcttgaccagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtatcgagc

SEQ ID NO: 56743 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcggggcgggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcagagggtgagcttgacaagggacagggacttgagcacggcgcatatggatataagggggttgacgcaggacgatacggcgacgtatttctgtgcgaggcagaagttcgcgaggggggaccaggggtggttctttgacttgtgggggagggggacgttgatagtggtgagtagc

SEQ ID NO: 56744 - RNA, 375 nt, synthetic construct
  misc_feature 1..375: note = derived and/or modified sequence opt11 from anti-HIV-1_HeavyChain
  source 1..375: mol_type = other RNA
caagtgcaattggtccagagcggggccgaggtcaagcgaccgggcgcgagcgtgaaagtgagctgttggacgagcgaggacatattcgagcgcacggaattgatccattgggtgcgccaggccccgggccagggcttggaatggatcgggtgggtgaaaacggtctcgggcgcggtcaatttcgggagcccgaactttcgccatcgcgtgagcttgacaagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 56745 - RNA, 375 nt, synthetic construct
  misc_feature 1..375: note = derived and/or modified sequence opt11 from anti-HIV-1_HeavyChain
  source 1..375: mol_type = other RNA
aggcacgatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtaaagatcgtgagcggggccgtgaactttggctcgcccaatttcaggcaaagggtctcgctcacgcgcgaccgagacctctttaccgcgcacatggacatacgcgggctcacgcaaggggacacggccacgtacttttgcgcgcgacagaaatttgaaaggggcgggcaagggtggatattcgatctctggggcaggggcacgctaatagccgtgagctcg

SEQ ID NO: 56746 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaagtgtggtcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgagatctctttaccgcgcacatggacatacgcgggctcacgcaaggggacacggccacgtacttttgcgcgcgccagaaattttacgcgggcgggcaagggtggtatttcgatctatggggaaggggcacgctcatagtcgtgagctcg

SEQ ID NO: 56747 - RNA, 375 nt, synthetic construct
  misc_feature 1..375: note = derived and/or modified sequence opt11 from anti-HIV-1_HeavyChain
  source 1..375: mol_type = other RNA
cgacatacctggaacaagagcggaagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtaaattacgggagcttggactttcgccatcgcgtgagcttgaccagggacagggacttgagcacggcccatatggatatcaggggcttgacccaggacgataccgcgacctatttctgtgccaggcaaaagttcgcgcgcggggaccagggctggttctttgacttgtgggggcgcgggaccctgatcgtggtctcgagc

SEQ ID NO: 56748 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 56749 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaggcccggggcctcggtcagggtctcgtgctggacctcggaagatatctttgaaacgaccgagctcatacactgggtcaggcaagcgcccgggcaagggctcgagtggataggctgggtcaaggccgtgagcggggccgtgaactatggctcgctcgatttcaggcacagggtctcgctcacgcgagatcgcgatctctcgaccgcgcacatggacatacgcggactcacgcaagatgacacggccacgtacttttgcgcgcgacagaaatttgccaggggcgatcaagggtggttcttcgatctctggggcaggggcacgctcatagtcgtgagctcg

SEQ ID NO: 56750 - RNA, 375 nt, synthetic construct
  misc_feature 1..375: note = derived and/or modified sequence opt11 from anti-HIV-1_HeavyChain
  source 1..375: mol_type = other RNA
aggcatgacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagt

SEQ ID NO: 56751 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctcgaccgcgcacatggacatacgcgggctaacgcaagatgacacggccacgtacttttgcgcgcgacagaaatttgccaggggcgatcaagggtggtttttcgatctctggggcaggggcacgctcatagtcgtgagctcg

SEQ ID NO: 56752 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtaagggtctcgtgcttggcctcggaagatatctttgaaaagagcgagctcatacactgggtcaggcaagcgcccgggcaagggctcgagtggataggctgggtcaagaccgtgaccggggcagtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctaatagtcgtgagctcg

SEQ ID NO: 56753 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggcgcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacacgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56754 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaagcccggggcctcggtcagggtctcgtgctggacatcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56755 - RNA, 375 nt, synthetic construct
  misc_feature 1..375: note = derived and/or modified sequence opt11 from anti-HIV-1_HeavyChain
  source 1..375: mol_type = other RNA
aggcatacgtgggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccaaactttaggcatagggtgagcttgacgagggacagggacttgttcacggcgcatatggatataagggggttgacgcatggggatacggcgacgtatttctgtgcgaggcagaagttcgagaggggagggcaggggtggtactttgacttgtgggggagggggacgttgatagtggtgagtagc

SEQ ID NO: 56756 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaagctaggggcctcggtcagggtctcgtgctggacctcggaagatatctttgaaaggaccgagctcatacactgggtcaggcaagcgcccgggcaagggctcgagtggataggatgggtcaaggccgtgagcggggccgtgaactatggctcgctcgatttcaggcacagggtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56757 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggcgcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccacgtacttttgcgcgcgacagaaatttgccaggggcgatcaagggtggtttttcgatctctggggcaggggcacgctcatagtcgtgagctcg

SEQ ID NO: 56758 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtggaagtgagctgttggacgagcgaggacatattcgagcgcacggaattgatccattgggtgcgacaggccccgggccagggcttggaatggatcgggtgggtgaaaacggtatcgggcgcggtcaatttcgggagcccgaactttcgccatcgcgtgagcttgaccagggacagagacctgttcacggcacatatggatatcaggggcttgacccagggagataccgcgacctatttctgtgccaggcaaaagttcgcgcgcggggaccagggctggttctttgacttgtgggggcgcgggaccctgatcgtggtctcgagc

SEQ ID NO: 56759 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcggggccggggtcaagaaattgggcgcgagcgtgcgcgtgagctgttggacgagcgaggacatattcaagaccgagctcatacactgggtaaggcaagcgcccgggcaagggctcgagtggataggctgggtcaaggccgtgagcggggccgtgaactatggctcgctcgatttcaggcacagggtatcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56760 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgacagaaattttacgcgggcgggcaagggtggtatttcgatctctggggcaggggcacgctcatagtcgtgagctcg

SEQ ID NO: 56761 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcgcatatggtcgggcgtgaaaaagcccggggcctcggtcagggtatcgtgctggacctcggaagatatctttgaaaggaccgagctcatacactgggtcaggcaagcgcccgggcaagggctcgagtggataggctgggtcaagatcgtgagcggggccgtgaactttggctcgcccaatttcaggcaaagggtctcgctaacgcgcgatcgcgatctctttaccgcgcacatggacatacgcgggctcacgcaaggggacacggccacgtacttttgcgcgcgacagaaatttgaaaggggcgggcaagggtggatattcgatctctggggcaggggcacgctaatagccgtgagctcg

SEQ ID NO: 56762 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtcaattacgggagcttggactttcgccatcgcgtgagcttgaccagggacagggacttgagcacggcccatatggatatcaggcgcttgacccaggacgataccgcgacctatttctgtgccaggcaaaagttcgcgcgcggggaccagggctggttctttgacctgtgggggcgcgggaccttgatcgtggtctcgagc

SEQ ID NO: 56763 - RNA, 375 nt, synthetic construct
  misc_feature 1..375: note = derived and/or modified sequence opt11 from anti-HIV-1_HeavyChain
  source 1..375: mol_type = other RNA
aggcatacggtggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacaagggacagggacttgttcacggcgcatatggatataagggggttgacgcagggggatacggcgacgtatttctgtgcaaggcagaagttcgagaggggggggcaggggtggtactttgacttgtgggggagggggacgttgatagtggtgagtagc

SEQ ID NO: 56764 - RNA, 375 nt, synthetic construct
  misc_feature 1..375: note = derived and/or modified sequence opt11 from anti-HIV-1_HeavyChain
  source 1..375: mol_type = other RNA
caggcgcacctggagcagagcgggagcggggtgaagaagccgggggcgagcgtgagggtgagctgttggacgagcgaggacatattcgagaagagtgagttgatacattgggtgaggcaggcaccggggcaggggttggagtggatagggtgggtgaagacggtgacgggggcggtgaatttcgggagcagtgactttagacagagggtgagcttgacgccggacagggacttgttcacggcacatatggatataagggggttgacgcagggggatacggcgacgtatttctgtgcgaggcagaagttctatgcgggggggcaggggtggtacttcgacttgtgggggagggggacgttgatagtggtgagtagc

SEQ ID NO: 56765 - RNA, 375 nt, synthetic construct
  misc_feature 1..375: note = derived and/or modified sequence opt11 from anti-HIV-1_HeavyChain
  source 1..375: mol_type = other RNA
aggcatacggtggagcagagcgggagcggggtgaagaaggtgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagtttggactttaggcatagggtgagcttgacaagggacagggacttgttcacggcgcatatggatataagggggttgacgcaggacgatacggcgatatatttctgtgcgaggcagaagttcgcgaggggggaccaggggtggttctttgacttgtgggggagggggacgttgatagtggtgtcgagc

SEQ ID NO: 56766 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttgggcgagcgaggacatattcgagaggacggagttgatacattgggtgaggcaggcgccggggcaggggttggagtggatagggtgggtgaagacggtgagtggggcggtgaatttcgggagcccgaactttagacatagagtgagcttgacgagggacagggacctgttcacggcgcatatggatataagggggttgacgcagggggatacggcgacgtatttctgtgcgaggcagaagttcgagaggggggggcaggggtggtactttgacttgtgggggagggggacgttgatagtggtgtcgagc

SEQ ID NO: 56767 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaagtgtggtcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagacagtgaccggggccgtgaactttggctcgcccaatttcaggcacagggtctcgctcacgcgcgatcgcgatctctttaccgcgcacatggacatacgcgggctaacgcaaggggacacggccacgtacttttgcgcgcgccagaaatttgaaaggggcgggcaagggtggtatttcgatctctggggcaggggcacgctcatagtcgtgagctcg

SEQ ID NO: 56768 - RNA, 375 nt, synthetic construct
  misc_feature 1..375: note = derived and/or modified sequence opt11 from anti-HIV-1_HeavyChain
  source 1..375: mol_type = other RNA
aggcacacgtggaggcaatcgggctcgggagtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggtcgtgaactatggctcgctcgatttcaggcacagggtctcgctaacgcgcgatcgagatctctcgaccgcgcacatggacatacgcgggctcacgcaagatgacacggccacgtacttttgcgcgcgccagaaatttgccaggggagatcaagggtggtttttcgatctctggggcaggggcacgctcatagtcgtgagttcg

SEQ ID NO: 56769 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagtggggtgaagaagccgggggcgagcgtgagggtgagctgttggacaagcggggacatattcgagaggacggagttgatacattgggtgaggcaggcgccggggcaggggttggagtggatagggtgggtgaagatagtgtcgggggcggtgaatttcgggagtccgaactttaggcagagggtgagcttgacgagggacagggacttgttcacggcgcatatggatataagggggttgacgcagggggatacagcgacgtatttctgtgcgaggcagaagttcgagaggggggggcaggggtggatatttgacttgtgggggagggggacattgatagcggtgagtagc

SEQ ID NO: 56770 - RNA, 375 nt, synthetic construct
  misc_feature 1..375: note = derived and/or modified sequence opt11 from anti-HIV-1_HeavyChain
  source 1..375: mol_type = other RNA
aggcacacggtcgagcaatcgggctcgggcgtgaaaaagcccggggcctcggtcagggtctcgtgctggacatcggaagatatctttgaaaagagcgagctcatacactgggtcaggcaagcgcccgggcaagggctcgagtggataggctgggtcaagaccgtgaccggggccgtgaactttggctcgagcgatttcagacaaagggtatcgctcacgagagatcgagatctctttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcg

SEQ ID NO: 56771 - RNA, 375 nt, synthetic construct
  misc_feature 1..375: note = derived and/or modified sequence opt11 from anti-HIV-1_HeavyChain
  source 1..375: mol_type = other RNA
caggcgcacctggagcagagcgggagcggggtgaagaagaggtgggcgagcgtgagggtgagctgttggacgagcgaggacatattcgagaggacggagttgatacattgggtgaggcaggcgccggggcaggggttggagtggatagggtgggtgaaggcggtgtcgggggcggtgaattacgggagcttggactttaggcatagggtgagcttgacgagggacagggacttgttcacggcgcatatggatataagggggttgacgcaggacgatacggcgacgtatttctgtgcgaggcagaagttcgcgaggggggaccaggggtggttctttgacttgtgggggagggggacgttgatagtggtgagtagc

SEQ ID NO: 56772 - RNA, 375 nt, synthetic construct
  misc_feature 1..375: note = derived and/or modified sequence opt11 from anti-HIV-1_HeavyChain
  source 1..375: mol_type = other RNA
agacatacggtggagcagagcgggagcggggtgaagaggccgggggcgagcgtgagggtgagctgttggacgagcgaggacatattcgagacgacggagttgatacattgggtgaggcaggcgccggggcaggggttggagtggatagggtgggtgaagacggtgacgggggcggtgaatttcgggagcagcgactttaggcagagggtgagcttgacgagggacagggacttgttcacagcgcatatggatataagggggttgacgcagggggatacggcgacgtatttctgtgcgaggcagaagttctatgcgggggggcaggggtggtactttgacttgtgggggagggggacgttgatagtggtgagtagc

SEQ ID NO: 56773 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaaattgggggcgagcgtgagggtgagctgttggacgagcgaggacatattcgagaggacggagttgatacattgggtgaggcaggcgccgggacaggggttggagtggatagggtgggtgaaggcggtgagtggggcggtgaattacgggagcttggactttaggcatagggtgagcctgacgagggacagggggctgttcacggcgcatatggatataagggggttgacgcaggacgatacggcgacatatttctgtgcgaggcagaagttcgcgagaggggaccaggggtggttctttgacttgtgggggagggggacgttgatagtggtgagtagc

SEQ ID NO: 56774 - RNA, 375 nt, synthetic construct
  misc_feature 1..375: note = derived and/or modified sequence opt11 from anti-HIV-1_HeavyChain
  source 1..375: mol_type = other RNA
caggtgcacttggagcagagcgggagcggggtgaagaagccgggggcgagcgtgagggtgagctgttggacgagcgaggacatattcgagaagagtgagttgatacattgggtgagacaggcgccggggcaggggttggagtggatagggtgggtgaagacggtgacgggggcggcgaatttcgggagcagtgactttaggcagagggtgagcttgacgccggacagagacctgttcacggcgcatatggatataagggggttgacgcagggggatacggcgacgtatttctgtgcgaggcagaagttctataagggagggcaggggtggtactttgacttgtgggggagggggacgttgatagtggtgagtagc

SEQ ID NO: 56775 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggcgcgggcgtgaaaaagcccggggcctcggtcagggtctcgtgctggacctcggaagatatctttgacacgaccgagctcatacactgggtcaggcaagcgcccgggcaagggctcgagtggataggctgggtcaagatcgtgagcggggccgtgaactttggctcgcccaatttcaggcaaagggtctcgctcacgcgcgatcgcgatctctttacagcgcacatggacatacgcgggctcacgcaaggggacacggcaacgtacttttgcgcgcgccagaaatttgaaaggggcgggcaagggtggatattcgatctctggggcaggggcacgctcatagccgtgagttcg

SEQ ID NO: 56776 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcatgctggacctcgcgcgatatctttgaaaggaccgagctcatacactgggtcaggcaagcgcccgggcaagggctagagtggataggctgggtcaaggccgtgagcggggccgtgaactatggctcgctcgatttcaggcacagggtctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56777 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgtctcgcgagcgaggacatattcgagcgcacggaattgatccattgggtgcgccaggccccgggccagggcttggaatggatcgggtgggtgaaagcggtctcgggcgcggtcaattacgggagcttggactttcgacatcgcgtgagcttgaccagggacagggacttgagcacggcccatatggatatcaggggcctgacccaggacgataccgcgacctatttctgtgccaggcaaaagttcgcgcgcggggaccagggctggttctttgacttgtgggggcgcgggaccttgatcgtggtctcgagc

SEQ ID NO: 56778 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggccgagcgaggacatattcgagaggacggagttgatacattgggtgaggcaggcgccggggcaggggttggagtggatagggtgggtgaagacggtgacggggacggtgaatttcgggagtttgaactttaggcagagggtgagcttgacgagggacagggacctgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56779 - RNA, 375 nt, synthetic construct
  misc_feature 1..375: note = derived and/or modified sequence opt11 from anti-HIV-1_HeavyChain
  source 1..375: mol_type = other RNA
cgcgcgcacttggaacagagcgggagtgagtggaagaaattgggagcgagcgtgcgcgtgagctgttggacgagcggggacatattcgagcgcacggaattgatccattgggtgcgacaggccccgggccagggcttggaatggatcgggtgggtgaaagcggtctcgggcgcggtcaattacgggagcttggactttcgccatcgcgtgagcttgaccagggacagggacttgttcacggcccatatggatatcaggggcttgacccaggacgataccgcgacctatttctgtgccaggcaaaagttcgcgcgaggggaccagggctggttctttgacttgtgggggcgcgggaccttgatcgtggtctcgagc

SEQ ID NO: 56780 - RNA, 375 nt, synthetic construct
  misc_feature 1..375: note = derived and/or modified sequence opt11 from anti-HIV-1_HeavyChain
  source 1..375: mol_type = other RNA
aggcacacggtagagcaatcgggctcgggcgtgaaaaagctcggggcctcggtcaatgtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccacgtacttttgcgcgcgccagaaatttgccaggggcgatcaagggtggtttttcgatctctggggaaggggcacgctcatagtcgtgagctcg

SEQ ID NO: 56781 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagcccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56782 - RNA, 375 nt, synthetic construct
  misc_feature 1..375: note = derived and/or modified sequence opt11 from anti-HIV-1_HeavyChain
  source 1..375: mol_type = other RNA
aggcatacgtggaacaagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttagacatagggtgagcttgacgagggacagggacttgttcacggcgcatatggatataagggggttgacgcagggggatacggcgacgtatttctgtgcgaggcagaagttcgagaggggagggcaggggtggtactttgacttgtgggggagggggacgttgatagtggtgagtagc

SEQ ID NO: 56783 - RNA, 375 nt, synthetic construct
  misc_feature 1..375: note = derived and/or modified sequence opt11 from anti-HIV-1_HeavyChain
  source 1..375: mol_type = other RNA
caggcccatagcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagatcgtgagcggggccgtgaactttggctcgcccaatttcaggcaaagggtctcgctcacgcgagatcgcgatctctttaccgcgcacatggacatacgcgggctcacgcaaggggacacggccacgtacttttgcgcgcgccagaaatttgaaaggggcgggcaagggtggatattcgacctctggggcaggggcacgctcatagccgtgagctcg

SEQ ID NO: 56784 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcggggccggggtcaagcgcccgggcgcgagcgtgcgcgtgagctgttggacgagcgaggacatattcgagaccacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacctgttcacggcccatatggatatcaggggcttgacccagggcgataccgcgacctatttctgtgccaggcaaaagttcgagcgcgggggccagggctggtactttgacttgtgggggcgcgggaccttgatcgtggtctcaagc

SEQ ID NO: 56785 - RNA, 375 nt, synthetic construct
  misc_feature 1..375: note = derived and/or modified sequence opt11 from anti-HIV-1_HeavyChain
  source 1..375: mol_type = other RNA
gggcacacgtgggagcaatcaggagcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccatatacttttgcgcgcgccagaaatttgccaggggcgatcaagggtggtttttcgatctctggggcaggggcacgctcatagtcgtgagctcg

SEQ ID NO: 56786 - RNA, 375 nt, synthetic construct
  misc_feature 1..375: note = derived and/or modified sequence opt11 from anti-HIV-1_HeavyChain
  source 1..375: mol_type = other RNA
gggacgccggggagcgagagcgggagcggggtgaagaagttgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagggacagggacttgagcacggcgcatatggatataagggggttgacgcaggacgatacggcgacgtatttctgtgcgaggcagaagttcgcgagaggggaccaggggtggttctttgacttgtgggggagggggacgttgatagtggtgagtagc

SEQ ID NO: 56787 - RNA, 375 nt, synthetic construct
  misc_feature 1..375: note = derived and/or modified sequence opt11 from anti-HIV-1_HeavyChain
  source 1..375: mol_type = other RNA
ggcacgccagggagcgagagcgggagcggggtcaagatgccgggcgcgagcgtgcgcgtgagctgttggacgagcgaggacatattcgagcgcacggaattgatccattgggtgcgccaggccccgggccagggcttggaatggatcgggtgggtgaaaacggtctcgggcgcggtcaatttcgggagcccgaactttcgccatcgcgtgagcttgaccagggacagggacttattcacggcccatatggatatcaggggcttgacccagggcgataccgcgacctatttctgtgccaggcaaaagttcgagcgcgggggccagggctggtactttgacttgtgggggcgagggaccttgatagtggtctcgagc

SEQ ID NO: 56788 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggcgcgggcgtgaaaaagcccggggcctcggtcagggtctcgtgctggacctcagaagatatctttgaaaggacagagctaatacactgggtcaggcaagcgcccgggcaagggctagagtggataggctgggtaaagaccgtgagcggggcagtgaactttggctcgcccaatttcaggcacagggtctcgctcacgcgcgatcgcgatctctttaccgcgcacatggacatacgcgggctcacgcaaggggacacagccacgtacttttgcgcgcgccagaaatttgaaaggggcgggcaagggtggtatttcgatctctggggcaggggcacgctcatagtcgtgagctcg

SEQ ID NO: 56789 - RNA, 375 nt, synthetic construct
  misc_feature 1..375: note = derived and/or modified sequence opt11 from anti-HIV-1_HeavyChain
  source 1..375: mol_type = other RNA
gggacaccgggaaataaaagcggatcaggagtgaaaaagccaggggcatcggtaagggtaagttgctggacaagtgaagatatattcgaaaagagcgagctaatacactgggtaaggcaagcgccagggcaagggctggagtggataggatgggtaaagacagtgacaggggcagtgaactttggaagtagcgatttcaggcaaagggtgtcgctgacgagagacagagatctatttacagcgcacatggacataagagggctaacgcaaggggacacggcaacgtacttttgcgcgagacagaaattttacgcgggagggcaagggtggtatttcgatctatggggaaggggaacgctaatagtagtgagctcg

SEQ ID NO: 56790 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcggggcgggggtgaagaagccgggggcgagtgtgagggtgagttgttggagtagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56791 - RNA, 375 nt, synthetic construct
  misc_feature 1..375: note = derived and/or modified sequence opt11 from anti-HIV-1_HeavyChain
  source 1..375: mol_type = other RNA
gggacgccggggaacaagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagagtgagcttgacgagggacagggacttgttcacggcgcatatggatataagggggctgacgcagggggatacggcgacgtatttctgtgcgaggcagaagttcgagaggggggggcaggggtggatatttgacttgtgggggagggggacgttgatagcggtgagtagc

SEQ ID NO: 56792 - RNA, 375 nt, synthetic construct
  misc_feature 1..375: note = derived and/or modified sequence opt11 from anti-HIV-1_HeavyChain
  source 1..375: mol_type = other RNA
gggaccccgggcaataaatcgggctcgggagtgaaaaagcccggggcctcggtcagggtctcgtgctggagctcggaagatatctttgaaaggaccgagctaatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggaaggggcacgctcatagccgtgagctcg

SEQ ID NO: 56793 - RNA, 375 nt, synthetic construct
  misc_feature 1..375: note = derived and/or modified sequence opt11 from anti-HIV-1_HeavyChain
  source 1..375: mol_type = other RNA
caagcgcacttggagcagagcgcgagcggggtgaagaggccgggggggtgggtgagggtgagctgttggacgagcgaggacatattcgagaggagtgagttgatatattgggtgaggcaggcgccggggcaggggttggagtggatagggtgggtgaagacggtaacgggggcggtgaatttcgggagcccgaactttaggcatagggtgagcttgacgagggacagggacctgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56794 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagagaacggagttgatacattgggtgaggcaggcgccggggcaggggttggagtggatagggtgggtgaagacgagcagtggggcggtaaatttcgggagcccgaactttaggacgagggtgagcttgacgagggacagggacttgttcacggcgcatatggatataagggggttgacgcagggggatacggcgacatatttctgtgcgaggcagaagttcgagaggggggggcaggggtggtactttgacttgtgggggagggggacgttgatagtggtgagtagc

SEQ ID NO: 56795 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcggggcgggggtgaagaagccgggggcgagtgtgagggtgagctgttggacgagcgaggacatattcgagaggacggagttgatacattgggtgaggcaggcgccggggcaggggttggagtggatagggtgggtgaagacggtgagtggggcggtgaatttcgggagcccgaactttaggcatagggtgagcttgacgagggacagggacttgttcacggcgcatatggatataagggggctgacgcagggggatacggcgacgtatttctgtgcgagacagaagttcgagaggggggggcaggggtggtactttgacttgtgggggagggggacgttgatagtggtgagtagc

SEQ ID NO: 56796 - RNA, 375 nt, synthetic construct
  misc_feature 1..375: note = derived and/or modified sequence opt11 from anti-HIV-1_HeavyChain
  source 1..375: mol_type = other RNA
aggcatacgtgggagcagagcgggagcggggtgaagaagccgggggcgagcgtgagggtgagttgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcctgacgagggacagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 56797 - RNA, 375 nt, synthetic construct
  misc_feature 1..375: note = derived and/or modified sequence opt11 from anti-HIV-1_HeavyChain
  source 1..375: mol_type = other RNA
gggacgacgtggaacaagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggacataagggggttgacgcagggggatacggcgacgtatttctgtgcgaggcagaagttcgagaggggggggcaggggtggtactttgacttgtgggggagggggacgttgatagtggtgagtagc

SEQ ID NO: 56798 - RNA, 375 nt, synthetic construct
  misc_feature 1..375: note = derived and/or modified sequence opt11 from anti-HIV-1_HeavyChain
  source 1..375: mol_type = other RNA
aggcacacgtggaatgaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcg

SEQ ID NO: 56799 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcgggcaatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctatcgacagcgcacatggacatacgcgggctcacgcaagatgacacggccacgtacttttgcgcgcgccagaaatttgccaggggcgatcaagggtggtttttcgatctctggggcaggggaacgctcatagtcgtgagctcg

SEQ ID NO: 56800 - RNA, 378 nt, synthetic construct
  misc_feature 1..378: note = derived and/or modified sequence opt11 from anti-HIV-1_HeavyChain
  source 1..378: mol_type = other RNA
aggtgctcgatggagcaaccgggctggagcgagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcggtctcgtacgcgcgcaagttccagggcagggtctcgttctatatgacgcgcgagctagggatggcgtacatggacttgcgcaatctcaggttcgatgacacggccgtgtacttttgcgcgcgcaagaccgcgggcgatgtatcgggcgataacaggggctatttctttgacttgtgggggcgagggagcagggtcatagtctcgagc

SEQ ID NO: 56801 - RNA, 375 nt, synthetic construct
  misc_feature 1..375: note = derived and/or modified sequence opt11 from anti-HIV-1_HeavyChain
  source 1..375: mol_type = other RNA
aggcacacgagcgagcaatcgggctcgggcgtgaaaaagcccggggcctcggtcagggtctcgtgctggacctcggaagatatctttgaaaggagcgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatattacgcgggcgggcaagggtggtatttcgatctatggggcaggggcacgctcatagtcgtgagctcg

SEQ ID NO: 56802 - RNA, 375 nt, synthetic construct
  misc_feature 1..375: note = derived and/or modified sequence opt11 from anti-HIV-1_HeavyChain
  source 1..375: mol_type = other RNA
aggcacacggtcgagcaatcgggcgcgggagtgaaaaagcccggggcctcggtaagggtctcgtgctggacatcggaagacatctttgaaaggaccgagctaatacactgggtcaggcaagcgcccgggcaagggctagagtggataggctgggtcaagacagtgagcggggccgtgaactttggaagcccaaatttcaggcacagggtctcgctcacgcgagatcgagatctatttacagcgcacatggacatacgcgggctcacgcaaggggacacggcaacgtacttttgcgcgagacagaaattcgaaaggggcgggcaagggtggtatttcgatctctggggaaggggaacgctaatagtcgtgagctcg

SEQ ID NO: 56803 - RNA, 375 nt, synthetic construct
  misc_feature 1..375: note = derived and/or modified sequence opt11 from anti-HIV-1_HeavyChain
  source 1..375: mol_type = other RNA
gggacgccgtggaacgagagcgggagcggggtgaagaagccgggggcgagcgtgagggtgagctgttggacgagcgaggacatattcgagaagagtgagttgatacattgggtgaggcaggcgccggggcaggggttggagtggatagggtgggtgaagacggtgacgggggcggtgaatttcgggagcccgaactttaggcatagagtgagcttgacgagggacagggacttgttcacggcgcatatggatataagggggttgacgcagggggatacggcgacgtatttctgtgcgaggcagaagttcgagaggggagggcaggggtggtactttgacttgtgggggagggggacgttgatagtggtgagtagc

SEQ ID NO: 56804 - RNA, 375 nt, synthetic construct
  misc_feature 1..375: note = derived and/or modified sequence opt11 from anti-HIV-1_HeavyChain
  source 1..375: mol_type = other RNA
aggcacgatctcgagccctcgggctcgggcgtgaaaaagcccggggcctcggtcagggtctcgtgctggacctcggaagatatctttgaaaggaccgagctcatacactgggtcaggcaagcgcccgggcaagggctcgagtggattggctgggtcaagaccgtgaccggggccgtgaactttggctcgctcgatttcaggcacagaatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtg

SEQ ID NO: 56805 - RNA, 375 nt, synthetic construct
  misc_feature 1..375: note = derived and/or modified sequence opt11 from anti-HIV-1_HeavyChain
  source 1..375: mol_type = other RNA
aggcacacggtcgagcaatcgggctcgggcgtgaaaaagctcggggcctcggtcagggtctcgtgcttggcctcggaagatatctttgaaaggaccgagctaatacactgggtcaggcaagcgcccgggcaagggctcgagtggataggctgggtcaaggccgtgagcggggccgtgaactatggctcactcgacttcaggcacagggtctcgctcacgcgagatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56806 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcgagagcaagaaaccgggcgcgagcgtgcgcgtgagctgttggacgagcgaggacatattcgagaaatcggaattaatccattgggtgcgccaggccccgggccagggcttggaatggatcgggtgggtgaaaacggtcacgggcgcggtcaatttcgggagctcggactttcgccagcgcgtgagcttgaccagggacagggacctgttcacggcccatatggacatcagaggcttgacccagggcgataccgcgacctatttctgtgccaggcaaaagttctacgccgggggccagggctggtactttgacctgtgggggcgcgggaccctgatcgtggtctcgagc

SEQ ID NO: 56807 - RNA, 375 nt, synthetic construct
  misc_feature 1..375: note = derived and/or modified sequence opt11 from anti-HIV-1_HeavyChain
  source 1..375: mol_type = other RNA
gggacgccggggagcgagagtgcgagcggggtgaggaggccgggggcgagcgtgagggtgagctgttggacgagcgaggatatattcgagaggagtgagttgatatattgggtgaggcaggcgccggggagggggttggagtggatagggtggataaagctggtgagtggggcggtgaattttgggagcgtggactttagggatagggtgagtttgacgagggacagggacttgtttacggcgcatatggatataagggggttgacgcagggggatacggcgacgtatttctgtgcgaggcagaagtttgagaggggggggcaggggtggtattttgacttgtgggggagggggacgttgatagtggtgagtagt

SEQ ID NO: 56808 - RNA, 375 nt, synthetic construct
  misc_feature 1..375: note = derived and/or modified sequence opt11 from anti-HIV-1_HeavyChain
  source 1..375: mol_type = other RNA
caggtgcatttggagcagagcgggagcggggtgaagaagccgggggcgagcgtgagggtgagctgttggacgagtgaggatatattcgagaagagtgagttgatacagtgggtgaggcaggcgccggggcaggggttggagtggatagggtgggtgaagacggtgacgggggcggtgaatttcgggagcagtgactttaggcagagggtgagtttgacgagggacagggacttgtttacggcgcatatggatataagggggttgacgcagggggacacggcgacgtatttctgtgcgaggcagaagttctatgcgggggggcaggggtggtattttgacttgtgggggagggggacgttgatagtggtgagtagc

SEQ ID NO: 56809 - RNA, 375 nt, synthetic construct
  misc_feature 1..375: note = derived and/or modified sequence opt11 from anti-HIV-1_HeavyChain
  source 1..375: mol_type = other RNA
gggacgccggggagcgagagcgggagtggggtgaagaaggtgggggcgagcgtgagggtgagctgttggacgagcgaggacatattcgagaggacggagttgatacattgggtgaggcaggcgccggggcaggggttggagtggatagggtgggtgaaagcggtgtcgggggcggtgaattacgggagcttggactttaggcatagggtgagcttgacgagggacagggacttgttcacggcgaggatggatataagggggttgacgcaggacgatacggcgatatatttctgtgcgaggcagaagttcgcgaggggggaccaggggtggttctttgacttgtgggggagggggacgctgatagtggtgagtagc

SEQ ID NO: 56810 - RNA, 375 nt, synthetic construct
  misc_feature 1..375: note = derived and/or modified sequence opt11 from anti-HIV-1_HeavyChain
  source 1..375: mol_type = other RNA
gggaccccgggctcggaatcgggctcgggcgtgaaaaggcccggggcctcggtcagggtctcgtgctggacctcggaagatatctttgaaacgaccgagctaatacactgggtcaggcaagcgcccgggcaagggctcgagtggataggctgggtaaagaccgtgagcggggcagtgaactttggctcgctcaatttcaggcacagggtctcgctcacgcgcgatcgcgatctatcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 56811 - RNA, 372 nt, synthetic construct
  misc_feature 1..372: note = derived and/or modified sequence opt11 from anti-HIV-1_HeavyChain
  source 1..372: mol_type = other RNA
cgcgcgcacctggaacagagcggggccggggtcaagaaaccgggcgggtgggtgcgcgtgagctgttggacgagcgaggacatattcaagaccgagctcatacactgggtcaggcaagcgcccgggcaagggctcgagtggataggctgggtaaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56812 - RNA, 378 nt, synthetic construct
  misc_feature 1..378: note = derived and/or modified sequence opt11 from anti-HIV-1_HeavyChain
  source 1..378: mol_type = other RNA
caagtccaactcatgcaatccggcgcagaagtcaaacgccccggcgcctccgtcaaaatctcatgcaccgcctccggcttcaccctcaccgaccactacatgcactgggtccgccaagccccaggccaaaccttcgaatggctcggctggatgaaacccgtcaccggcgccgtcaactacgcccgcaaattccaaggccgcgtctccttctaccgcacccgcgaactcggcatcgcatacatggacctccgaaacctccgcttcgacgacaccgccgtctacttctgcgcccgcaaaaccgccggcgacgtctccggcgacaaacgcggcttcttcttcgacctatggggccgcggctcccgcgtcatcgtctcatcc

SEQ ID NO: 56813 - RNA, 378 nt, synthetic construct
  misc_feature 1..378: note = derived and/or modified sequence opt11 from anti-HIV-1_HeavyChain
  source 1..378: mol_type = other RNA
caagtgcaattggtccagagcggggccgaggtcaagaaaccgggcgcgagcgtgaaagtgagctgtaaagcgagcgggtacaatttcacgggctattacttgcactgggtcaggcaagcgcccgggcaaacgttcgagtggttgggctggatgaagcccgtgaccggggccgtgagctatgccaggaaatttcaagggcgcgtgagcttttacatgaccagggaattgggcatggcctatatggatctcaggaacttgcgctttgacgataccgcggtctatttctgtgccaggaaaacggccggggacgtgagcggggacaatcgcgggtactttttcgatctctggggcaggggctcgcgcgtgatcgtgagctcg

SEQ ID NO: 56814 - RNA, 375 nt, synthetic construct
  misc_feature 1..375: note = derived and/or modified sequence opt11 from anti-HIV-1_HeavyChain
  source 1..375: mol_type = other RNA
gggacgccggggagcaagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttagacatagggtgagcttgacgagggacagggacttgttcacggcgcatatggatataagggggttgacacagggggatacggcgacgtatttctgtgcgaggcagaagttcgagaggggagggcaggggtggtactttgacttgtgggggagggggacgttgatagtggtgagtagc

SEQ ID NO: 56815 - RNA, 378 nt, synthetic construct
  misc_feature 1..378: note = derived and/or modified sequence opt11 from anti-HIV-1_HeavyChain
  source 1..378: mol_type = other RNA
caagtgcaattggtccagagcggggcagagctcaagaaaccgggcgcgagcgtgaaagtgagctgtgaagcgagcgggtactcgttcacggaccatcacatacactgggtcaggcaagcgcccgggcaagggctcgagtggctgggctggatgaatcccaataacggggacacggcctatgcccagacctttctcgggcgcgtgaccatgaccagggacacgagcataaacacggcctatatggagctctcgcgcttgacctcggacgataccgcggtctatttctgtgccaggaaaacggccggggacgtgagcggagacaagcgagggttctttttcgatctctggggaaggggctcgcgagtgatcgtgagctcg

SEQ ID NO: 56816 - RNA, 378 nt, synthetic construct
  misc_feature 1..378: note = derived and/or modified sequence opt11 from anti-HIV-1_HeavyChain
  source 1..378: mol_type = other RNA
caagtgtacatgagctcgcgagggggcatgaaaaagcccggggcctcgatgacggtctcgtgcaagaccgcggacgaggacatattcgatgccgcgtacatgcactgggtcaggcaagcgccagggcaaacgttcgagtggctgggctggatgaagcccgtgaccggggccgtgaactatgccaggcaatttcaagggcgcgtgagcttttacaggaccagggaattgggcatagcctatatggatctcagggacttgaaatttgacgatacagcggtctatttctgtgccaggaaaacgaaaggggacgtgagcggggacgatcgcgggttctttttcgatctctggggcaggggcacgcgcgtgatcgtgagctcg

SEQ ID NO: 56817 - RNA, 378 nt, synthetic construct
  misc_feature 1..378: note = derived and/or modified sequence opt11 from anti-HIV-1_HeavyChain
  source 1..378: mol_type = other RNA
caagtgcaactggtccagagcggggccgaggtcaagaaaccgggcgcgagcgtgaaagtgagttgtaaagcgagcgggtacacgttcacggcctattacatgcactggctcaggcaagcgcccgggcaagggctcgagtggatgggctggatcaatccccatagcgggggcacgaactttgcccagaaatttcaagggcgcgtgaccatgaccagggacacgagcataaccacggcctatatggagctctcgcgcttgcgctcggacgataccgcgacctatttctgtgccaggcaaaagttcgcgagcaggtactcgggcgatcaagggagctatttcgatctctggggcaggggcacgctcatagtcgtgagctca

SEQ ID NO: 56818 - RNA, 375 nt, synthetic construct
  misc_feature 1..375: note = derived and/or modified sequence opt11 from anti-HIV-1_HeavyChain
  source 1..375: mol_type = other RNA
agggcgcacttggagcagagcggggcgggggtgaagaagctgggggcgagcgtgagggtgagctgttggacgagcgaggacatattcgagaggacggagttgatacattgggtgaggcaggcgccggggcaggggttggagtggatagggtgggtgaaggcggtgagtggggcggtgaattacgggagcttggactttaggcatagggtgagcttgacgagggacagggacttgttcacggcgcatatggatataagggggttgacgcaggacgatacggcgacgtatttctgtgcgaggcagaagttcgcgagaggggaccaggggtggttctttgacttgtgggggagggggacgttgatagtggtgagtagc

SEQ ID NO: 56819 - RNA, 378 nt, synthetic construct
  misc_feature 1..378: note = derived and/or modified sequence opt11 from anti-HIV-1_HeavyChain
  source 1..378: mol_type = other RNA
caagtgcgattggtccagagcggggccgatgtcaagcaaccgggcgcgagcgtgaaagtgagctgtaaagcgagcgggtacacgttcacggactattacatgcactgggtcaggcaagcgcccgggcaaacgttcgagtggttgggctggatgaagcccgtgaccggggccgtgagctatgccagaaaatttcaagggcgcgtgagcttttacatgaccagggaattgggaatggcctatatggatctcaggaacttgcgctttgacgataccgcggtctatttctgtgccaggaaaacggccggggacgtgagcggggacaatcgcgggtactttttcgatctctggggcaggggctcgcgagtgatcgtgagctcg

SEQ ID NO: 56820 - RNA, 378 nt, synthetic construct
  misc_feature 1..378: note = derived and/or modified sequence opt11 from anti-HIV-1_HeavyChain
  source 1..378: mol_type = other RNA
caagcgcacttgggcaataaatcgggctcgggcgtgaaaaagccaggggcatcggtcagggtctcgtgctggacatcggaagatatctttgaaaagagcgagctaatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctaacgcaaggggacacggccacgtacttttgcgcgcgccagaaattttacgcgggcgggcaagggtggtatttcgatctctggggaaggggcacgctcatagtcgtgagctcg

SEQ ID NO: 56821 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcagagtggggggggggtgaagaagccgggggcgagcgtgacgttgagttgtaagacggcggatgaggatgtgtttgatgcggcgtatatgcattgggtgaggcaggcgccggggcagacgtttgagtggttggggtggatgaagccggtgacgggagcggtgaattatgcgaggaagtttcaggggagggtgagtttttataggacgagggagttggggatagcgtatatggatttgaggaatttgaggtttgatgatacggcggtgtatttttgtacgaggaagacggcgggggatgtgagtggggataagagggggtttttttttgatttgtgggggagggggagtagggtgatagtgagtagt

SEQ ID NO: 56822 - RNA, 381 nt, synthetic construct
  misc_feature 1..381: note = derived and/or modified sequence opt11 from anti-HIV-1_HeavyChain
  source 1..381: mol_type = other RNA
caggtgtatgtggagcagccgggggggggggtgaagaagccgggggcgagtgtgacgttgagttgtaagacggcggatgaggatgtgtttgatgcgacgtatatgcattgggtgaggcaggcgccggggcagacgtttgagtggctggggtggatgaagccggtgacgggggcggtgaattatgcgaggaagtttcaggggagggtgagtttttataggacgagggagttggggatagcgtatatggatctgaggaatttgaggtttgatgatacggcggtgtatttttgtgcgaggaagacggcgggggatgtgagtggggataagagggggtttttttttgatttgtggggaagggggagtagggtgatagtgagtagt

SEQ ID NO: 56823 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgtggaagtggaaaagcccggggcatcggtcacactctcgtgcaagacagcggacgaggacgtgttcgatgccgcgtacatgcactgggtcaggcaagcgcccgggcaaacgttcgagtggttgggctggatgaagcccgtgaccggggccgtgagctatgccaggaaatttcaagggcgagtgagcttttacatgaccagggaattgggcatggcctatatggatctcagaaacttgcgctttgacgataccgcggtctatttctgtgccaggaaaacggccggggacgtgagcggggacaatagagggtactttttcgatctatggggcaggggctcgcgcgtgatcgtgagctcg

SEQ ID NO: 56824 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgcgggcgtgaaaaagcccggggcctcggtcacgctctcgtgcaagaccgcggacgaggacgtgttcgatgccgcgtacatgcactgggtcaggcaagcgccagggcaaacgttcgagtggttgggctggatgaagcccgtgaccggggccgtgagctatgccaggaaatttcaagggcgcgtgagcttttacatgaccagggaattgggcatggcctatatggatctcaggaacttgcgatttgacgataccgcggtctatttctgtgccaggaaaacggccggggacgtgagcggggacaatcgcgggtactttttcgatctctggggcaggggctcgcgcgtgatcgtgagctcg

SEQ ID NO: 56825 - RNA, 381 nt, synthetic construct
  misc_feature 1..381: note = derived and/or modified sequence opt11 from anti-HIV-1_HeavyChain
  source 1..381: mol_type = other RNA
caggtgcatatggagcaggcgggggcgggggtgaagaagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56826 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggcggaggtgaagaagccgggggcgagtgtgacgttgagttgtgagacggcggatgaggatgtgtttgatgcggcgtatatgcattgggtgagacaggcgccggggcagacgtttgagtggttggggtggatgaagccggtgacgggggcggtgaattatgcgaggaagtttcaggggagggtgagtttttataggacgagggagttggggatagcgtatatggatttgaggaatctgaggtttgatgatacagcggtgtatttttgtgcgagaaagacggcgggggatgtaagtggggataagagggggtttttttttgatttgtgggggagggggagtagggtgatagtgagtagc

SEQ ID NO: 56827 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacagcccgggggcggggtcaagaaaccgggcgcgagcgtgacattgagctgtaaaacggccgatgaagatgtctttgacgcggcctatatgcattgggtgcgacaggccccgggccagacctttgaatggctcgggtggatgaaaccggtcacgggcgcggtcaattacgcgcgcaagttccagggcagggtctcgttctatcgcacgcgcgagctcgggatcgcgtacatggacctgcgcaatctcaggttcgatgacacggccgtgtacttttgcgcgcgcaagaccgcgggcgatgtctcgggcgataaaaggggctttttctttgacttgtgggggcgcgggagcagggtcatagtctcgagc

SEQ ID NO: 56828 - RNA, 372 nt, synthetic construct
  misc_feature 1..372: note = derived and/or modified sequence opt11 from anti-HIV-1_HeavyChain
  source 1..372: mol_type = other RNA
gccacgccctggaacaagagcgggagcggggtcaagaaaccgggagcgagcgtgcgcgtgagctgttggacgagcgaggacatattcgagcgcacggaattgagcttggtcaggcaagcgcccgggcaagggctcgagtggataggctggatgaaaaccgtgaccggggccgtgaactttggctcgcccaatttcaggcacggggtctcgctcacgcgcgatcgcgatctctttaccgcgcacatggacatacgagggctcacgcaaggggacacggccacgtacttttgcgcgcgccagaaatttgaaaggggcgggcaagggtggtatttcgatctctggggcaggggcacgctcatagtcgtgagctcg

SEQ ID NO: 56829 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgcgggcatgaaaaagcccggggcctcgatgacggcatcgtgcaagacagcggacgaggacatattcgatgccgcgtacatgcactgggtcaggcaagcgcccgggcaaacgttcgagtggttgggctggatgaagcccgtgaccggggccgtgaactatgccaggcaatttcaagggcgcgtgagcttttacaggaccagggaattgggcatagcctatatggatctcagggacttgaaatttgacgatacagcggtctatttctgtgccaggaaaacgaaaggggacgtgagcggggacgatcgcgggttctttttcgatctatggggcaggggcacgcgcgtgatcgtgagctcg

SEQ ID NO: 56830 - RNA, 378 nt, synthetic construct
  misc_feature 1..378: note = derived and/or modified sequence opt11 from anti-HIV-1_HeavyChain
  source 1..378: mol_type = other RNA
caggtccagctcgtgcaatcgggcgcggaagtgaaaaagcccggggcctcggtcaaggtctcgtgcaaggcctcgggctatacctttaccgggtactatatgcattgggtgcgccaggccccgggacagacctttgaatggctcgggtggatgaaaccggtcacgggcgcggtcaattacgcgcgccagttccagggcagggtctcgttctatcgcacgcgcgagctcgggatcgcgtacatggacctgcgcgatctaaagttcgatgacacggccgtgtacttttgcgcgcgcaagaccaaggccgatgtctcgggcgatgacaggggctttttcttcgacttgtgggggcgcgggaccagggtcatagtctcgagc

SEQ ID NO: 56831 - RNA, 381 nt, synthetic construct
  misc_feature 1..381: note = derived and/or modified sequence opt11 from anti-HIV-1_HeavyChain
  source 1..381: mol_type = other RNA
agggtctatatggagcaagcgggcgcgggagtgaaaaagcccggggcctcggtcacgctctcgtgcaagaccgcggacgaggacgtgttcgatgccgcgtacatgcactgggtcaggcaagcgcccgggcaaacgttcgagtggctgggctggatgaagcccgtgaccggggccgtgagctatgccaggaaatttcaagggcgcgtgagctttaccatgaccagggaattgggcatggcctatatggatctcaggaacttgcgctttgacgataccgcggtctatttctgtgccaggaaaacggccggggacgtgagcggggacaatcgcgggtactttttcgatctctggggcaggggatcgcgcgtgatcgtgagctcg

SEQ ID NO: 56832 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcagagtggggggggggtgaagaagccggggccgagtgtaacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtggggaagggggagtagggtgatagtgagtagt

SEQ ID NO: 56833 - RNA, 378 nt, synthetic construct
  misc_feature 1..378: note = derived and/or modified sequence opt11 from anti-HIV-1_HeavyChain
  source 1..378: mol_type = other RNA
caagtgcaattggtccagagcggggccgaggtcaagaaaccgggcgcgagcgtgaaagtgagctgtaaagcgagcgggtacacgttcacgggctattacatacactggatgaggcaagcgcccgggcaagggctcgagtggatgggctggatcaatcccaatagcggggccgtgagctatgccaggaaatttcaagggcgcgtgagctttctacatgaccagggcatacgcatggcctatatggatctcaggaacttgcgctttgacgataccgcggtctatttctgtgccaggaaaacggccggggacgtgagcggggacaatcgcgggtactttttcgatctctggggcaggggctcgcgcgtgatcgtgagctcg

SEQ ID NO: 56834 - RNA, 381 nt, synthetic construct
  misc_feature 1..381: note = derived and/or modified sequence opt11 from anti-HIV-1_HeavyChain
  source 1..381: mol_type = other RNA
caggtgcatatggagcaggcgggggtggaggtggagaagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatctgaggaatttgaggtttgatgatacggcggtgtatttttgtgcgaggaagacggcgggggatgtgagtggggataagagggggtttttttttgatttgtgggggagggggagcagggtgatagtgagtagt

SEQ ID NO: 56835 - RNA, 381 nt, synthetic construct
  misc_feature 1..381: note = derived and/or modified sequence opt11 from anti-HIV-1_HeavyChain
  source 1..381: mol_type = other RNA
caggtatatatggagcaagcgggagcgggggtgaaaaagccaggggcatcggcaacgctatcgtgcaagaccgcggacgaggacgtgttcgatgccgcgtacatgcactgggtcaggcaagcgccagggcaaacgttcgagtggttgggctggatgaagccagtgacaggggcagtgagctatgccaggaaatttcaagggagagtgagcttttacatgacaagggagttgggaatggcatatatggatctcaggaacttgagatttgacgatacggcggtatatttctgtgcaaggaaaacggcaggggacgtgagcggggacaatagagggtactttttcgatctctggggaaggggctcgagagtgatagtgagctcg

SEQ ID NO: 56836 - RNA, 375 nt, synthetic construct
  misc_feature 1..375: note = derived and/or modified sequence opt11 from anti-HIV-1_HeavyChain
  source 1..375: mol_type = other RNA
gggcacgatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccatatacttttgcgcgcgccagaaatttgccaggggcgatcaagggtggtttttcgatctatggggcaggggcacgctaatagtcgtgagctcg

SEQ ID NO: 56837 - RNA, 378 nt, synthetic construct
  misc_feature 1..378: note = derived and/or modified sequence opt11 from anti-HIV-1_HeavyChain
  source 1..378: mol_type = other RNA
caagcgcacaggggcacgatctggggcctggaagtgaaaaagcccgggggctgggtcagggtctcgtgctggacctcggaagatatctttgaaaggaccgagctaatacactgggtcaggcaagcgcccgggcaagggctagagtggataggctgggtaaagaccgtgaccggggccgtgaactttggctcgcccaatttcaggcacagggtctcgctaacgcgcgatcgcgatctatttacagcgcacatggacataagagggctaacgcaaggggacacggccacgtacttttgcgcgagacagaaatttgaaaggggcgggcaagggtggtatttcgatctatggggcaggggcacgctaatagtcgtgagctcg

SEQ ID NO: 56838 - RNA, 381 nt, synthetic construct
  misc_feature 1..381: note = derived and/or modified sequence opt11 from anti-HIV-1_HeavyChain
  source 1..381: mol_type = other RNA
caggtccatatggagcaagcgggcgcgggcgtggaaaagcccggggcctcggtcacgctctcgtgcaagaccgcggacgaggacgtgttcgatgcagcgtacatgcactgggtcaggcaagcgcccgggcaaacgttcgagtggttgggctggatgaagcccgtgaccggggccgtgagctatgccaggaaatttcaagggcgcgtgagcttttacatgacaagggaattgggcatggcatatatggatctcaggaacttgcgctttgacgataccgcggtctatttctgtgccaggaaaacggcaggggacgtgagcggggacaatcgcgggtactttttcgatctctggggcaggggctcgcgcgtgatcgtgagctcg

SEQ ID NO: 56839 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcagagtggggggggggtgaagaagccgggggcgagtgtgacactgagttgtaagacggcggacgaggatgtgttcgatgcagcgtatatgcattgggtgaggcaggcgccggggcagacgtttgagtggttggggtggatgaagccggtgacgggggcggtgagttatgcgaggaagtttcaggggagagtgagtttttatatgacgagggagctggggatggcgtatatggatttgaggaacctgaggtttgatgatacggcggtgtatttttgtgcgaggaagacggcaggggatgtgagtggggataatagggggtatttttttgatttgtgggggagggggagtagagtgatagtgagtagc

SEQ ID NO: 56840 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcagagtggggggggggtgaagaagccgggggcgagtgtgacgttgagctgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagcttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56841 - RNA, 381 nt, synthetic construct
  misc_feature 1..381: note = derived and/or modified sequence opt11 from anti-HIV-1_HeavyChain
  source 1..381: mol_type = other RNA
gaggtgtatatggagcagagtggggggggggtaaagaagccgggggcgagcgtgacgttgagttgtaagacggcgagtgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagctggggatagcgtatatggatttgaggaatctgaggtttgatgatacggcggtgtacttttgtgcgaggaagacggcgggggatgtgagtggggataagagggggtttttttttgatttgtgggggagggggagtagggtaatagtgagtagc

SEQ ID NO: 56842 - RNA, 381 nt, synthetic construct
  misc_feature 1..381: note = derived and/or modified sequence opt11 from anti-HIV-1_HeavyChain
  source 1..381: mol_type = other RNA
caggtccagctagtgcaatcaggcgcggaagtgaaaaagcccggggcctcggtcacgctctcgtgcaagaccgcggacgaggacgtgttcgatgccgcgtacatgcactgggtcaggcaagcgcccgggcaaacgttcgagtggctgggctggatgaagcccgtgaccggggccgtgagctatgccaggaaatttcaagggcgcgtgagcttttacatgaccagggaattgggcatggcctatatggatctcaggaacttgcgctttgacgataccgcggtctatttctgtgccaggaaaacggccggggacgtgagcggggacaatcgcgggtactttttcgatctctggggcaggggctcgcgcgtgatcgtgagctcg

SEQ ID NO: 56843 - RNA, 381 nt, synthetic construct
  misc_feature 1..381: note = derived and/or modified sequence opt11 from anti-HIV-1_HeavyChain
  source 1..381: mol_type = other RNA
caggtctttatggagcaatcgggagggggcatgaaaaagcccggggcctcgatgacggtctcgtgcaagacagcggacgaggacgtgttcgatgcagcgtacatgcactgggtaaggcaagcgcccgggcaaacgttcgagtggttgggctggatgaagccagtgaccggggccgtgagctatgcaaggaaatttcaagggcgcgtgagcttttacatgaccagggaattgggcatggcctatatggatctaaggaacttgcgatttgacgataccgcggtctatttctgtgcaaggaaaacggcaggggacgtgagcggggacaatcgcgggtactttttcgatctctggggcaggggctcgagagtgatcgtgagctcg

SEQ ID NO: 56844 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaaaaagccgggggcgagtatgacggtgagttgtaagacggcggatgaggacatattcgatgcggcgtatatgcattgggtgaggcaggcgccggggcagacgtttgagtggttggggtggatgaagccggtgacgggggcggtgaattatgcaaggaggtttcaggggagggtgagcttttacaggacaagggagttggggatagcatatatggatttgagggatttgaaatttgatgatacggcggtgtatttttgtgcgaggaagacgaagggggatgtgagcggggacgatagggggttttttttcgatttgtgggggagggggacgagagtgatagtgagcagt

SEQ ID NO: 56845 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggcgggggtgaagaagccgggggcgagtgtgacgttgagctgtaaggcggcggatgaggatgtgtttgatgcagcgtatatgcattgggtgaggcaggcgccggggcagacgtttgagtggttggggtggatgaagccggtgacgggggcggtgagttatgcgaggaagtttcaggggagggtgagtttttatatgacgagggagttggggatggcgtatatggacttgaggaatttgaggtttgatgatacggcggtgtatttttgtgcgaggaagacggcgggggatgtgagtggggataatagggggtatttttttgatttgtgggggagggggagtagggtgatagtgagtagt

SEQ ID NO: 56846 - RNA, 381 nt, synthetic construct
  misc_feature 1..381: note = derived and/or modified sequence opt11 from anti-HIV-1_HeavyChain
  source 1..381: mol_type = other RNA
caagtgttcatggaacaggccggggccgggatgaagaaaccgggcgcgagcatgaccgtgagctgtaaaacggccgatgaagatatctttgacgcggcctatatgcattgggtgcgccaggccccaggccagacctttgaatggctcgggtggatgaaaccggtcacgggcgcggtcaattacgcgcgccagttccagggcagggtatcgttctatcgcacgcgcgagctcgggatagcgtacatggacttgcgcgatctcaagttcgacgacacggccgtgtacttttgcgcgcgcaagaccaagggcgatgtctcgggcgatgacaggggctttttctttgacctgtgggggcgcgggaccagagtcatagtctcgagc

SEQ ID NO: 56847 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacagcccgggggcgaggtcaagaaaccgggcgcgagcgtgaccttgagctgtaaaacggccgatgaagatgtatttgacgcggcctatatgcattgggtgcgccaggccccgggccagacctttgaatggctcgggtggatgaaaccggtcacgggcgcggtcaattacgcgcgcaagttccagggcagggtctcgttctatatgacgcgcgagctcgggatggcgtacatggacctgcgcaatctcaggttcgatgacacggccgtgtacttttgcgcgcgcaagaccgcgggcgatgtctcgggcgataacaggggctatttctttgacttgtgggggcgcgggagcagggtcatagtatcgagc

SEQ ID NO: 56848 - RNA, 381 nt, synthetic construct
  misc_feature 1..381: note = derived and/or modified sequence opt11 from anti-HIV-1_HeavyChain
  source 1..381: mol_type = other RNA
caggtccatatggagcaagcgggcgcgggcgtgaaaaagcccggggcctcggtcacgctctcgtgcaagaccgcggacgaggacgtgttcgatgccgcgtacatgcactgggtaaggcaagcgcccgggcaaacgttcgagtggctgggctggatgaagcccgtgaccggggccgtgagctatgccaggaaatttcaagggcgcgtgagcttttacatgaccagggaattgggcatggcatatatggatctcaggaacttgcgctttgacgataccgcggtctatttctgtgccaggaaaacagccggggacgtgagcggggacaatcgcgggtactttttcgatctctggggcaggggctcgcgcgtgatcgtgagctcg

SEQ ID NO: 56849 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgggggagtgaaaaagccaggggcctcggtcacgctatcgtgcaagaccgcggacgaggacgtgttcgatgccgcgtacatgcactgggtcaggcaagcgcccgggcaaacgttcgagtggttgggctggatgaagcccgtgaccggggccgtgaactatgccaggaaatttcaagggcgagtgagcttttacaggaccagggaattgggcatagcctatatggatctaaggaacttgagatttgacgataccgcggtctatttctgtgccaggaaaacggccggggacgtgagcggggacaagcgcgggttctttttcgatctatggggcaggggcccgagagtgatcgtgagctcg

SEQ ID NO: 56850 - RNA, 381 nt, synthetic construct
  misc_feature 1..381: note = derived and/or modified sequence opt11 from anti-HIV-1_HeavyChain
  source 1..381: mol_type = other RNA
caagtgcaattggtccagagcggggccgaggtcaagaaaccgggcgcgagcgtgaaagtgagctgtaaagcgagcgggcacacgttcacgaactatgacataaactgggtcaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgtacatggacatacgcgggctcacgcaagatgacacggccacgtacttttgcgcgcgccagaaatttgcctcgcgctatagcggggaccagggctcgtactttgacctgtgggggcgcgggaccttgatcgtggtctcgagc

SEQ ID NO: 56851 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagtatgacggtgagttgtaagacggcggatgaggatatatttgatgcggcgtatatgcattgggtgaggcaggcgccggggcagacgtttgagtggttggggtggatgaagccggtgacgggggcggtgaattatgcgaggcagtttcaggggagggtgagcttttataggacgagggagttggggatagcgtatacggatttgagggatttgaagtttgatgatacggcggtgtatttttgtgcgaggaagacgaagggggatgtgagtggggatgatagggggtttttttttgatttgtgggggagggggacgagagtgatagtgagtagt

SEQ ID NO: 56852 - RNA, 381 nt, synthetic construct
  misc_feature 1..381: note = derived and/or modified sequence opt11 from anti-HIV-1_HeavyChain
  source 1..381: mol_type = other RNA
caggtatatatggagcaagcgggagggggagtgaaaaagccaggggcatcagtcacgctatcgtgcaagacagcggacgaggacgtgttcgatgccgcgtacatgcactgggtaaggcaagcgccggggcaaacgttcgagtggttggggtggatgaagccagtgacaggggcagtgaactatgcaaggcaatttcaagggcgcgtgagcttttacaggacaagggaattgggaatagcatatatggatctaagggacttgaaatttgacgatacagcggtatatttctgtgcaaggaaaacgaaaggggacgtgagcggggacgatagagggttctttttcgatctatggggaaggggaacgagagtgatagtgagctcg

SEQ ID NO: 56853 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagttgtaagacggcggatgaggatgtgtttgatgcggcgtatatgcattgggtgaggcaggcgccggggcagacgtttgagtggccggggtggatgaagccggtgacgggggcggtgaattatgcgaggaagtttcaggggagggtgagtttttataggacgagggagttggggatagcgtatatggatctgaggaatctgaggtttgatgatacggcggtgtatttttgtgcgagaaagacggcgggggatgtgagtggggataagagggggtttttttttgatttgtgggggagggggagtagggtgatagtgagtagc

SEQ ID NO: 56854 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgggggcgtgaaaaagcccggggcatcggccacgctctcgtgcaagaccgcggacgaggacgtgttcgatgcagcgtacatgcactgggtcaggcaagcgcccgggcaaacgttcgagtggttgggctggatgaagcccgtgaccggggccgtgagctatgccaggaaatttcaagggcgcgtgagcttttacatgaccagggaattgggaatggcctatatggatctaaggaacttgcgctttgacgataccgcggtctatttctgtgccaggaaaacggcaggggacgtgagcggggacaatagagggtactttttcgatctctggggcaggggctcgcgcgtgatcgtgagctcg

SEQ ID NO: 56855 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagttgtaagacggcggatgaggatgtgtttgatgcggcgtatatgaggtgggtgaggcaggcgccggggcagacgtttgagtggttgggatggatgaagccggtgacgggggcggtgaattatgcgaggaagtttcaggggagggtgagtttttataggacgagggagttggggatagcgtacatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56856 - RNA, 381 nt, synthetic construct
  misc_feature 1..381: note = derived and/or modified sequence opt11 from anti-HIV-1_HeavyChain
  source 1..381: mol_type = other RNA
caggtccagctcgtgcaatcgggcgcggaagtgaaaaagcccggggcctcggtcaaggtctcgtgcagggcctcgggctatacctttggcaatcacgcgatctcgtgggtgcgccaggccccgggccagggcctggaatggatggggtggatacgcccgaaaacgggcgcgcgcaatcaagcgcgccagttccagcccaggatctcgctcacacgcgatcgcgcgctctcaaccgcgtacttggacttgaactcgctcacgagcgcggactcgggcacgtacttttgcgcgcgccagacctttaaaccggacttttactttgccgatcaagggtggtcgttcaatctctggggcaggggcgcgcactttatcgtgagctcg

SEQ ID NO: 56857 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacattgagctgtaagacggcggatgaggatgtgtttgatgcggcgtatatgcattgggtgaggcaggcgccggggcagacgtttgagtggttggggtggatgaagccggtgacgggggcggtgagttatgcgaggaagtttcaggggagggtgagtttttatatgacgagggagttggggatggcgtatatggatttgaggaatttgaggtttgatgatacggcggtgtatttttgtgcgaggaagacggcgggggatgtgagtggggataatagggggtatttttttgatttgtgggggccggggagtagggtgatagtgagtagt

SEQ ID NO: 56858 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacaggccggggccggggtcaagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacttgcgaaatctcaggttcgatgacacggccgtgtacttttgcgcgcgcaagaccgcgggcgatgtctcgggagataaaaggggctttttctttgacttgtgggggcgcgggagcagggtcatagtctcgagc

SEQ ID NO: 56859 - RNA, 381 nt, synthetic construct
  misc_feature 1..381: note = derived and/or modified sequence opt11 from anti-HIV-1_HeavyChain
  source 1..381: mol_type = other RNA
caggtgcatatggagcaggcgggggggggggtgaagaagccgggggcgagtgtgacgttgagctgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcaaggaagacggcgggggatgtgagtggggataagagggggtttttttttgatttgtgggggagggggagtagggtgatagtgagtagc

SEQ ID NO: 56860 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggatgggatgaagaagccgggggcgagtatgacggtgagttgtaagacggcggatgaggatatatttgatgcggcgtatatgcattgggtgaggcaggcgccggggcagacgtttgagtggctggggtggatgaagccggtgacgggggcggtgaattatgcaaggcagtttcaggggagggtgagcttttataggacgagggagttggggatagcgtatatggatttgagggatttgaagtttgatgatacggcggtgtatttttgtgcgaggaagacgaagggggatgtgagcggggatgatagggggtttttttttgatctgtgggggagggggacgagggtgatagtgagtagt

SEQ ID NO: 56861 - RNA, 381 nt, synthetic construct
  misc_feature 1..381: note = derived and/or modified sequence opt11 from anti-HIV-1_HeavyChain
  source 1..381: mol_type = other RNA
caggtgcagttggtgcagagtggggcggaggtgaagaagccgggggcgagtgtgacgttgagttgtaagacggcggatgaggatgtgtttgatgcggcgtatatgcattgggtgaggcaggcgcaggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56862 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacaggccgggggcggggtcaagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacttgcgcaatctaaggttcgatgacacggccgtgtacttttgcgcgcgcaagaccgcgggcgatgtctcgggcgataaaaggggctttttctttgacttgtgggggcgcgggagccaggtcatagtctcgagc

SEQ ID NO: 56863 - RNA, 381 nt, synthetic construct
  misc_feature 1..381: note = derived and/or modified sequence opt11 from anti-HIV-1_HeavyChain
  source 1..381: mol_type = other RNA
caagtgcaattggtccagagcggggccgaggtcaggaaaccgggcgcgagcgtgaaagtgagctgtaaagcgagcgggtacacgttcacgaactattacatgcactgggtcaggcaagcgcccgggcaagggctcgagtggataggctgggtcaagatcgtgagcgggaccgtgaactttgcctcgctagatttcaggaacaggatctcgctctcacgcgatcgcgatctctcgaccgcgtacatggacatacgcgggctcacgcaagatgacacggccacgtacttttgcgcgcgccagaaatttgcctcgcgctatagcggggaccagggctcgtactttgacttgtgggggcgcgggaccttgatcgtggtctcgagc

SEQ ID NO: 56864 - RNA, 381 nt, synthetic construct
  misc_feature 1..381: note = derived and/or modified sequence opt11 from anti-HIV-1_HeavyChain
  source 1..381: mol_type = other RNA
caagcgcacttggaacagagcgggagcggggtcaagaaaccgggcgcgagcgtgcgcgtgagctgttggacgagcgaggacatattcgagcgcacagaattgatccattgggtgcgccaggccccgggccagggcttggaatggatcgggtgggtgaaaacggtcacgggcacggtcaattacgcgcgcaagttccagggcagggtctcgttctatcgcacgcgcgagctcgggatcgcgtacatggacttgcgcaatctcaggttcgatgacacggccgtgtacttttgcgcgcgcaagaccgcgggcgatgtctcgggcgataaaaggggctttttctttgacttgtgggggcgcgggagcagggtcatagtctcgagc

SEQ ID NO: 56865 - RNA, 381 nt, synthetic construct
  misc_feature 1..381: note = derived and/or modified sequence opt11 from anti-HIV-1_HeavyChain
  source 1..381: mol_type = other RNA
ctaatccatctcgcgcaatcgggcgcggaagtgaaaaagcccggggcctcggtcacactctcgtgcaagaccgcggacgaggacgtgttcgatgccgcgtacatgcactgggtcaggcaagcgcccgggcaaacgttcgagtggttgggctggatgaagcccgtgaccggggccgtgagctatgccaggaaatttcaagggcgagtgagcttttacatgaccagggaattgggcatggcctatatggatctcaggaacttgcgctttgacgataccgcggtctatttctgtgccaggaaaacggccggggacgtgagcggggacaatcgcgggtactttttcgatctatggggcaggggctcgcgcgtgatcgtgagctcg

SEQ ID NO: 56866 - RNA, 381 nt, synthetic construct
  misc_feature 1..381: note = derived and/or modified sequence opt11 from anti-HIV-1_HeavyChain
  source 1..381: mol_type = other RNA
caagtgcaattggtccagagcggggccgaggtcaagaaaccgggcgcgagcatgaccgtgagctgtaaaacggccgatgaagatatctttgacgcggcatatatgcattgggtgcgccaggcaccgggccagacctttgaatggctcggatggatgaaaccggtcacgggcgcggtcaattacgcgcgccagttccagggcagggtctcgttctatcgcacgcgcgagctcgggatcgcgtacatggacttgcgcgatctaaagttcgatgacacggccgtgtacttttgcgcgcgcaagaccaagggcgatgtctcgggcgatgacaggggctttttctttgacttgtgggggcgcgggaccagggtcatagtctcgagc

SEQ ID NO: 56867 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggggagggggggggtgaagaagccgggggcgagcgtgacgttgagttgtaagacggcggatgaggatgtgtttgatgcggcgtatatgcattgggtgaggcaggcgccggggcagacgtttgagtggttggggtggatgaagccggtaacgggggcggtgaattatgcgaggaagtttcaggggagggtgagtttttataggacgagggagttggggatagcgtatatggatctgaggaatttgagatttgatgatacggcggtgtatttttgtgcgaggaagacggcgggggatgtgagtggggataagagggggtttttttttgatttgtgggggagagggagcagggtgatagtgagtagc

SEQ ID NO: 56868 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagcatgacggtgagttgtaagacggcggatgaggatgtgtttgatgcggcgtatatgcattgggtgaggcaggcgccggggcagacgtttgagtggttggggtggatgaagccggtgacgggggcggtgaattatgcgaggcagtttcaggggagggtgagtttttataggacgagggagctggggatagcgtatatggatttgagggatttgaagagtgatgatacggcggtgtatttttgcgcgaggaagacggcgggggatgtgagtggagataagagggggtttttttttgatttgtgggggagggggagtagggtgatagtgagtagc

SEQ ID NO: 56869 - RNA, 381 nt, synthetic construct
  misc_feature 1..381: note = derived and/or modified sequence opt11 from anti-HIV-1_HeavyChain
  source 1..381: mol_type = other RNA
caagtgcaactggtccagagcggggccgaggtcaagaaaccgggctcgagcataaaagtgagctgtaaagcgagcggggacacgatctcgcgctatgccataaactgggtcaggcaagcgcccgggcaagggctcgagtggataggctgggtcaagaccgtgaccggggccgtgaactttggctcgctcgatttcaggcacaggatctcgctcacgcgcgaccgcgatctctttaccgcgcacatgggcatacgcgggctcacgcaaggggacacggccacgtacttttgcgcgcgccagaaatttgaatcgcgctataccgggggccagggctggtactttgacttgtgggggcgcgggacccatatagtggtctcgagc

SEQ ID NO: 56870 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagctgtaagacggcggatgaggatatatttgatgcggcgtatatgcattgggtgaggcaggcgccggggcagacgtttgagtggctggggtggatgaagccggtgacgggggcggtgaattatgcgaggaagtttcaggggagggtgagtttttataggacgagggagttggggatagcgtatatggatctgaggaatttgaggtttgatgatacggcggtgtacttttgtgcgaggaagacggcgggggatgtgagtggggacaagagggggtttttttttgatttgtgggggagggggagcagggtgatagtgagcagt

SEQ ID NO: 56871 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgggggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgaccggggccgtgaactatgccaggaactttcaagggcgcgtgagcttttacaggaccagggaattgggcatagcctatatggatctcagaaacctgcgatttgacgataccgcagtctatttctgtgccaggcaaaagttcgagagcaggtactcgggcgatcaagggagctatttcgatctctggggcaggggcacgctcataatcgtgagctcg

SEQ ID NO: 56872 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacaggccgggggcggggtcaagcgcccgggcgcgagcgtgacattgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacttgcgcaatctcaggttcgatgacacggccgtgtacttttgcgcgcgcaagaccgcgggcgatgtctcgggagataaaaggggctttttctttgacttgtgggggcgcgggagcagggtcatagtctcgagc

SEQ ID NO: 56873 - RNA, 381 nt, synthetic construct
  misc_feature 1..381: note = derived and/or modified sequence opt11 from anti-HIV-1_HeavyChain
  source 1..381: mol_type = other RNA
caggtgcagctggtgcagagtggggatgaggtgaagaagccgggggcgagtgtgacgttgagttgtaagacggcggatgaggatgtgtttgatgcggcgtacatgcattgggtgaggcaggcgccggggcagacgtttgagtggctggggtggatgaagccggtgacgggggcggtgaattatgcgaggaagtttcaggggagggtgagtttttataggacgagggagttggggatagcgtatatggatttgaggaatttgagatttgatgatacagcggtgtatttttgtgcgaggaagacggcgggggatgtgagtggggataagaggggatttttttttgatttgtgggggagggggagcagggtgatagtgagcagt

SEQ ID NO: 56874 - RNA, 381 nt, synthetic construct
  misc_feature 1..381: note = derived and/or modified sequence opt11 from anti-HIV-1_HeavyChain
  source 1..381: mol_type = other RNA
caggtccagctcgtgcaatcgggcgcgggcgtgaaaaagcccgggagctcggtcaaggtctcgtgcaaggcctcgggcgggacctttagctcgtacgcgatcaattggttgcgccaggtcccgggccagcgcccggaatggatggggtggatacgaccgaaaacgggcgcgcgcaatcaagcgcgccagttccagcccagaatctcgctcacgcgcgatcgcgcgctctcgaccgcgtacttggacttgaactcgctcacgagcgcggactcgggcacgtacttttgcgcgcgccagacctttaaaccggacttttactttgccgatcaagggtggtcgttcaatctctggggcaggggcgcgcactttatcgtgagctcg

SEQ ID NO: 56875 - RNA, 381 nt, synthetic construct
  misc_feature 1..381: note = derived and/or modified sequence opt11 from anti-HIV-1_HeavyChain
  source 1..381: mol_type = other RNA
caggtgtatatggagagggcgggggggggggtgaagaagccgggggcgagcgtgacgttgagttgtgagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56876 - RNA, 381 nt, synthetic construct
  misc_feature 1..381: note = derived and/or modified sequence opt11 from anti-HIV-1_HeavyChain
  source 1..381: mol_type = other RNA
caggtatatatggagcaagcgggagcgggcatgaaaaagccaggggcctcgatgacggtctcgtgcaagaccgcggacgaggacatattcgacgccgcgtacatgcactgggtcaggcaagcgccagggcaaacgttcgagtggctgggatggatgaagccagtgacaggggccgtgaactatgccaggcaatttcaagggcgcgtgagctttctacaggaccagggcataagaatagcatatatggatctaagggacctgaaatttgacgatacagcagtctatttctgtgccaggaaaacgaaaggggacgtgagcggggacgatcgaggattctttttcgatctctggggaaggggcacgcgagtgatcgtaagctcg

SEQ ID NO: 56877 - RNA, 381 nt, synthetic construct
  misc_feature 1..381: note = derived and/or modified sequence opt11 from anti-HIV-1_HeavyChain
  source 1..381: mol_type = other RNA
caggtgtatatgggggcggggagggggggggtgaagaagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56878 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacaggccggggccggggtcaagaaaccgggcgcgagcgtgaccttgagctgtaaaacggccgatgaagatgtctttgacgcggcctatatgcattgggtgcgccaggccccgggccagccctttgaatggctcgggtggatgaaaccggtcacgggcgcggtctcgtacgcgcgcaagttccagggcagggtctcgttctatatgacgcgcgagctcgggatggcgtacatggacttgcgcaatctcaggttcgatgacacggccgtgtacttttgcgcgcgcaagaccgcgggcgatgtctcgggcgataacaggggctatttctttgacttgtgggggcgcgggagcagggtcatagtctcgagc

SEQ ID NO: 56879 - RNA, 381 nt, synthetic construct
  misc_feature 1..381: note = derived and/or modified sequence opt11 from anti-HIV-1_HeavyChain
  source 1..381: mol_type = other RNA
caagtccaactcgtacaatccggcgccgaagtcaaaaaacccggcgcctccgtcaaaatctcctgcaaagcctccggctacaccttcatccgccacggcatccactggctccgccaagtcccaggccaacgccccgaatggatgggctggatccgccccaaaaccggcgcccgcaaccaagcccgccaattccaaccccgcatctccctcgcccgcgaccgcgccctctccaccgcctacctcgacctcaactcactcacctccgccgactccggcacctacttctgcgcccgccaaaccttcaaacccgacttctacttcgccgaccaaggctggtccttcaacctctggggccgcggcgcccacttcatcgtctcctcc

SEQ ID NO: 56880 - RNA, 381 nt, synthetic construct
  misc_feature 1..381: note = derived and/or modified sequence opt11 from anti-HIV-1_HeavyChain
  source 1..381: mol_type = other RNA
caggtcttgctcgtgcaatcgggcgcggaagtgaaaaagcccgggagctcggtcaaggtctcgtgcaaggcctcgggcgacagcctgaccaagtacgcgttctcgtgggtgcgccaggccccgggccagggcccggaatggatgggatggatacgcccgaaaacgggcgcgcgcaatcgcgcgcgccagttccagcccaggatctcgctcacgcgcgatcgcgcgctctcaaccgcgtacttggacttgaactcgctcacgagcgcggactcgggcacgtacttttgcgcgcgccagacctttaaaccggacttttactttgccgatcaagggtggtcgttcaatctctggggcaggggcgcgcactttatcgtgagctcg

SEQ ID NO: 56881 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgttgagttgtaagacggcggatgaggatgtgtttgatgcggcgtatatgcattgggtgaggcaggcgagggggcagacgtttgagtggttggggtggatgaagccggtgacgggggcggtgaattatgcgaggaagtttcaggggagggtgagtttttataggacgagagagttggggatagcgtacatggatttgaggaatttgaggtttgatgatacggcggtgtatttttgtgcgaggaagacggcgggggatgtgagtggggataagagggggtttttttttgatctgtgggggagggggagtagggtgatagtgagtagc

SEQ ID NO: 56882 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgggggcgtgaaaaagcccggggcctcggtcacgctatcgtgcaagaccgcggacgaggacgtgttcgatgccgcgtacatgcactgggtcaggcaagcgcccgggcaaacgttcgagtggttgggctggatgaagcccgtgaccggggccgtgaactatgccaggaaatttcaagggcgcgtgagcttttacaggaccagggaattgggcatagcctatatggatctaaggaacttgcgctttgacgataccgcggtctatttctgtgccaggaaaacggccggggacgtgagcggggacaatcgcgggtactttttcgatctctggggcaggggctcgcgcgtgatagtgagctcg

SEQ ID NO: 56883 - RNA, 381 nt, synthetic construct
  misc_feature 1..381: note = derived and/or modified sequence opt11 from anti-HIV-1_HeavyChain
  source 1..381: mol_type = other RNA
caagtgtacatggaacaggccgggggcggggtcaagaaaccgggcgcgagcgtgaccttgagctgtaaaacggccgatgaagatgtctttgacgcggcctatatgcattgggtgcgccaggccccgggccagacctttgaatggctagggtggatgaaaccggtcacgggcgcggtcaattacgcgcgcaagttccagggcagggtctcgttctatcgaacgcgcgagctcgggatcgcgtacatggacttgcgcaatctcaggttcgatgacacggccgtgtacttttgcgcgcgcaagaccgcgggcgatgtctcgggcgataaaaggggctttttctttgacttgtgggggcccgggagcagggtcatagtctcgagc

SEQ ID NO: 56884 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagcatgacggtgagttgtaagacggcggatgaggatatatttgatgcggcgtatatgaggtgggtgaggcaggcgccggggcagacgtttgagtggttggggtggatgaagccagtgacgggggcggtgaattatgcgaggcagtttcaggggagggtgagtttttataggacgagggagttggggatagcgtatatggatttgagggatctgaagtttgatgatacggcggtgtatttttgtgcgagaaagacgaagggggatgtgagtggggatgacagggggtttttttttgatttgtgggggagggggacgagggtgatagtgagtagc

SEQ ID NO: 56885 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggagggggcgtgaaaaagcccggggcatcggtcacgctctcgtgcaagaccgcggacgaggacgtgttcgatgccgcgtacatgcactgggtcaggcaagcgcccgggcaaacattcgagtggttgggctggatgaagcccgtgaccggggccgtgagctatgccaggaaatttcaagggcgcgtgagcttttacatgaccagggaattgggcatggcctatctcgatctcaggaacttgcgatttgacgataccgcggtctatttctgtgcaaggaaaacggccggggacgtgagcggggacaatcgagggtactttttcgatctctggggcaggggctcgcgcgtgatagtgagctcg

SEQ ID NO: 56886 - RNA, 381 nt, synthetic construct
  misc_feature 1..381: note = derived and/or modified sequence opt11 from anti-HIV-1_HeavyChain
  source 1..381: mol_type = other RNA
caagtgcaattggtccagagcggggccgaggtcaagaaaccgggcgcgagcgtgaaagtgagctgtaaagcgagcgggtacacgttcacgggctattacatgcactgggtcaggcaagcgcccgggcaagggctcgagtggataggctgggtcaagaccgtgaccggggccgtgaactttggctcgctcgatttcaggcacaggatctcgctcacgcgcgatcgagatctctttaccgcgcacatggacatacgagggctcacgcaaggggacacggccacgtacttttgcgcgcgccagaaatttgaatcgcgctataccgggggccagggctggtactttgacctgtgggggcgcgggacccatatcgtggtctcgagc

SEQ ID NO: 56887 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgggggcgtgaaaaagcccggggcctcggtcacgctctcgtgcaagaccgcggacgaggacgtgttcgatgccgcgtacatgcactgggtcaggcaagcgcccgggcaaacgttcgagtggctgggctggatcaagcccgtgaccggggcagtgaactatgccaggaaatttcaagggcgagtgagcttttacaggaccagggaattgggcatagcctatatggatctcaggaacttgcgctttgacgataccgcggtctatttctgtgccaggaaaacggccggggacgtgagcggggacaagcgcgggttctttttcgatctctggggcaggggctcgcgcgtgatcgtgagctca

SEQ ID NO: 56888 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagtgtgacggtgagttgtaagacggcggatgaggatatatttgatgcggcgtatatgcattgggtgaggcaggcgccggggcagacgtttgagtggttggggtggatgaagccggtgacgggggcggtgaattatgcgaggcagtttcaggggagggtgagtttttataggacgagggagttggggatagcgtatatggatttgagggatttgaagtttgatgatacggcggtgtatttttgtgcgaggaagacgaagggggatgtgagcggggatgatagggggtttttttttgatttgtgggggagggggacgagggtgatagtgagtagt

SEQ ID NO: 56889 - RNA, 381 nt, synthetic construct
  misc_feature 1..381: note = derived and/or modified sequence opt11 from anti-HIV-1_HeavyChain
  source 1..381: mol_type = other RNA
caagcgcacttggaacagagcgggagcggggtcaagaaaccgggcgcgagcgtgcgcgtgagctgttggtcgagcgaggacataagcaaggccgagctcatacactgggtcaggcaagcgcccgggcaagggctcgagtggataggctgggtcaagaccgtgaccggggcagtgaactttggctcgctcgatttcaggcacaggatctcgctaacgcgagatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 56890 - RNA, 381 nt, synthetic construct
  misc_feature 1..381: note = derived and/or modified sequence opt11 from anti-HIV-1_HeavyChain
  source 1..381: mol_type = other RNA
caggtgtatatggaggcggggagggggggggtgaagaagccgggggcgagtgcgacgttgagttgtaagacggcggatgaggatgtgtttgatgcggcgtatatgcattgggtgaggcaggcgccggggcagacgtttgagtggttggggtggatgaagccggtgacgggggcggtgagttatgcgaggaagtttcaggggagggtgagtttttatatgacgagggagttggggatggcgtatatggatttgaggaatttgaggtttgatgatacggcggtgtatttttgtgcgaggaagacggcgggggatgtgagtggggataatagggggtatttttttgatctgtgggggagggggagtagggtgatagtgagcagt

SEQ ID NO: 56891 - RNA, 381 nt, synthetic construct
  misc_feature 1..381: note = derived and/or modified sequence opt11 from anti-HIV-1_HeavyChain
  source 1..381: mol_type = other RNA
aggtgcatatggaggcaagcgggcgggggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgaccggggccgtgagctatgccaggaaatttcaagggcgcgtgagcttttacatgaccagggaactgggcatggcctatatggatctcaggaacttgcgctttgacgataccgcggtctatttctgtgccaggaaaacggccggggacgtgagcggggacaatcgcgggtactttttcgatctctggggcaggggctcgcgcgtgatcgtgagctcg

SEQ ID NO: 56892 - RNA, 381 nt, synthetic construct
  misc_feature 1..381: note = derived and/or modified sequence opt11 from anti-HIV-1_HeavyChain
  source 1..381: mol_type = other RNA
caggtatatatggagcaagcgggagggggcgtgaaaaagcccggggcctcggtcacgctctcgtgcaagaccgcggacgaggacgtgttcgatgccgcgtacatgcactgggtcaggcaagcgccagggcaaacgttcgagtggttgggctggatcaagcccgtgaccggggccgtgagctatgcaaggaaatttcaagggcgcgtgagcttttacatgaccagggaattgggaatggcctatatggatctcaggaacttgcgatttgacgataccgcggtctatttctgtgccaggaaaacggccggggacgtgagcggggacaatcgcgggtactttttcgatctctggggcaggggctcgcgcgtgatagtgagctcg

SEQ ID NO: 56893 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcaagagctcgtgctggacctcggaagatatctttgacacgaccgagctcatatactgggtcaggcaagcgcccgggcaagggctcgagtggataggatgggtcaagatcgtgagcgggaccgtgaacttcgcctcgctcgatttcaggaacaggatctcgctatcacgcgatcgcgatctctcgaccgcgtacatggacatacgcgggctcacgcaagatgacacggccacgtacttttgcgcgcgccagaaatttgcctcacgctatagcggggaccagggctcgtactttgacttgtgggggcgcgggaccttgatcgtggtctcgagc

SEQ ID NO: 56894 - RNA, 381 nt, synthetic construct
  misc_feature 1..381: note = derived and/or modified sequence opt11 from anti-HIV-1_HeavyChain
  source 1..381: mol_type = other RNA
aggtgtttgtggaggcaggcggggggggggatgaagaagccgggggcgagtatgacggtgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatttgaggaatttgaggtttgatgatacggcggtgtatttttgtgcgaggaagacggcgggagatgtgagtggggataagagggggtttttttttgatttgtgggggagggggagtagggtgatagtgagtagt

SEQ ID NO: 56895 - RNA, 381 nt, synthetic construct
  misc_feature 1..381: note = derived and/or modified sequence opt11 from anti-HIV-1_HeavyChain
  source 1..381: mol_type = other RNA
aggtgtatatgggagagggcggggggggggatgaagaagccgggggcgagtatgacggtgagttgtaagacggcggatgaggatatatttgatgcggcgtatatgcattgggtgaggcaggcgccggggcagacgtttgagtggttggggtggatgaagccggtgacgggggcggtgaattatgcgaggcagtttcaggggagggtgagtttttataggacgagggagttggggatagcgtatatggatctgagggatttgaagtttgatgatacggcggtgtatttttgtgcgaggaagacgaagggggatgtgagtggggatgatagggggtttttttttgatttgtgggggagggggacgagggtgatagtgagtagc

SEQ ID NO: 56896 - RNA, 381 nt, synthetic construct
  misc_feature 1..381: note = derived and/or modified sequence opt11 from anti-HIV-1_HeavyChain
  source 1..381: mol_type = other RNA
caggtgcagttggagcaggcgggggggggggtgaagaagccgggggcgagcgtgacgttgagctgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttatagaacgagggagttggggatagcgtatatggatttgaggaatttgaggtttgatgatacggcggtgtatttttgtgcgaggaagacggcgggggatgtgagcggggataagagggggtttttttttgatttgtgggggagggggagcagagtgatagtgagcagt

SEQ ID NO: 56897 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcggggggggggatgaagaagccgggggcgagcatgacggtgagttgtaagacggcggatgaggatgtgtttgatgcggcatatatgcattgggtgaggcaggcgccggggcagacgtttgagtggctggggtggatgaagccggtgacgggggcggtgaattatgcgaggaagtttcaggggagggtgagtttttatagaacgagggagttggggatagcgtatatggacttgaggaatttgaggtttgatgatacggcggtgtatttttgtgcgaggaagacggcgggggatgtgagtggggataagagggggtttttttttgatctgtgggggagggggagtagggtgatagtgagtagt

SEQ ID NO: 56898 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaagaagccgggggcgagtgtgacgctgagttgtaagacggcggatgaggatgtgtttgatgcggcatatatgaggtgggtgaggcaggcgccggggcagacgtttgagtggttggggtggatgaagccggtgacgggggcggtgagttatgcgaggaagtttcaggggagggtgagtttttatatgacgagggagttggggatggcatatatggatttgaggaatttgaggtttgatgatacggcggtgtatttttgtgcgaggaagacggcgggggatgtgagtggggataatagggggtatttttttgatttgtgggggagggggagtagggtgatagtgagtagt

SEQ ID NO: 56899 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcagccgggggggggggtgaagaagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgagttatgcgaggaagtttcaggggagggtgagcttttatatgacgagggagttggggatggcgtatatggatttgaggaatttgaggtttgatgatacggcggtgtatttttgtgcgaggaagacggcgggggatgtgagcggggataatagggggtatttttttgatttgtgggggagggggagcagggtgatagtgagtagt

SEQ ID NO: 56900 - RNA, 381 nt, synthetic construct
  misc_feature 1..381: note = derived and/or modified sequence opt11 from anti-HIV-1_HeavyChain
  source 1..381: mol_type = other RNA
caggtatatatggagcaggcggggggggaggtgaagaagccgggggcgagtgtgacgttgagttgtaagacggcggacgaggatgtgtttgatgcggcgtatatgcattgggtgaggcaggcgccggggcagacgtttgagtggttggggtggatgaagccggtgacgggggcggtgagttatgcgaggaagtttcaggggagggtgagcttttatatgacgagggagttggggatggcatatatggatttgaggaatctgagatttgacgatacggcggtgtatttttgtgcgaggaagacggcgggggacgtgagcggggataatagggggtacttttttgatctgtgggggagggggagtagagtgatagtgagcagt

SEQ ID NO: 56901 - RNA, 381 nt, synthetic construct
  misc_feature 1..381: note = derived and/or modified sequence opt11 from anti-HIV-1_HeavyChain
  source 1..381: mol_type = other RNA
caagtccaactcgtccaatcaggcgccgaagtcaaaaaacccggcgcctccgtccgcgtctcctgccaagcctccggctacatcttcaccggctacttcgtcaactggctccgccaactccccggccaacgacccgaatggatgggctggatccgccccaaatccggcgcccgcaaccaagcccgccaattccaaccccgcatctcactcacccgcgaccgcgccctatccaccgcctacctcgactccaactccctcacctccgccgactccggcacatacttctgcgcccgccaaaccttcaaacccgacttctacttcgccgaccaaggctggtccttcaacctctggggccgcggcgcccacttcatcgtctcctcc

SEQ ID NO: 56902 - RNA, 381 nt, synthetic construct
  misc_feature 1..381: note = derived and/or modified sequence opt11 from anti-HIV-1_HeavyChain
  source 1..381: mol_type = other RNA
gggtgcatatggacgcaagcgggcgggggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgaccggggccgtgagctatgccaggaaatttcaagggcgcgtgagcttttacatgaccagggaattgggcatggcctatatggatctcaggaacttgcgctttgacgataccgcggtctatttctgtgccaggaaaacggccggggacgtgagcggggacaatcgcgggtactttttcgatctctggggcaggggctcgcgcgtgatcgtgagctcg

SEQ ID NO: 56903 - RNA, 381 nt, synthetic construct
  misc_feature 1..381: note = derived and/or modified sequence opt11 from anti-HIV-1_HeavyChain
  source 1..381: mol_type = other RNA
aggtgtatatggaggcaggcggggggggggatgaagaagccgggggcgagtatgacggtgagttgtaagacggcggatgaggatatatttgatgcggcgtatatgcattgggtgaggcaggcgccggggcagacgtttgagtggttggggtggatgaagccggtgacgggggcggtgaattatgcgaggcagtttcaggggagggtgagtttttataggacgagggagttggggatagcgtatatggatttgagggatctgaagtttgatgatacggcggtgtatttttgtgcgaggaagacgaagggggatgtgagtggggatgacagggggtttttttttgatttgtgggggagggggacgagagtgatagtgagtagt

SEQ ID NO: 56904 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggagtgaagaagccgggggcgagtgtgacgctgagttgtaagacggcggatgaggatgtgtttgatgcggcgtatatgcattgggtgaggcaggcgccggggcagacgtttgagtgggtagggtggatgaagccggtgacgggggcggtgagttatgcgaggaagtttcaggggagagtgagtttttatatgacgagggagttggggatggcgtatatggatttgaggaatttaaggtttgatgatacggcggtgtatttttgtgcgaggaagacggcgggggatgtgagcggggataatagggggtatttttttgatttgtgggggagggggagtagggtgatagtgagtagt

SEQ ID NO: 56905 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggggtgaaggagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcgtatatggatctgaggaatttgaggtttgatgatacggcggtgtatttttgtgcgaggaagacggcgggggatgtgagtggggataagagggggtttttttttgatttgtgggggagggggagtagggtgatagtgagtagt

SEQ ID NO: 56906 - RNA, 381 nt, synthetic construct
  misc_feature 1..381: note = derived and/or modified sequence opt11 from anti-HIV-1_HeavyChain
  source 1..381: mol_type = other RNA
caagcgcacttggaacagagcgggagcggggtaaagaaaccgggcgcgagcgtgcgcgtgagctgttggtcgagcgaggacatattcaagaccgagctcatacactgggtcaggcaagcgcccgggcaagggctcgagtggataggctgggtcaagaccgtgacaggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctatacagggggccagggctggtactttgacttgtgggggcgcgggacccatatcgtggtctcgagc

SEQ ID NO: 56907 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggtcgagcgaggacatattcgagcgcacggaattgatccattgggtgcgccaggccccgggccagggcttggaatggatcgggtggatgaaaacggtcacgggcgcggtcaatttcgggagcttggactttcgccatcgcatcagcttgaccagggacagggacttgttcacggcccatatggatataaggggcttggcccagggcgataccgcgacctatttctgtgccaggcaaaagttcgagagcaggtacacgggcgggcaagggtggtatttcgatctctggggcaggggcacgcacatagtcgtgagctcg

SEQ ID NO: 56908 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtaaagaaaccgggcgcgagcgtgagagtgagctgttggacgagcgaggacatattcgagcgcacggaattgatccattgggtgagacaggcaccgggacagggattggaatggatcgggtgggtgaaaacggtaacgggcgcggtaaatttcgggagcctggactttagacatcgaatcagcttgaccagggacagggacttgttcacggcccatatggatataaggggcttgacacagggcgatacagcgacctatttctgtgcaagacaaaagttcgagagcaggtacacgggcgggcaagggtggtatttcgatctctggggaaggggcacgcacatagtcgtgagctcg

SEQ ID NO: 56909 - RNA, 384 nt, synthetic construct
  misc_feature 1..384: note = derived and/or modified sequence opt11 from anti-HIV-1_HeavyChain
  source 1..384: mol_type = other RNA
caaagccacctcgaacaatccggctccgccatgaaaaaacccggcgcctccgtccgcgtatcctgctggacctcagaagacatcttcgacaccaccgaactcatctactgggtccgacaagcccccggccaaggcctcgaatggatcggctgggtaaaaatcgtatccggcaccgtcaacttcgcctccctcgacttccgcaaccgcatctccctctcccgcgaccgcgacctctccaccgcctacatggacatccgcggcctcacccaagacgacaccgccacctacttctgcgcccgccaaaaattcgcctcccgctactccggcgaccaaggctcctacttcgacctctggggccgcggcaccctcatcgtagtctcctcc

SEQ ID NO: 56910 - RNA, 384 nt, synthetic construct
  misc_feature 1..384: note = derived and/or modified sequence opt11 from anti-HIV-1_HeavyChain
  source 1..384: mol_type = other RNA
tcccacacctggaacaaccgcggctccgccatgaaaaaacccggcgcctcagtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctccctcgacttccgcaaccgcatctcactctcccgagaccgcgacctctccaccgcctacatggacatccgcggcctcacccaagacgacaccgccacctacttctgcgcccgccaaaaattcgcctcccgctactccggcgaccaaggctcctacttcgacctctggggccgaggcaccctcatcgtcgtctcctcc

SEQ ID NO: 56911 - RNA, 381 nt, synthetic construct
  misc_feature 1..381: note = derived and/or modified sequence opt11 from anti-HIV-1_HeavyChain
  source 1..381: mol_type = other RNA
caatcgcacttggaacagagcgggagcgcgatgaagaaaccgggagcgagcgtgagagtgagctgttggacgagcgaggacatattccataacgagctcatatactgggtcaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgtacatggacatacgcgggctcacgcaagacgacacggccacgtacttttgcgcgcgccagaaatttgcctcgcgctatagcggggaccagggctcgtactttgacttgtgggggcgcgggaccttgatcgtggtctcgagc

SEQ ID NO: 56912 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtaagctgttggacgagcgaggacatattcgagcgcacggaactgatacattgggtgcgccaggccccgggccagggcttggaatggatcgggtggatgaaaacggtcacgggcgcggtcaatttcgggagcttggactttcgccatcgcatcagcttgaccagggacagggacttgttcacggcccatatggatataaggggcttgacccagggcgataccgcgacctatttctgtgccaggcaaaagttcgagagcaggtacacgggcgggcaagggtggtatttcgatctctggggcaggggaacgcacatagtcgtgagctcg

SEQ ID NO: 56913 - RNA, 381 nt, synthetic construct
  misc_feature 1..381: note = derived and/or modified sequence opt11 from anti-HIV-1_HeavyChain
  source 1..381: mol_type = other RNA
caagtgttcatggaacaggccgggggcgaggtcaagaaaccgggcgcgagcatgaccgtgagctgtaaaacggccgatgaagatgtctttgacgcggcctatatgcattgggtgcgccaggccccgggccagacctttgaatggctcgggtggatgaaaccggtcacgggcgcggtcaattacgcgcgccagttccagggcagggtctcgttctatcgcacgcgagagctcgggatcgcgtacatggacttgcgcgatctcaagttcgatgacacggccgtgtacttttgcgcgcgcaagaccaagggcgatgtctcgggcgatgacaggggctttttctttgacttgtgggggcgcgggaccagggtcatagtctcgagc

SEQ ID NO: 56914 - RNA, 381 nt, synthetic construct
  misc_feature 1..381: note = derived and/or modified sequence opt11 from anti-HIV-1_HeavyChain
  source 1..381: mol_type = other RNA
caagcgcacttggaacagagcgggagcggggtcaagaaattgggcgcgagcgtgcgcgtgagctgttggacaagcgaggacatattcgaggacgagctcatacactgggtcaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgtacatggacatacgcgggctcacgcaagatgacacggccacgtacttttgcgcgcgccagaaatttgcctcgcgctatagcggggaccagggctcgtactttgacttgtgggggcgcgggaccttgatcgtggtctcgagc

SEQ ID NO: 56915 - RNA, 381 nt, synthetic construct
  misc_feature 1..381: note = derived and/or modified sequence opt11 from anti-HIV-1_HeavyChain
  source 1..381: mol_type = other RNA
caatcgcacttggaacagagcgggagcgcgatgaagaaaccgggcgcgagcgtgcgcgtgagctgttggacaagcgaggacatactcaaggccgagctcatatactgggtcaggcaagcgcccgggcgcgggctcgagtggataggctgggtcaagaccgtgagcgggaccgtgaactttggctcgagcgatttcaggaacaggatctcgctcacgcgcgatcgcgatctctcgaccgcgcacatggacatacgagggctcacgcaagatgacacggccacgtacttttgcgcgcgccagaaatttgaatcgctctatagcgatgaccagggctcgtactttgacttgtgggggcgcgggaccttgatcatagtctcgagc

SEQ ID NO: 56916 - RNA, 381 nt, synthetic construct
  misc_feature 1..381: note = derived and/or modified sequence opt11 from anti-HIV-1_HeavyChain
  source 1..381: mol_type = other RNA
caagtccaactcgtccaatccggcgccgaagtcaaaaaacccggcgcctccgtcaaagtctcctgcaaagcctccggctactccttcaccgactactacatccactggctccgccaagtccaaggccaacgccccgaatggatgggctggatccgcccccgcaccggcgcccgcaaccaagcccgccaattccaaccccgcatctcactcacccgcgaccgcgccctctccaccgcctacctcgacctcaactccctcacctccgccgactccggcacctacttctgcgcccgccaaaccttcaaacccgacttctacttcgccgaccaaggctggtccttcaacctctggggccgcggcgcccacttcatcgtctcctcc

SEQ ID NO: 56917 - RNA, 381 nt, synthetic construct
  misc_feature 1..381: note = derived and/or modified sequence opt11 from anti-HIV-1_HeavyChain
  source 1..381: mol_type = other RNA
caggtgtttatggagcaggcggggggggaggtgaagaagccgggggcgagtatgacggtgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagcttttataggacgagggagttggggatagcgtatatggatttgagggatttgaagtttgatgatacggcggtgtatttttgtgcgaggaagacgaagggggatgtgagcggggatgatagggggtttttttttgatctgtgggggagggggacgagagtgatagtgagtagt

SEQ ID NO: 56918 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcggggccggagtcaagaaaccgggcgcgagcgtgcgcgtgagctgttggacgagcgaggacatattcgagcgaacggaattgatccattgggtgcgccaggcaccgggccagggcttggaatggatcgggtgggtgaaaacggtcacgggcgcggtcaatttcgggagcttggactttcgccatcgaatcagcttgaccagggacagagacttgttcacggcacatatggatataaggggcttgacccagggcgataccgcgacctatttctgtgccaggcaaaagttcgagagcaggtacacgggcgggcaagggtggtatttcgatctctggggcaggggcacgcacatagtcgtgagctca

SEQ ID NO: 56919 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggcgcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttacagcgcacatggacatacgagggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 56920 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctgggcctcggaagatatcttcgacacgaccgagctcatatactgggtcaggcaagcgcccgggcaagggctagagtggataggctgggtcaagatcgtgagcgggaccgtgaacttcgcctcgctcgatttcagaaacaggatctcgctctcgcgcgatcgcgacctatcgaccgcgtacatggacatacgcgggctcacgcaagatgacacggccacgtacttttgcgcgcgccagaaatttgcctcgcgctatagcggggaccagggctcgtactttgacttgtgggggcgcgggaccttgatcgtggtctcgagc

SEQ ID NO: 56921 - RNA, 381 nt, synthetic construct
  misc_feature 1..381: note = derived and/or modified sequence opt11 from anti-HIV-1_HeavyChain
  source 1..381: mol_type = other RNA
cgctgtcgcttggtccagagcggggccgaggtcaagaaaccgggcgcgagcgtgcgcgtgagctgtcaagcgagcgggtacacgttctcggcctatggcgtgaactgggtaaggcaagcgcccgggcaagagctcgagtggataggctgggtcaagaccgtgaccggggcagtgaactttggctcgcccaatttcaggcacaggatctcgctaacgcgcgatcgcgatctctttaccgcgcacatggacatacgcgggctcacgcaaggggacacggccacgtacttttgcgcgcgccagaaatttgaatcgcgatatacagggggccagggctggtactttgacttgtgggggcgcgggacccatatcgtggtctcgagc

SEQ ID NO: 56922 - RNA, 384 nt, synthetic construct
  misc_feature 1..384: note = derived and/or modified sequence opt11 from anti-HIV-1_HeavyChain
  source 1..384: mol_type = other RNA
caagcgcacctggaacagagcgggagcggggtcaagaaaccgggcgcgagcgtgcgcgtgagctgttggtcgagcgaggacatattcgagcgcacggaattgatccattgggtgtgccaggccccgggccagggcttggaatggatcgggtgggtgaaaacggtcacgggcgcggtcaatttcgggagcttggactttcgccatcgcatcagcttgaccagggacagggacctgttcacggcccatatggatataagaggcttgacccagggcgataccgcgacctatttctgtgccaggcaaaagttcgagagcaggtacacgggcgggcaagggtggtatttcgatctctggggcaggggcacgcacatagtagtgagctcg

SEQ ID NO: 56923 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggtcgagcgaggacatattcgagcgcacggaattgatccattgggtgcgccaggccccgggccagggcttggaatggatagggtgggtgaaaatagtcacgggcgcggtcaatttcgggagcttggactttcgccatcgaataagcctgaccagggacagggacttgttcacggcccatatggatataaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 56924 - RNA, 384 nt, synthetic construct
  misc_feature 1..384: note = derived and/or modified sequence opt11 from anti-HIV-1_HeavyChain
  source 1..384: mol_type = other RNA
caggtccagctcgtgcaatcgggcttggaagtgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgcacatggacatacgcgggctcacgcaagatgacacggcaacgtacttttgcgcgcgacagaaatttgcctcacgctatagcggggaccagggctcgtactttgacttgtgggggcgcgggaccttgataatagtctcgagc

SEQ ID NO: 56925 - RNA, 384 nt, synthetic construct
  misc_feature 1..384: note = derived and/or modified sequence opt11 from anti-HIV-1_HeavyChain
  source 1..384: mol_type = other RNA
caatcgcacttggaacagagcgggagcgcgatgaagaaaccgggcgcgagcgtgcgcgtaagctgttggacgagcgaggacatattcgataccacggaactgatctattgggtgcgccaggccccgggccagggcttggaatggatcgggtgggtgaaaatagtctcgggcacggtcaatttcgcgagcttggactttcgcaatcgcatcagcttgagcagggacagggacctgagcacggcccatatggatataaggggcttgcgccaggacgataccgcgacatatttctgtgccaggcaaaagttcgagagcaggtactcgggcgatcaagggagctatttcgatctctggggcagaggcacgctcataatcgtgagctcg

SEQ ID NO: 56926 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccaggacagggcttggaatggatcgggtgggtgaaaacggtcacgggcgcggtcaatttcgggagctcggactttcgccagcgcgtgagcttgaccagggacagggacttgttcacggcacatatggatatcaggggcttgacccagggcgataccgcgacctatttctgtgccaggcaaaagttcgcgagcaggtactcgggcgatcaagggagctatttcgatctctggggcaggggcacgctcatagtcgtgagctcg

SEQ ID NO: 56927 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcctggaatggatcgggtgggtgaaaacggtcacgggcgcggtcaatttcgggagcccgaactttcgccatcgcgtgagcctgaccagggacagggacttgttcacggcccatatggatatcagaggcttgacacagggcgataccgcgacctatttctgtgccaggcaaaagttcgagagcaggtacacgggcgggcaagggtggtatttcgatctatggggcaggggcacgcacatagtcgtgagctcg

SEQ ID NO: 56928 - RNA, 384 nt, synthetic construct
  misc_feature 1..384: note = derived and/or modified sequence opt11 from anti-HIV-1_HeavyChain
  source 1..384: mol_type = other RNA
aggcacacgtgggagcaatcaggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctcgaccgcgtacatggacatacgcgggctcacgcaagatgacacggccacgtacttttgcgcgcgacagaaatttgcctcgcgctatagtggggaccagggctcgtactttgacttgtgggggcgcgggaccttgatcgtggtctcgagc

SEQ ID NO: 56929 - RNA, 384 nt, synthetic construct
  misc_feature 1..384: note = derived and/or modified sequence opt11 from anti-HIV-1_HeavyChain
  source 1..384: mol_type = other RNA
caatcacacttggaacagagcgggagcgcgatgaagaaaccgggcgcgagcgtgcgcgtgagctgttggacgagcgaggacatattcgataccacggaattgatctattgggtgcgccaggccccgggccagggcctggaatggatcgggtgggtgaaaatagtctcgggcacggtcaatttcgcgagcttggactttcgcaatcgcatcagcttgagcagggacagggacttgagcacggcctatatggatataaggggcttaacccaggacgataccgcgacctatttctgtgccaggcaaaagttcgagagcaggtacacgggcgggcaagggtggtatttcgatctctggggcaggggcacgcacatagtcgtgagctcg

SEQ ID NO: 56930 - RNA, 384 nt, synthetic construct
  misc_feature 1..384: note = derived and/or modified sequence opt11 from anti-HIV-1_HeavyChain
  source 1..384: mol_type = other RNA
caggtccagctcgtgcaatcgggcgcggaagtgaaaaagcccggggcctcggtcagggtctcgtgctggacctcggaagatatctttgacacgaccgagctcatatactgggtaaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgcacatggacatacgcgggctcacgcaagatgacacggccacgtacttttgcgcgcgccagaaatttgaatcgcgctataccgggggccagggctggtactttgacctgtgggggagagggacccatatcgtggtctcgagc

SEQ ID NO: 56931 - RNA, 384 nt, synthetic construct
  misc_feature 1..384: note = derived and/or modified sequence opt11 from anti-HIV-1_HeavyChain
  source 1..384: mol_type = other RNA
caatcgcacttggaacagagcgggagcgcgatgaagaaaccgggcgcgagcgtgcgcgtgagctgttggacgagcgaggacatattcgataccacggaattgatctattgggtgcgccaggccccgggacagggcttggaatggatcgggtgggtgaaaatagtctcgggcacggtcaatttcgcgagcttggactttcgcaatcgcatcagcttgagcagggacagggacttgagcacggcatatatggatataaggggcttgacccagggcgataccgcgacctatttctgtgccaggcaaaagttcgagagcaggtacacgggcgggcaagggtggtatttcgatctctggggcaggggcacgcacatagtcgtgagctca

SEQ ID NO: 56932 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtccgcgtatcctgctggacctccgaagacatcttcgaacgcaccgaactcatccactgggtccgccaagcccccggccaaggcctcgaatggatcggctgggtcaaaaccgtctcaggcgccgtcaacttcggctcccccgacttccgccaccgcatctccctctcccgcgaccgcgacctctccaccgcccacatggacatccgcggcctaacccaagacgacaccgccacctacttctgcgcccgccaaaaattcgcctcccgctactccggcgaccaaggctcatacttcgacctctggggccgcggcaccctcatcatcgtctcctcc

SEQ ID NO: 56933 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggcaggggcttggaatggatcgggtgggtgaaaacggtctcgggcacggtcaatttcgggagctcggactttcgcaatcgcgtgagcttgaccagggacagggacttgagcacggcccatatggatatcagaggcttgacccaggacgataccgcgacctatttctgtgccaggcaaaagttcgagagcttgtactcggacgatcaagggagctatttcgatctatggggcaggggcacgctcataatcgtgagctcg

SEQ ID NO: 56934 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtccgcgtctcctgctggacctccgaagacatcttcgaacgcaccgaactcatccactgggtccgacaagcccccggccaaggcctcgaatggatcggctgggtcaaaaccgtcaccggcgccgtcaacttcggctcccccaacttccgcaaccgcatctccctcacccgagaccgcgacctatccaccgcccacatggacatccgaggcctcacccaagacgacaccgccacctacttctgcgcccgccaaaaattcgaatccctctactccgacgaccaaggctcctacttcgacctctggggccgcggcaccctcatcatcgtctcctcc

SEQ ID NO: 56935 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaggcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcgctctcgcgcgatcgcgatctctcgaccgcgtacatggacatacgcgggctaacgcaagatgacacagccacgtacttttgcgcacgccagaaatttgcctcgcgctatagcggggaccagggctcgtactttgacttgtgggggcgcgggaccttgatcgtggtctcgagc

SEQ ID NO: 56936 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaattgggcgcgagcgtgcgagtgagctgttggacgagcgaggacatattcgagcgaacggaattgatccattgggtgcgacaggcaccgggccagggcttggaatggatagggtgggtgaaagcggtctcgggagcggtcaattacgggagcctggactttagaaatagaataagcctgagcagggacagggacttgagcacggcctatatggatataaggggcttgacccaggacgataccgcgacctatttctgtgccaggcaaaagttcgcgagcaggtactcgggagatcaagggagctatttcgatctctggggcaggggaacgctcatagtagtgagctcg

SEQ ID NO: 56937 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggacgagcgaggacatattcgagcgaacggaattgatacattgggtgcgacaggcaccgggacagggcctggaatggatcgggtgggtgaaaacggtcacgggcgcggtcaatttcgggagcttggactttcgccatcgcatcagcttgaccagggacagagactttttcacggcccatatggatataaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 56938 - RNA, 381 nt, synthetic construct
  misc_feature 1..381: note = derived and/or modified sequence opt11 from anti-HIV-1_HeavyChain
  source 1..381: mol_type = other RNA
caagcgcacttggaacagagcgggagcggggtcaagaaaccgggcgcgagcgtgcgcgtgagctgttggtcgagcgaggacatattcaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctattcaccgcgcacatggacatacgcgggctaacgcaaggggacacagccacgtacttttgcgcgcgccagaaatttgaatcgcgctataccgggggccagggctggtactttgacctgtgggggcgcgggacccatatcgtggtctcgagc

SEQ ID NO: 56939 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgaacggaattgatccattgggtgcgccaggccccgggccagggcttggaatggatcgggtgggtgaaaacggtcacgggcgcggtcaatttcgggagcccgaactttcgacatcgcgtgagcttgaccagggacagggacttgttcacggcccatatggatatcaggggcttgacccagggcgataccgcgacctatttctgtgccaggcaaaagttcgagagcttgtactcggacgatcaagggagctatttcgatctctggggcaggggcacgctcataatcgtaagctcg

SEQ ID NO: 56940 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctccctcgacttccgcaaccgcatctccctctcccgcgaccgcgacctctccaccgcccacatggacatccgcggcctcacccaagacgacaccgccacctacttctgcgcccgccaaaaattcgcctcccgctactccggcgaccaaggctcctacttcgacctctggggccgcggcaccctcatcatcgtctcctcc

SEQ ID NO: 56941 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgagcgatttcaggaacaggatctcgctctcgcgcgatcgcgatctctcgaccgcgcacatggacatacgcgggctcacgcaagatgacacggccacgtacttttgcgcgcgccagaaatttgcctcgcgctatagcggggaccagggctcgtactttgacttgtgggggcgcgggaccttgatcgtggtctcgagc

SEQ ID NO: 56942 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtcaaaaagcccggggcctcggtaagggtctcgtgctggacctcagaagatatctttgaaaggaccgagctcatatactgggtcaggcaagcacccgggcgcgggctcgagtggataggctgggtcaagaccgtgagcgggaccgtgaactttggctcgagcgatttcaggaacaggatctcgctcacgcgcgatcgagatctctcgaccgcgcacatggacatacgagggctcacgcaagatgacacggccacgtacttctgcgcgcgccagaaatttgaatcactctacagcgatgaccagggctcatactttgacctgtgggggcgcgggaccctgatcatagtctcgagc

SEQ ID NO: 56943 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgacacgaccgagctaatacactgggtcaggcaagcgcccgggcaagggctcgagtggataggctgggtcaagaccgtgaccggggccgtgaactttggctcgctcgatttcaggcacaggatctcgctcacgcgagatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 56944 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatcttcggcacgaccgagctcatatactgggtcagacaagcgcccgggcaagggctcgagtggattggctgggtcaagatcgtgagcgggaccgtgaactttgcctcgctcgatttcagaaacaggatctcgctctcgcgcgatcgcgatctctcgaccgcgtacatggacatacgcggactcacgcaagatgacacggccacgtacttttgcgcgcgccagaaatttgcctcgcgctatagcggggaccagggctcgtactttgacttgtgggggcgcgggaccttgatcgtagtctcgagc

SEQ ID NO: 56945 - RNA, 384 nt, synthetic construct
  misc_feature 1..384: note = derived and/or modified sequence opt11 from anti-HIV-1_HeavyChain
  source 1..384: mol_type = other RNA
caagtccaactcgtccaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatagtctccggcaccgtcaacttcgcctccctcgacttccgcaaccgcatctccctctcccgcgaccgcgacctctccaccgcctacatggacatccgcggcctcacccaagacgacaccgccacctacttctgcgcccgccaaaaattcgcctcccgctactccggcgaccaaggctcctacttcgacctctggggccgcggcaccctcatcgtcgtctcctcc

SEQ ID NO: 56946 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggacgagcgagggcatattcgagcgcacggaattgatccattgggtgcgccaggccccgggccagggcttggaatggatcgggtgggtgaaaacggtcacgggcgcggtcaatttcgggagcttggactttcgacatcgcatcagcttgaccagggacagggacctgttcacggcacatatggatataaggggattgacccagggagataccgcgacctatttctgtgccaggcaaaagttcgagagcaggtacacgggcgggcaagggtggtatttcgatctctggggaaggggcacgcacatagtcgtgagctcg

SEQ ID NO: 56947 - RNA, 384 nt, synthetic construct
  misc_feature 1..384: note = derived and/or modified sequence opt11 from anti-HIV-1_HeavyChain
  source 1..384: mol_type = other RNA
caagcgcacctggaacagagcgggagcggggtcaagaaaccaggcgcgagcgtgcgcgtgagctgttggacgagcgaggacatattcgagcgcacggaactgatccattgggcgcgccaggccccgggccagggcttggaatggatcgggtgggtgaaaacggtcacgggcgcggtcaatttcgggagcccgaactttcgccatcgcgcgagcttgaccagggacagggacttgttcacggcccatatggatatcaggggcttgaccgagggcgataccgcgacctatttctgtgccagacaaaagttcgcgagcaggtactcgggcgatcaagggagctatttcgatctctggggcaggggcacgctcataatcgtgagctca

SEQ ID NO: 56948 - RNA, 384 nt, synthetic construct
  misc_feature 1..384: note = derived and/or modified sequence opt11 from anti-HIV-1_HeavyChain
  source 1..384: mol_type = other RNA
caatcgcacttggaacagagcgggagcgcgatgaagaaaccgggcgcgagcgtgcgcgtgagctgttggacgagcgaggacatattcgataccgcggaattgatctattgggtgcgccaggccccgggccagggcttggaatggatcgggtgggtgaaaatagtctcgggcacggtcaatttcgcgagcctggactttcgcaatcgcataagcctgagcagggacagggacttgagcacggcccatatggatatcaggggcttgcgccaggacgataccgcgacctatttctgtgccaggcaaaagttcgagagcaggtactcgggcgatcaagggagctatttcgatctctggggcaggggaacgctcataatcgtgagctca

SEQ ID NO: 56949 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaattgggcgcgagcgtgcgcgtgagctgttggacgagcgaggacatattcgagcgcacggaactgatccattgggtgcgccaggccccgggccagggcttggaatggatcgagtgggtgaaagcggtctcgggcgcggtcaattacgggagcttggactttcgccatcgagtgagcttgaccagggacagggacttgttcacggcccatatggatatcaggggcttgacccaggacgataccgcgacctatttctgtgccaggcaaaagttcgagagcaggtacacgggcgggcaagggtggtatttcgatctctggggcaggggcacgcacatagtcgtgagttcg

SEQ ID NO: 56950 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactcatctactgggtccgccaagccccaggccaaggcctcgaatggatcggctgggtcaaaatcgtctccggcaccgtcaacttcgcctccctcgacttccgcaaccgcatctccctctcccgagaccgcgacctatccaccgcctacatggacatccgcggcctcacccaagacgacaccgccacctacttctgcgcccgacaaaaattcgcctcccgctactccggcgaccaaggctcctacttcgacctctggggccgcggcaccctcgactgcgtctcctcc

SEQ ID NO: 56951 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactaatctactgggtccgacaagcccccggccaaggcctcgaatggatcggctgggtcaaaatcgtctccggcgccgtcaacttcgcatccctcgacttccgaaaccgcatctccctctcccgcgaccgcgacctctccaccgcccacatggacatccgcggcctcacccaagacgacaccgccacctacttctgcgcccgccaaaaattcgcctcccgctactccggcgaccaaggctcctacttcgacctctggggccgcggcaccctcatcatcgtctcctcc

SEQ ID NO: 56952 - RNA, 384 nt, synthetic construct
  misc_feature 1..384: note = derived and/or modified sequence opt11 from anti-HIV-1_HeavyChain
  source 1..384: mol_type = other RNA
caggcgcacttggagcagagcgggagcggggtaaagaagctgggggcgagcgtgagggtgagttgttggacgagcgaggacatattcgagaggacggagttgatacattgggtgaggcaggcgccggggcaggggttggagtggatagggtgggtgaaggcggtgagcggggcggtgaattacgggagcttggactttagacatagagtgagcttgacgagggacagggacttgagcacggcgcatatggatataagggggttgacgcagggggatacggcgacgtatttctgtgcgaggcagaagttcgagagcaggtacacaggagggcaggggtggtatttcgatctgtgggggagggggacgcacatagtggtaagcagt

SEQ ID NO: 56953 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctcaaccgcgcacatggacatacgcgggctcacgcaagatgacacggccacgtacttttgcgcgcgccagaaattcgaatcgctctatagcgatgaccagggctcgtactttgacttgtgggggcgcgggaccttgatcatagtctcgagc

SEQ ID NO: 56954 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggagcgagcgtgcgagtgagctgttggacgagcgaggacatattcgagcgcacagaattgatccattgggtgcgccaggccccgggccagggcttggaatggatcgggtgggtgaaaacggtcacgggcacggtcaatttcgggagcctgaactttcgccatcgcatcagcttgaccagggacagggacttgttcacggcccatatggatataaggggcttgacccagggcgataccgcgacctatttctgtgccagacaaaagttcgagagcaggtacacgggcgggcaagggtggtatttcgatctctggggaaggggcacgcacatagtcgtgagctcg

SEQ ID NO: 56955 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgaacgcaccgaactcatctactgggtccgccaagcccccggccgcggcctagaatggatcggctgggtcaaaatcgtctccggcaccgtcaacttcgcctccctcgacttccgcaaccgaatctccctctcccgcgaccgcgacctctccaccgcccacatggacatccgcggcctcacccaagacgacaccgccacatacttctgcgcccgccaaaaattcgcctcccgctactccggcgaccaaggctcctacttcgacctctggggccgcggcacactcatcatcgtctcctcc

SEQ ID NO: 56956 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacacaaccgaactcatctactgggtccgccaagcccccggccaaggcctcgaatggatcggctgggtcaaaatcgtctccggcaccgtcaacttcgcctccctagacttccgaaaccgcatctccctctcccgcgaccgcgacctctccaccgcctacatggacatccgcggcctcacccaagacgacaccgccacctacttctgcgcccgccaaaaattcgcctcccgctactccggcgaccaaggctcctacttcgacctctggggccgcggcaccctaatcatcgtctcctcc

SEQ ID NO: 56957 - RNA, 384 nt, synthetic construct
  misc_feature 1..384: note = derived and/or modified sequence opt11 from anti-HIV-1_HeavyChain
  source 1..384: mol_type = other RNA
caagcgcgcttggaacagagcgggagcggggtcaagaaattgggcgcgagcgtgcgcgtgagctgttggacgagcgaggacatattcgagcgcacggaattgatccattgggtgcgacaggccccgggccagggcttggaatggatcgggtgggtgaaagcggtctcgggcgcggtcaattacgggagcttggactttcgcaatcgcatcagcttgagcagggacagggacttgagcacagcctatatggatataaggggcttgacacaggacgataccgcgacctatttctgtgccaggcaaaagttcgcgagcaggtactcgggcgatcaagggagctatttcgatctctggggcaggggcacgctcatagtagtgagctcg

SEQ ID NO: 56958 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcggccatgaaaaagcccggggcctcggtcagggtctcgtgctggacctcagaagatatctttgacacgaccgagctcatatactgggtcaggcaagcgcccgggcaagggctcgagtggataggctgggtcaagatcgtgagcgggaccgtgaactttgcctcgctcgacttcaggaacaggatctcgctctcgagagaccgcgatctctcgaccgcgcacatggacatacgagggctaacgcaagatgacacggccacgtacttttgcgcgcgccagaaatttgcctcgcgctatagcggggaccagggctcgtactttgacctgtgggggcgcgggaccttgatcatagtctcgagc

SEQ ID NO: 56959 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggtcgagcgaggacatattcgagcgcacggaattgatacattgggtgcgccaggccccgggccagggcttggaatggatcgggtgggtgaaaacggtcacgggcgcggtcaatttcgggagcttggactttcgccatcgcatcagcttgaccagggacagggacctgagcacggcctatatggatataaggggattgacccaggacgataccgcgacctatttctgtgccaggcaaaagttcgcgagcaggtactcgggcgatcaagggagctatttcgatctctggggcaggggcacgctaatagtcgtgagctcg

SEQ ID NO: 56960 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggccgcgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 56961 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggacctcggaagatatctttgaaaggagcgagctcatacactgggtcaggcaagcgcccgggcaagggctagagtggataggctgggtcaagaccgtgaccggggccgtgaactttggctcgctcgatttcaggcacaggatctcgctcacgcgagatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 56962 - RNA, 381 nt, synthetic construct
  misc_feature 1..381: note = derived and/or modified sequence opt11 from anti-HIV-1_HeavyChain
  source 1..381: mol_type = other RNA
aggtgtatatggaggcaggcgggggggggggtgaagaagccgggggcgagcgtgacgttgagttgtaagacggcggatgaggatgtgtttgatgcggcgtatatgcattgggtgaggcaggcgccggggcagacgtttgagtggttggggtggatgaagccggtgacgggggcggtgagttatgcgaggaagtttcaggggagggtgagtttttatatgacgagggggataaggatggcgtatatggatttgaggaatttgaggtttgatgatacggcggtgtatttttgtgcgaggaagacggcgggggacgtgagtggggataatagggggtatttttttgatttgtgggggagggggagtagggtgatagtgagtagt

SEQ ID NO: 56963 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgaacgcaccgaactcatctactgggtccgccaagcccccggccgcggcctcgaatggatcggctgggtcaaaatcgtcagcggcaccgtcaacttcgcctccctcgacttccgaaaccgaatctcactctcccgcgaccgcgacctctccaccgcctacatggacatccgcggcctcacccaagacgacaccgccacctacttctgcgcccgccaaaaattcgcctcccgctactcaggcgaccaaggctcctacttcgacctctggggacgcggcaccctcatcgtcgtctcctcc

SEQ ID NO: 56964 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcaggctcggccatgaaaaagcccggggcctcggtcagggtctcgtgctggacctcagaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctaacgcaaggggacacggccacgtacttttgcgcgcgacagaaatttgaatcgcgctataccgggggccagggctggtactttgacttgtgggggcgcgggacccatatcgtggtctcaagc

SEQ ID NO: 56965 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggacaaggcctcgaatggatcggctgggtcaaaatcgtctccggcaccgtcaacttcgcctccctcgacttccgcaaccgcatatccctctcccgagaccgcgacctctccgccgcccacatggacatccgcggcctcacccaagacgacaccgccacctacttctgcgcccgccaaaaattcgcctcccgctactccggcgaccaaggctcctacttcgacctatggggccgcggcaccctcatcatcgtctcctcc

SEQ ID NO: 56966 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggacgagcgaggacatattcgagcgcacggaattgatccattgggtgcgccaggccccgggccagggcctggaatggatcgggtgggtgaaaatagtctcgggcgcggtcaatttcgggagcccgaactttcgccagcgcgtgagcttgaccagggacagggacttgttcacggcccatatggatatcaggggcttgacccagggcgataccgcgacctatttctgtgccaggcaaaagttcgcgagcaggtactcgggcgatcaagggagctatttcgatctctggggcaggggcacgctcatagtcgtgagctcg

SEQ ID NO: 56967 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggtcgagcgaggacatattcgagcgcacagaattgatccattgggtgcgccaggccccgggccagggcctggaatggatcgggtgggtgaaaacggtcacgggcgcggtcaatttcgggagcttggactttcgccatcgcatcagcttgaccagggacagggacctgttcacggcccatatggatataaggggcttgacccagggcgataccgcgacctatttctgtaccaggcaaaagttcgagagcaggtacacgggcgggcaaggatggtatttcgatctctggggcaggggcacgcacatagtcgtgagctcg

SEQ ID NO: 56968 - RNA, 384 nt, synthetic construct
  misc_feature 1..384: note = derived and/or modified sequence opt11 from anti-HIV-1_HeavyChain
  source 1..384: mol_type = other RNA
caagcgcacctggaacagagcgggagcggagtcaagaaaccgggcgcgagcgtgcgcgtgagctgttggtcgagcgaggacatattcgagcgcacggaattgatccattgggtgcgccaggccccgggccagggcccggaatggatcgggtgggtgaaaacggtcacgggcgcggtcaatttcgggagcttggactttcgccatcgcatcagcttgacaagggacagggacttgttcacggcccatatggatataagaggcctgacccagggcgataccgcgacctatttctgtgccaggcaaaagttcgagagcaggtacacgggagggcaagggtggtatttcgatctatggggcaggggcacgcacatagtcgtgagctcg

SEQ ID NO: 56969 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggtcgagcgaggacatattcgagcgcacggaattgatccattgggtgcgccaggcaccgggccagggcctggaatggatcgggtgggtgaaaacagtcacgggcgcggtcaatttcgggccattggactttcgacatcgcatcagcttgaccagggacagggacttgttcacggcccatatggatataaggggactgacccagggagataccgcgacctatttctgtgccaggcaaaagttcgagagcaggtacacgggagggcaagggtggtatttcgatctctggggaaggggaacgcacatagtcgtgagctcg

SEQ ID NO: 56970 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatcaggccccgccatgaaaaaacccggcgcctccgtccgcgtcagctgctggacctccgaagacatcttcgaacgcaccgaactcatctactgggtccgccaagcccccggccgcggcctcgaatggatcggctgggtcaaaacagtctccggcacagtcaacttcggctcctccgacttccgaaaccgcatctccctaacccgcgaccgcgacctctccaccgcccacatggacatccgcggcctcacccaagacgacaccgccacctacttctgcgcccgccaaaaattcgaatcactctactccgacgaccaaggctcctacttcgacctctggggccgcggcaccctcatcatcgtctcctcc

SEQ ID NO: 56971 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgacacgaccgagctcatatactgggtcagacaagcgcccgggcaagggctcgagtggataggctgggtcaagatcgtgagcgggaccgtgaactttgcctcgctcgatttcaggaacaggatctcgctctcgcgagatcgcgggctctcgaccgcgcacatggacatacgcgggctcacgcaagatgacacggccacgtacttttgcgcgcgccagaaatttgcctcgcgctatagcggggaccagggctcatactttgacctgtgggggcgcgggaccctgatcatagtctcaagc

SEQ ID NO: 56972 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaactgatccattgggtgcgccaggccccgggccagggcttggaatggatcgggtgggtgaaaacggtctcgggcgcggtcaatttcgggagcccgaactttcgccatcgagtgagcttgaccagggacagggacctgttcacggcccatatggatatcaggggcttgacccagggcgataccgcgacctatttctgtgccaggcaaaagttcgcgagcaggtactcgggcgatcaagggagctatttcgatctctggggcaggggcacgctaataatcgtgagctcg

SEQ ID NO: 56973 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacactccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcatccctcgacttccgcaaccgcatctcactctcccgcgaccgagacctctccaccgcctacatggacatccgcggcctcacccaagacgacaccgccacctacttctgcgcccgccaaaaattcgcctcccgctactccggcgaccaaggctcctacttcgacctctggggccgcggcaccctcatcgtcgtctcctcc

SEQ ID NO: 56974 - RNA, 384 nt, synthetic construct
  misc_feature 1..384: note = derived and/or modified sequence opt11 from anti-HIV-1_HeavyChain
  source 1..384: mol_type = other RNA
caagcgcacctggaacagagcgggagcggggtcaagaaaccgggcgcgagcgtgcgcgtgagctgttggacgagcgaggacatattcgagcgcacggaattgatccattgggtacgccaggccccgggccagggcctggaatggatcgggtgggtgaaaatagtctcgggcgcggtcaatttcgggagcccgaactttcgccagcgcgtgagcttgaccagggacagagacctgttcacggcccatatggatatcaggggcttgacccagggcgataccgcgacctatttctgtgccagacaaaagttcgagagcctgtactcggacgatcaagggagctatttcgatctctggggcaggggcacgctcataatcgtgagctcg

SEQ ID NO: 56975 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtccgcgtctcatgctggacctccgaagacatcttcgaacgcaccgaactcatccactgggtccgccaagcccccggacaaggcctcgaatggatcggctgggtcaaaaccgtctccggcgccgtcaacttcggctcccccaacttccgccaccgcatctccctcacccgcgaccgcgacctcttcaccgcccacatggacatccgcggcctaacccaaggcgacacagccacctacttctgcgcccgccaaaaattcgaatcccgatacacaggcggccaaggctggtacttcgacctctggggccgcggcacccacatcgtcgtctcctcc

SEQ ID NO: 56976 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgcgagcggggtcaggcgaccgggcgcgagcgtgcgcgtgagctgttggacgagcgaggacatattcgagcgctcagaattgatctattgggtgcgccaggccccgggcaggggcttggaatggatcgggtggataaaattggtctcgggagcggtcaatttcgggagcgtggactttcgcaatcgcatcagcttgagcagggacagggacctgagcacggcccatatggatataaggggcttgcgccaggacgataccgcgacctatttctgtgccaggcaaaagttcgagagcaggtactcgggcgatcaagggagctatttcgatctctggggcaggggcacgctcataatagtgagctcg

SEQ ID NO: 56977 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgcgagcggggtcaagcgaccgggcgcgagcgtgcgcgtgagctgttggacgagcgaggacatattcgagcgcacggaattgatctattgggtgcgccaggccccgggccagggcttggaatggatcgggtgggtgaaaacggtctcgggcgcggtcaatttcgggagccaggactttcgcgatcgctttagcttgaccagagacagggacttgagcacggcccatatggatatcaggggcttgacccaggacgataccgcgacctatttctgtgccaggcaaaagttcgcgagcaggtactcgggcgatcaagggagctatttcgatctctggggcaggggcacgctcataatcgtgagctca

SEQ ID NO: 56978 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagaaatcggaactgatccattgggtgcgccaggccccgggccagggcttggaatggatcgggtgggtgaaaacggtcacgggcgcggtcaatttcgggagcttggactttcgccatcgcataagcctgaccagagacagggacctgttcacggcccatatggatatcaggggcttgacccagggcgataccgcgacctatttctgtgccaggcaaaagttcgagagcaggtacacgggcgggcaagggtggtatttcgatctctggggcagaggcacgcacatagtcgtgagctcg

SEQ ID NO: 56979 - RNA, 384 nt, synthetic construct
  misc_feature 1..384: note = derived and/or modified sequence opt11 from anti-HIV-1_HeavyChain
  source 1..384: mol_type = other RNA
caagcccacctagaacaatccggctccggcgtcaaaaaacccggcgcctccgtccgcgtctcctgctggacctccgaagacatcttcgaacgcaccgaactcatccactgggtccgccaagcccccggccaaggcctcgaatggatcggctgggtcaaaaccgtctccggcgccgtcaacttcggctcccccaacttccgccaccgcgtctccctaacccgcgaccgcgacctcttcaccgcccacatggacatccgcggcctcacccaagacgacaccgccacctacttctgcgcccgccaaaaattcgaatccctctactccgacgaccaaggctcctacttcgacctctggggccgcggcacactcatcatcgtctcctcc

SEQ ID NO: 56980 - RNA, 384 nt, synthetic construct
  misc_feature 1..384: note = derived and/or modified sequence opt11 from anti-HIV-1_HeavyChain
  source 1..384: mol_type = other RNA
caatcccacctcaaacaatccggctccgccatgaaaaaacccggcgcctccgtccgcgtctcatgctggacctccgaagacatcttcgaacgcaccgaactcatctactgggtccgccaagcccccggccgcggcctcgaatggatcggctgggtcaaaaccgtctccggcaccgtcaacttcggctcctccgacttccgcaaccgcatctccctcacccgcgaccgcgacctctccaccgcccacatggacatccgcggcctcacccaagacgacaccgccacctacttctgcgcccgccaaaaattcgaatccctctactccgacgaccaaggctcctacttcgacctctggggccgcggcaccctcatcatcgtctcctcc

SEQ ID NO: 56981 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggatcgggcgtgaaaaagccaggagcctcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcactcacgcgcgatcgcgatctctcgaccgcgcacatggacatacgcgggctcacgcaagatgacacggccacgtacttttgcgcgcgccagaaatttgcctcgcgctatagcggggaccagggctcgtactttgacttgtgggggcgcgggaccttgatcatagtctcgagc

SEQ ID NO: 56982 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaattgggagcgagcgtgcgcgtgagctgttggacgagcgaggacatattcgagcgcacggaattgatccattgggtgcgacaggcaccgggccagggcctggaatggatcgggtgggtgaaagcggtctcgggcgcggtcaattacggaagcctggactttcgccatcgcgtgagcttgaccagggacagggacttgttcacggcccatatggatatcaggggcttgacccaggacgataccgcgacctatttctgtgccaggcaaaagttcgagagcaggtacacgggagggcaagggtggtatttcgatctctggggcaggggaacgcacatagtcgtgagctcg

SEQ ID NO: 56983 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtccgcgtctcctgctggacctccgaagacatcttcgaacgcaccgaactaatccactgggtccgccaagcccccggacaaggcctcgaatggatcggctgggtcaaaaccgtaaccggcgccgtcaacttcggctcccccaacttccgccaccgcgtctcactcacccgcgaccgcgacctcttcaccgcccacatggacatccgcggcctcacccaagacgacaccgccacatacttctgcgcccgccaaaaattcgaatcactctactcagacgaccaaggctcctacttcgacctctggggccgcggcaccctaatcatcgtctcctcc

SEQ ID NO: 56984 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtatcgtgctggacctcggaagatatcctggaaaggaccgagctcatatactgggtcaggcaagcgcccgggcgcgggctcgagtggataggctgggtcaagaccgtgagcgggaccgtgaactttggctcgagcgatttcaggaacaggatctcgctaacgcgcgatcgcgatctctcaaccgcgcacatggacatacgcgggctaacgcaagatgacacggccacgtacttttgcgcgcgccagaaatttgaatcgctctatagcgatgaccagggctcgtactttgacttgtgggggcgcgggaccttgatcatagtctcgagc

SEQ ID NO: 56985 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtccgcgtctcatgctggacctccgaagacatcttcgaacgcaccgaactcatccactgggtccgccaagcccccggccaaggcctcgaatggatcggctgggtcaaaaccgtcaccggcgccgtcaacttcggctcccccaacttccgccaacgcgtctccctcacccgcgaccgcgacctattcaccgcccacatggacatccgcggcctcacccaaggcgacaccgccacctacttctgcgcccgccaaaaattcgcctcccgctactccggcgaccaaggatcctacttcgacctctggggccgcggcaccctcatcgtcgtctcctcc

SEQ ID NO: 56986 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccaggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgacatcgcatcagcttgaccagggacagggacttgttcacggcccatatggatataaggggcctgacccagggcgataccgcgacctatttctgtgccaggcaaaagttcgagagcaggtacacgggcgggcaagggtggtatttcgatctctggggcagaggcacgcacatagtcgtgagctcg

SEQ ID NO: 56987 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgatgacatattcgagcgcacggaactgatccattgggtgcgccaggccccgggccagggcttggaatggatcgggtgggtgaaaacggtcacgggcgcggtcaatttcgggagcccgaactttcgccagcgcgtgagcttgaccagggacagggacctgttcacggcccatatggatatcaggggcctgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 56988 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatattcgacaccaccgaactcatctactgggtccgccaagcccccggccaaggcctcgaatggatcggctgggtcaaaatcgtctccggcaccgtcaacttcgcctccctcgacttccgcaaccgcatctccctctcccgcgaccgcgacctctccaccgcccacatggacatccgcggcctcacccaagacgacaccgccacctacttctgcgcccgacaaaaattcgcctcccgctactccggcgaccaaggctcctacttcgacctctggggccgcggcaccctcatcgtcgtctcctcc

SEQ ID NO: 56989 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgaacggaattgatccattgggtgcgccaggccccgggccagggcctggaatggatcgggtgggtgaaaacggtcacgggcgcggtcaatttcgggagcccaaactttcgcaatcgcatcagcttgagcagggacagggacttgagcacggcccatatggatataaggggattgacccaggacgataccgcgacctatttctgtgcaaggcaaaagttcgcgagcaggtactcgggcgatcaagggagctatttcgatctctggggcaggggcacgctcataatcgtgagctcg

SEQ ID NO: 56990 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcggcctcgggcgtgaaaaggcccggggcctcggtcagggtctcgtgctggacctcggaagatatctttgaaaggaccgagctcatatactgggtcaggcaagcgcccgggcaagggctcgagtggataggctgggtcaagaccgtgaccggggccgtaaactttggctcgctcgatttcaggcacaggatctcgctcacgcgagatcgcgatctctttaccgcgcacatggacatacgcgggctaacgcaaggggacacggccacgtacttttgcgcacgccagaaatttgaatcgcgctataccgggggccagggctggtactttgacttgtgggggcgcgggacccatatcgtggtctcgagc

SEQ ID NO: 56991 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcggcctcgggcgtgcgcaggcccggggcctcggtcagggtctcgtgctggacctcggaagatatctttgaaaggagcgagctcatatactgggtaaggcaagcgcccgggcgcgggctcgagtggataggctggatcaagctcgtgagcggggccgtgaactttggctcggtcgatttcagggacagggtctcgctcacgcgcgatcgcgatctatttaccgcgcacatggacatacgcgggctcacgcaagatgacacggccacgtacttttgcgcgcgccagaaatttgcctcgcgctatagcggggaccagggctcgtactttgacttgtgggggcgcgggaccttgatcatagtctcgagc

SEQ ID NO: 56992 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggagcgagcgtgcgcgtgagctgttggacgagcgaggacatattcgagcgcacggaattgatccattgggtgcgacaggccccgggccagggcttggaatggatcgggtgggtgaaaacggtctcgggcacggtcaatttcgcgagcttggactttcgcaatcgcatcagcttgagcagggacagagacttgagcacggcctatatggatataaggggcctgacccaggacgataccgcgacctatttctgtgccaggcaaaagttcgcgagcaggtactcgggcgatcaagggagctatttcgatctctggggcaggggcacgctaatagtcgtgagctcg

SEQ ID NO: 56993 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcacccggacaagggctcgagtggataggctgggtcaagaccgtgagcggggccgtgaactttggctcgcccaatttcaggcacaggatctcgctctcgcgcgatcgcgatctctcgaccgcgtacatggacatacgagggctcacgcaagatgacacggccacgtacttttgcgcgcgccagaaatttgcctcgcgctatagcggggaccagggctcgtactttgacttgtgggggcgcgggaccttgatcgtggtctcgagc

SEQ ID NO: 56994 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtacgcgtgagctgttggtcgagcgaggacatattcgagcgcacggaattgatccattgggtgcgccaggccccgggccagggcctggaatggatcgggtgggtgaaaacggtcacgggcgcggtcaatttcgggagcttggactttcgccatcgcataagcccgaccagggacagggacctgttcacggcacatatggatatcaggggcttgacccagggcgataccgcgacctatttctgtgcaaggcaaaagttcgagagcaggtacacgggcgggcaagggtggtatttcgatctctggggcaggggcacgctcatagtcgtgagctcg

SEQ ID NO: 56995 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctagagtggataggctgggtcaagatcgtgagcgggaccgtgaactttgcctcgctcgatttcaggaacaggatctcgctctcgcgcgatcgcgatctcccgaccgcgtacatggacatacgcgggctcacgcaagatgacacggccacgtacttttgcgcgcgccagaaatttgcctcgcgctatagcggggaccagggctcgtactttgacctgtgggggcgcgggaccttgatcgtggtctcgagc

SEQ ID NO: 56996 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgccagcggcaccgtcaacttcgcctccctcgacttccgcaaccgaatctccctctcccgcgaccgcgacctctccacagcccacatggacatccgcggcctcacccaagacgacaccgccacctacttctgcgcccgccaaaaattcgcctcccgctactccggcgaccaaggctcctacttcgacctctggggccgcggcaccctcatcgtcgtctcatcc

SEQ ID NO: 56997 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaaccgtcaccggcgccgtcaacttcggctccctcgacttccgccaccgaatctccctcacccgcgaccgagacctcttcaccgcacacatggacatccgcggcctcacccaaggcgacaccgccacctacttctgcgcccgccaaaaattcgaatcccgctacaccggcggccaaggctggtacttcgacctctggggccgcggcacccacatcgtcgtctcctcc

SEQ ID NO: 56998 - RNA, 384 nt, synthetic construct
  misc_feature 1..384: note = derived and/or modified sequence opt11 from anti-HIV-1_HeavyChain
  source 1..384: mol_type = other RNA
caagtccaactcgtccaatccggcgccgaagtcaaaaaacccggcgcctcagtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctccctagacttccgcaaccgcatctccctctcccgcgaccgcgacctctccaccgcccacatggacatccgcggcctccgccaagacgacaccgccacctacttctgcgcccgacaaaaattcgaatcccgctactccggcgaccaaggctcctacttcgacctctggggccgcggcaccctcatcatcgtctcctcc

SEQ ID NO: 56999 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcagccatgaaaaagcccggggcctcggtcagggtctcgtgctggacatcggaagatatcttcgacacgaccgagctcatatactgggtcaggcaagcgcccggacaagggctcgagtggataggctgggtcaagatcgtgagcggaaccgtgaactttgcctcgctcgatttcaggcacaggatctcgctaacgcgcgaccgcgacctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57000 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgcgagcggggtcaaacgaccgggagcgagcgtacgcgtgagctgttggacgagcgaggacatattcgagcgctcggaattgatctattgggtgcgccaggccccgggccagggcttggaatggatcgggtgggtgaaaacggtcacgggcgcggtcaatttcgggagcttggactttcgccatcgaatcagcttgaccagggacagggacttgttcacggcccatatggatataaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 57001 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggccagggcctggaatggatcgggtgggtgaaaacggtcacgggcgcggtcaatttcgggagctcggactttcgccagcgcgtgagcctgaccagggacagggacttgttcacggcccatatggatatcaggggcctgacccagggcgatacagcgacctatttctgtgccaggcaaaagttcgagagcttgtactcagacgatcaagggagctatttcgatctctggggcaggggcacgctcataatcgtgagctcg

SEQ ID NO: 57002 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctcagccatgaaaaaacccggcgcctccgtccgcgtatcctgctggacctcagaagacatcttcgaacgcaccgaactcatctactgggtacgccaagcccccggccgaggcctcgaatggatcggctgggtcaaaaccgtctccggcaccgtcaacttcggctcctccgacttccgcaaccgcatctccctcacccgcgaccgcgacctatccaccgcccacatggacatccgcggactcacccaagacgacaccgccacctacttctgcgcccgccaaaaattcgaatccctctactcagacgaccaaggctcctacttcgacctctggggccgcggcaccctaatcgtcgtctcctcc

SEQ ID NO: 57003 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaattgggcgcgagcgtgcgcgtgagctgttggacgagcgaggacatattcgagcgaacggaattgatccattgggtgcgccaggccccgggccagggcttggaatggatcgggtgggtgaaagcggtctcgggcgcggtcaattacgggagcttggactttcgccatcgagtgagcttgacaagggacagggacttgttcacggcccatatggatatcaggggcttgacccagggcgataccgcgacctatttctgtgccaggcaaaagttcgagagcaggtacacgggcgggcaagggtggtatttcgatctctggggcagaggcacgcacatagtcgtgagctca

SEQ ID NO: 57004 - RNA, 381 nt, synthetic construct
  misc_feature 1..381: note = derived and/or modified sequence opt11 from anti-HIV-1_HeavyChain
  source 1..381: mol_type = other RNA
caagcgcacttggaacagagcgggagcggggtcaagaaaccgggcgcgagcgtgcgcgtgagctgttggacgagcgaggacatactcaggaaatcggaattgatccattgggtgcgccaggccccgggccagggcttggaatggatcgggtgggtgaaaacggtcacgggcgcggtcaatttcgggcaccagatctcggacagggtctcgctcacgcgcgatcgcgatctctcgacagcgcacatggacatacgcgggctcacgcaagatgacacggccacatacttttgcgcgcgccagaaatttgaatcgctctatagcgatgaccagggctcgtactttgacttgtgggggcgcgggaccttgatcatagtctcgagc

SEQ ID NO: 57005 - RNA, 384 nt, synthetic construct
  misc_feature 1..384: note = derived and/or modified sequence opt11 from anti-HIV-1_HeavyChain
  source 1..384: mol_type = other RNA
ccggcccatctcgagcaatcgggctcgggcgtgaaaaagcccggggcctcggtcagggtctcgtgctgggcctcggaagatatcttcgaaaggaccgagctcatacactgggtcaggcaagcgcccgggcaagggctagagtggataggctgggtcaagaccgtgaccggggccgtgaactttggctcgctcgatttcaggcacaggatctcgctcacgcgcgatcgcgatctatttaccgcgcacatggacatacgagggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57006 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgcgagcggggtcaagcgcccgggcgcgagcgtgcgcgtgagctgttggacgagcgaggacatattcgagcgctcggaattgatctattgggtgcgccaggccccgggccagggcttggaatggatcgggtgggtgaaaacggtctcgggcgcggtcaatttcgggagcacggactttcgcgagcgcatcagcttgagcagggacagggacttgagcacggcctatatggatataaggggcttgacccaggacgatgccgcgacctatttctgtgccaggcaaaagttcgcgagcaggtactcgggcgatcaagggagctatttcgatctctggggcaggggcacgctcatagtcgtgagctcg

SEQ ID NO: 57007 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcatgctggagctcggaagatatctttgaaaggaccgagctcatacactgggtcaggcaagcgcccgggcaagggctcgagtggataggctgggtcaagaccgtgaccggggccgtgaactttggctcgctcgatctcaggcacaggatctcgctcacgcgcgatcgcgatctctttacagcgcacatggacatacgcgggctaacgcaaggggacacggccacgtacttttgcgcgcgccagaaatttgaatcgcgctataccgggggccagggctggtactttgacctgtgggggcgcgggacccatatcgtggtctcgagc

SEQ ID NO: 57008 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatcaggctccggcgtcaaaaaacccggcgcctccgtccgcgtctcctgctggacctccgaagacatcttcgaacgcaccgaactcatccactgggtccgccaagcccccggccaaggcctcgaatggatcggctgggtcaaaaccgtcaccggcgccgtcaacttcggctcactcgacttccgacaccgcatctccctcacccgagaccgcgacctcttcaccgcccacatggacatcagaggcctcacccaaggcgacaccgccacctacttctgcgcccgccaaaaattcgaatcccgctacaccggaggccaaggctggtacttcgacctctggggccgcggcaccctcatcgtcgtctcctca

SEQ ID NO: 57009 - RNA, 384 nt, synthetic construct
  misc_feature 1..384: note = derived and/or modified sequence opt11 from anti-HIV-1_HeavyChain
  source 1..384: mol_type = other RNA
tcccacgacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctcaggcaccgtcaacttcgcctccctcgacttccgcaaccgaatctccctctcccgcgaccgcgacctctccaccgcctacatggacatacgcggcctcacccaagacgacaccgccacctacttctgcgcccgccaaaaattcgcctcccgctactccggcgaccaaggctcctacttcgacctctggggccgcggcaccctcatcgtcgtctcctcc

SEQ ID NO: 57010 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctagagtggataggctgggtcaaggccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtacttcgacttgtgggggcgcgggacccatatcgtggtctcgagc

SEQ ID NO: 57011 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcaggggcctgacccagggagataccgcgacctatttctgtgccaggcaaaagttcgcgagcaggtactcgggcgatcaagggagctatttcgatctctggggcaggggcacgctcatagtcgtgagctcg

SEQ ID NO: 57012 - RNA, 384 nt, synthetic construct
  misc_feature 1..384: note = derived and/or modified sequence opt11 from anti-HIV-1_HeavyChain
  source 1..384: mol_type = other RNA
caatcgcacttggaacagagcgggagcgcgatgaagaaaccgggcgcgagcgtacgcgtgagctgttggacgagcgaggacatattcgataccacggaattgatctactgggtgcgccaggccccgggccagggcttggaatggatcgggtgggtgaaaatagtctcgggcacggtcaatttcgcgagctcggactttcgcaatcgcatcagcttgagcagggacagggacttgagcacggcacatatggggataaggggcttgcgccaggacgataccgcgacctatttctgtgccaggcaaaagttcgagagcaggtactcgggcgatcaagggagctatttcgatctctggggcaggggcacgctcataatcgtgagctca

SEQ ID NO: 57013 - RNA, 384 nt, synthetic construct
  misc_feature 1..384: note = derived and/or modified sequence opt11 from anti-HIV-1_HeavyChain
  source 1..384: mol_type = other RNA
gaggtccagctcgtgcaatcgggcgcggacgtgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcgctctcgcgagatcgcgatctctcgaccgcgtacatggacatacgagggctcacgcaagatgacacggcaacgtacttttgcgcgcgccagaaatttgcctcgcgctatagcggggaccagggctcgtactttgacttgtgggggcgcgggaccctgatcgtggtctcgagc

SEQ ID NO: 57014 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtccgcgtctcctgctggtcctcagaagacatcttcgaacgcaccgaactcatccactgggtacaccaagcccccggccaaggcctcgaatggatcggctgggtcaaaaccgtcaccggcgccgtcaacttcggctccctcgacttcagacaccgcatatccctcacccgcgaccgcgacctcttcaccgcccacatggacatccgcggcctcacccaaggcgacaccgccacctacttctgcgcacgacaaaaattcgaatcccgctacaccggcggccaaggctggtacttcgacctctggggccgcggcacccacatcgtcgtctcctcc

SEQ ID NO: 57015 - RNA, 384 nt, synthetic construct
  misc_feature 1..384: note = derived and/or modified sequence opt11 from anti-HIV-1_HeavyChain
  source 1..384: mol_type = other RNA
caatcccacctagaacaatccggctccgccatgaaaaaacccggcgcctccgtccgcgtctcctgctggacctccgaagacatattcgacaccaccgaactaatctactgggtccgccaagcccccggccaaggcctcgaatggatcggctgggtcaaaatagtctccggcaccgtcaacttcgcctccctcgacttccgcaaccgcatctcactctcacgcgaccgcgccctctccaccgcccacatggacatccgcggcctcacccaagacgacaccgccacctacttctgcgcccgccaaaaattcgcctcccgctactccggcgaccaaggctcctacttcgacctctggggccgcggcaccctcatcatcgtctcctcc

SEQ ID NO: 57016 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagtgggagcggggtcaagaaaccgggcgcgagcgtgcgcgtgagctgttggtcgagcgaggacatattcgagcgcacggaattgatccattgggtgcgccaggccccaggccagggcttggaatggatcgggtgggtgaaaacggtcacgggcgcggtcaatttcgcgagcttggactttcgcaatcgcatcagcttgagcagggacagggacttgagcacggcctatatggatataaggggcttgacccaggacgataccgcgacatacttctgtgccaggcaaaagttcgcgagcaggtactcgggcgatcaagggagctatttcgatctctggggcaggggcacgctcatagtcgtgagctcg

SEQ ID NO: 57017 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgcgagcggggtcaggcgcccgggcgcgagcgtgcgcgtgagctgttggacgagcgaggacatattcgagcgctcggaactgatctattgggtgcgccaggccccgggcaggggcttggaatggatcgggtggataaaattggtctcgggcgcggtcaatttcgcgagcttggactttcgcaatcgcatcagcttgagcagggacagggacctgagcacggcctatatggatataaggggcttgacccaggacgataccgcgacctatttctgtgccaggcaaaagttcgcgagcaggtactcgggcgatcaagggagctatttcgatctctggggcaggggcacgctcatagtcgtgagctcg

SEQ ID NO: 57018 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggagctcggaagatatctttgaaaggacagagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacataagagggctcacgcaagatgacacggccacgtacttttgcgcgcgccagaaatttgcctcgcgctatagcggggaccagggctcgtactttgacttgtgggggcgcgggaccttgatcatagtctcgagc

SEQ ID NO: 57019 - RNA, 384 nt, synthetic construct
  misc_feature 1..384: note = derived and/or modified sequence opt11 from anti-HIV-1_HeavyChain
  source 1..384: mol_type = other RNA
caatcgcacttggaacagagcgggagcgcgatgaagaaaccgggcgcgagcgtgcgagtgagctgttggacgagcgaggacatattcgataccacggaattgatctattgggtgcgccaggccccgggccagggcttaggctggatcgggtgggtgaaaatagtctcgggcacggtcaatttcgcgagcttggactttcgctcgcgcatcagcttgagcagggacagggacttgagcacggcctatatggatataaggggcctgacccaggacgataccgcgacctatttctgtgccaggcaaaagttcgcgagcaggtactcgggagatcaagggagctatttcgatctctggggcaggggcacgctcatagtcgtgagctca

SEQ ID NO: 57020 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggagcgagcgtgcgcgtgagctgttggacgagcgaggacatattcgagagaacggaattgatccattgggtgcgccaggccccgggccagggcttggaatggatcgggtgggcgaaaacggtcacgggcgcggtcaatttcgggagcttggactttcgccatcgcatcagcttgaccagggacagggacttgttcacggcccatatggatataaggggcttgacacagggcgatacagcgacctatttctgtgccaggcaaaagttcgagagcaggtacacgggagggcaagggtggtatttcgatctctggggcaggggaacgcacatagtcgtgagctcg

SEQ ID NO: 57021 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcggccatgaaaaagcccggggcctcggtcagggtctcgtgctggacctcggaagatatctttgaaaggaccgagctcatatactgggtcaggcaagcgccagggcgcgggctcgagtggataggctgggtcaagaccgtgagcgggaccgtgaactttggctcgagcgatttcaggaacaggatctcgctcacgcgcgatcgcgatctctcgaccgcgcacatggacatacgcgggctcacgcaagatgacacggccacgtacttttgcgcgcgccagaaatttgaatcgctctatagcgatgaccagggctcgtactttgacctgtgggggcgcgggaccctgatcatagtctcgagc

SEQ ID NO: 57022 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatcaggctccgccatgaaaaaacccggcgcctccgtccgcgtctcctgctggacctcagaagacatcttcgacaccaccgaactcatctactgggtcagacaagcccccggccaaggcctcgaatggatcggctgggtcaaaatcgtctccggcaccgtcaacttcggctccctcgacttccgccaccgcatctccctcacccgcgaccgcgacctcttcaccgcccacatggacatccgcggcctcacccaaggcgacaccgccacctacttctgcgcccgccaaaaattcgaatcccgctacaccggcggccaaggctggtacttcgacctctggggccgcggcacccacatcgtcgtctcctcc

SEQ ID NO: 57023 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaactcggcgcctccgtccgcgtctcctgctggacctccgaagacatcttcgacaccaccgaactcatctactgggtccgacaagcccccggccaaggcctcgaatggatcggctgggtcaaaatcgtctccggcaccgtcaacttcgcctccctcgacttccgcaaccgcatctccctctcccgagaccgcgacctctccaccgcctacatggacatccgcggcctcacccaagacgacaccgccacctacttctgcgcccgccaaaaattcgcctcccgctactcaggcgaccaaggctcctacttcgacctatggggccgaggcaccctcatcgtcgtctcctcc

SEQ ID NO: 57024 - RNA, 384 nt, synthetic construct
  misc_feature 1..384: note = derived and/or modified sequence opt11 from anti-HIV-1_HeavyChain
  source 1..384: mol_type = other RNA
tcccacaacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctcactcgacttccgcaaccgcatctccctctcccgcgaccgcgacctctccaccgcctacatggacatccgcggcctcacccaagacgacacagccacctacttctgcgcccgccaaaaattcgcctcacgctactccggcgaccaaggctcatacttcgacctctggggccgcggcaccctcatcgtcgtctcctca

SEQ ID NO: 57025 - RNA, 384 nt, synthetic construct
  misc_feature 1..384: note = derived and/or modified sequence opt11 from anti-HIV-1_HeavyChain
  source 1..384: mol_type = other RNA
agccatacctggaacaatcgagggagcgcgatgaagaaaccgggcgcgagcgtgcgcgtgagctgttggacgagcgaggacatattcgagcgaacggaactgatctattgggtgcgccaggccccgggcaggggcttggaatggatcgggtgggtgaaaacggtctcgggcacggtcaatttcgggagctcggactttcgcaatcgcatcagcttgagcagggacagggacttgagcacggcccatatggatataaggggcttgacccaggacgatacagcgacctatttctgtgccaggcaaaagttcgcgagcaggtactcgggcgatcaagggagctatttcgatctctggggcaggggcacgctcataatcgtgagctcg

SEQ ID NO: 57026 - RNA, 384 nt, synthetic construct
  misc_feature 1..384: note = derived and/or modified sequence opt11 from anti-HIV-1_HeavyChain
  source 1..384: mol_type = other RNA
agccatacctggaacgagagcgggagcgcgatgaagaaaccgggcgcgagcgtgcgcgtgagctgttggacgagcgaggacatattcgagcgcacggaattgatctattgggtgcgacaggccccgggcaggggcttggaatggatcgggtgggtgaaaatagtctcgggcacggtcaatttcgcgagcttggactttcgcaatcgcataagcctgagcagggacagggacttgagcacggcctatatggatatcaggggcctgacccaggacgataccgcgacatatttctgtgccaggcaaaagttcgcgagcaggtactcgggagatcaagggagctatttcgatctctggggcaggggcacgctcatagtcgtgagctcg

SEQ ID NO: 57027 - RNA, 384 nt, synthetic construct
  misc_feature 1..384: note = derived and/or modified sequence opt11 from anti-HIV-1_HeavyChain
  source 1..384: mol_type = other RNA
aggcatacgtgggagcagagcgggagcggggtgaagaagccgggggcgagcgtgagggtgagttgttggacgagcgaggacatattcgagaggacggagttgatacattgggtgaggcaggcgccggggcaggggttggagtggatagggtgggtgaagacggtgacgggggcggtgaattacgggagcttgaactttaggagtaggataagtttgacgagggacagggacttgttcacggcgcatatggatataagggggttgacgcagggggatacggcgacgtatttctgtgcgaggcagaagttcgagagcaggtacacgggagggcaggggtggtatttcgatctgtgggggagggggacgcacatagtggtgagcagc

SEQ ID NO: 57028 - RNA, 384 nt, synthetic construct
  misc_feature 1..384: note = derived and/or modified sequence opt11 from anti-HIV-1_HeavyChain
  source 1..384: mol_type = other RNA
caagcccacctcgaacaatccggctccggcgtcaaaaaacccggcgcctccgtcaaagtctcctgctggacctccgaagacatcttcgaacgcacagaactcatccactgggtccgccaagcccccggccaaggcctcgaatggatcggctgggtcaaaaccgtcaccggcgccgtcaacttcggctccctcgacttccgccaccgcatctccctcacccgcgaccgcgacctattcaccgcccacatggacatccgcggcctcacccaaggcgacaccgccacctacttctgcgcccgccaaaaattcgaatcccgctacaccggcggccaaggctggtacttcgacctctggggccgcggcacccacatcgtcgtatcctcc

SEQ ID NO: 57029 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggacctcggaagatatctttgaagggagcgagctcatacactgggtcaggcaagcgcccgggcaagggctcgagtggataggctgggtcaagaccgtgaccggggccgtgaactttggctcggcctatttcaggcacagggtctcgctcacgcgcgatcgcgatctctcgaccgcgtacatggacatacgcgggctcacgcaagatgacacggccacgtacttttgcgcgcgccagaaatttgcctcgcgatatagcggggaccagggctcgtactttgacttgtgggggcgcgggaccttgatcgtggtctcgagc

SEQ ID NO: 57030 - RNA, 384 nt, synthetic construct
  misc_feature 1..384: note = derived and/or modified sequence opt11 from anti-HIV-1_HeavyChain
  source 1..384: mol_type = other RNA
gggcacgatctcgagcaatcgggctcgggcgtgaaaaagcccggggcctcggtcagggtctcgtgctggacctcggaagatatctttgaagggagcgagctcatacactgggtcaggcaagcgcccgggcaagggctcgagtggataggctgggtaaagaccgtgaccggggccgtgaactttggctcggcctatttcagacacaggatctcgctctcgcgcgatcgcgatctctcgaccgcgtacatggacatacgcgggctcacgcaagatgacacggccacgtacttttgcgcgcgccagaaatttgcctcgcgctatagcggggaccagggctcgtacttcgacttgtgggggcgagggaccctgatcgtggtctcgagc

SEQ ID NO: 57031 - RNA, 384 nt, synthetic construct
  misc_feature 1..384: note = derived and/or modified sequence opt11 from anti-HIV-1_HeavyChain
  source 1..384: mol_type = other RNA
tcgcacacgtggaataacaggggctcggccatgaaaaagcccggggcctcggtcagggtctcatgctggacctcagaagatatcttcgacacgaccgagctcatatactgggtcaggcaagcgcccgggcaagggctcgagtggataggctgggtcaagaccgtgagcgggaccgtgaactttggctcaagcgacttcaggaacaggatctcgctcacgcgagaccgcgacctctcgaccgcgcacatggacatacgcgggctcacgcaagacgacacggccacgtacttctgcgcgcgccagaaatttgaatcgctctatagcgatgaccagggctcgtactttgacctgtgggggcgcgggaccttgatcatagtctcgagc

SEQ ID NO: 57032 - RNA, 384 nt, synthetic construct
  misc_feature 1..384: note = derived and/or modified sequence opt11 from anti-HIV-1_HeavyChain
  source 1..384: mol_type = other RNA
agacatacgtgggagcagagcgggagcggggtgaagaagccgggggcgagcgtaagggtgagctgttggacgagcgaggacatattcgagaggacggagctgatacattgggtgaggcaggcgccggggcaggggctggagtggatagggtgggtgaagacggtgagcggggcggtgaatttcgggagcccgaactttaggcacagggtgagcttgacgagggacagagacttgttcacggcgcatatggatataagggggttgacgcagggggatacggcgacgtatttctgtgcgagacagaagttcgagagcaggtacacgggagggcaggggtggtatttcgatctgtgggggagggggacgcacatagtggtgagcagc

SEQ ID NO: 57033 - RNA, 384 nt, synthetic construct
  misc_feature 1..384: note = derived and/or modified sequence opt11 from anti-HIV-1_HeavyChain
  source 1..384: mol_type = other RNA
tcgcacacgtggaataacaggggctcggccatgaaaaagcccggggcctcagtcagggtctcgtgctggacctcggaagatatctttgaaaggaccgagctcatatactgggtcaggcaagcgcccgggcgcgggctagagtggataggctgggtcaagacagtgagcgggacagtgaacttcggctcgagcgatttcaggaacaggatctcgctcacgcgcgaccgcgacctctcgaccgcgcacatggacatacgcgggctcacgcaagatgacacggccacgtacttttgcgcacgccagaaatttgaatcgctctatagcgatgaccagggctcatactttgacctgtgggggcgagggaccctgatcatagtctcgagc

SEQ ID NO: 57034 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcatgcctcgcctccgaagacatcttcgacaccaccgaactcatctactgggtccgccaagcccccggccaaggcctcgaatggatcggctgggtcaaaatcgtctccggcaccgtcaacttcgcctccctcgacttccgcaaccgcatctccctatcccgcgaccgcgacctctccaccgcctacatggacatccgcggcctcacccaagacgacaccgccacctacttctgcgcccgccaaaaattcgcctcccgctactccggcgaccaaggctcatacttcgacctctggggccgcggcaccctcatcgtcgtctcctcc

SEQ ID NO: 57035 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggcgccgccatgaaaaaacccggcgcctcagtccgcgtctcctgctggacctcagaagacatcttcgacaccaccgaactcatctactgggtccgccaagcccccggacaaggcctcgaatggatcggctgggtcaaaatcgtctcaggcaccgtcaacttcgcctccctcgacttccgaaaccgcatctccctctcccgcgaccgagacctctccaccgcccacatggacatccgcggcctccgccaagacgacaccgccacctacttctgcgcccgccaaaaattcgaatcccgctactccggcgaccaaggctcctacttcgacctctggggccgcggcaccctcatcatcgtctcctcc

SEQ ID NO: 57036 - RNA, 384 nt, synthetic construct
  misc_feature 1..384: note = derived and/or modified sequence opt11 from anti-HIV-1_HeavyChain
  source 1..384: mol_type = other RNA
aggcatacgtgggagcagagcgggagcggggtgaagaagccgggggcgagcgtgagggtgagctgttggacgagcgaggacatattcgagaagagcgaattgatacattgggtgaggcaggcgccggggcaggggttggagtggatagggtgggtgaagacggtgacgggggcggtgaatttcgggagcagtgactttaggcagagggtgagcctgacgagggacagagacttgttcacggcacatatggacataagggggttgacacagggggatacggcgacgtatttctgtgcgaggcagaagttcgagagcaggtacacgggggggcaggggtggtatttcgatctgtgggggagggggacgcacatagtggtgagcagt

SEQ ID NO: 57037 - RNA, 384 nt, synthetic construct
  misc_feature 1..384: note = derived and/or modified sequence opt11 from anti-HIV-1_HeavyChain
  source 1..384: mol_type = other RNA
agtcatacctggaacgagagcgggagcgcgatgaagaaaccgggcgcgagcgtgcgcgtgagctgttggacgagcgaggacatattcgataccacggaattgatctattgggtgcgccaggccccgggccagggattggaatggatcgggtgggtgaaaatagtctcgggcacggtcaatttcgcgagcttggactttcgaaatcgcatcagcttgagcagggacagggacttgagcacggcctatatggatataaggggcttgacccaggacgataccgcgacctatttctgtgccaggcaaaagttcgcgagcaggtactcgggcgatcaagggagctatttcgatctctggggcaggggcacgctcatagtcgtgagctcg

SEQ ID NO: 57038 - RNA, 384 nt, synthetic construct
  misc_feature 1..384: note = derived and/or modified sequence opt11 from anti-HIV-1_HeavyChain
  source 1..384: mol_type = other RNA
aggcacacgtggaatgaatcgggctcgggagtgaaaaagcccggggcctcggtcagggtctcgtgctggagctcggaagatatctttgaaaggaccgagctcatacactgggtcaggcaagcacccgggcgcgggctcgagtggataggctgggtcaagaccgtgagcgggaccgtgaactttggctcgagcgatttcaggaacaggatctcgctcacgcgcgatcgcgatctctcgaccgcgcacatggacatacgagggctcacgcaagatgacacggccacgtacttttgcgcgcgccagaaatttgaatcgctctatagcgatgaccagggctcgtactttgacttgtgggggcgcgggaccttgatcatagtctcgagc

SEQ ID NO: 57039 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggaaatgaaaaagcccggggcctcggtcagggtctcgtgctggacctcggaagatatctttgacacgaccgagctcatatactgggtcaggcaagcacccgggcaagggctcgagtggataggctgggtcaagatcgtgagcgggaccgtgaactttgcctcgctcgatttcaggaacaggatctcgctctcgcgcgatcgcgatctctcgaccgcgtacatggacatacgcgggctcacgcaagatgacacggccacgtacttttgcgcgcgccagaaatttgcctcgcgctatagcggggaccagggctcatactttgacctgtgggggcgagggaccttgatcgtggtctcgagc

SEQ ID NO: 57040 - RNA, 384 nt, synthetic construct
  misc_feature 1..384: note = derived and/or modified sequence opt11 from anti-HIV-1_HeavyChain
  source 1..384: mol_type = other RNA
cgccatacctgggaacagagcgggagcggggtcaagaaaccgggagcgagcgtgcgcgtgagctgttggacgagcgaggacatattcgagcgcacggaattgatccattgggtgcgccaggccccgggccagggcttggaatggatcgggtgggtaaaaacggtcacgggcacggtaaatttcgggagcttgaactttcgccagcgcgtgagcttgaccagggacagggacttgttcacggcccatatggatatcaggggcttgacccagggcgataccgcgacctatttctgtgccaggcaaaagttcgagagcttgtactcggacgatcaagggagctatttcgatctctggggcaggggcacgctcataatcgtgagctca

SEQ ID NO: 57041 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggagcgagcgtgcgcgtgagctgttggacgagcgaggacatattcgagcgctcggaattgatccattgggtgcgccaggccccgggccagggcctggaatggatcgggtgggtgaaaacggtcacgggcgcggtcaatttcgggagccagatctttcgccatagaatcagcttgaccagggacagggacttgttcacggcccatatggatataaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 57042 - RNA, 384 nt, synthetic construct
  misc_feature 1..384: note = derived and/or modified sequence opt11 from anti-HIV-1_HeavyChain
  source 1..384: mol_type = other RNA
agccatacctggaacaagagcgggagcgcgatgaagaaaccgggcgcgagcgtgcgcgtgagctgttggacgagcgaggacatattcgagcgcacggaattgatctattgggtgcgccaggccccgggcaggggcttggaatggatcgggtgggtgaaaacggtctcgggcacggtcaatttcgggagctcggactttcgcaatcgaatcagcttgaccagggacagggacttgagcacggcccatatggatataaggggcttgacccaggacgataccgcgacctatttctgtgccaggcaaaagttcgagagcttgtactcggacgatcaagggagctatttcgatctatggggcaggggcacgctcataatcgtgagctcg

SEQ ID NO: 57043 - RNA, 384 nt, synthetic construct
  misc_feature 1..384: note = derived and/or modified sequence opt11 from anti-HIV-1_HeavyChain
  source 1..384: mol_type = other RNA
caggcccatctagagcaatcgggctcgggcgtgaaaaagcccggggcctcggtcagggtctcgtgctggagctcggaagatatctttgaaaggacagagctcatacactgggtcaggcaagcgcccgggcaagggctcgagtggataggctgggtcaagaccgtgaccggggccgtgaactttggctcgcaaatattcaggcacaggatctcgctcacgcgcgatcgcgatctctttaccgcgcacatggacatacgcgggctcacgcaaggggacacggccacgtacttttgcgcgcgccagaaatttgaatcgcgatataccgggggccagggctggtactttgacttgtgggggcgagggcccacgctctttgtctcgagc

SEQ ID NO: 57044 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgcgagcggggtcaggcgcccgggcgcgagcgtgcgcgtgagctgttggacgagcgaggacatattcgagcgctcggaattgatctattgggtgcgccaggccccgggaaggggcttggaatggatcgggtggataaaaacgtgctcgggcgcggtcaatttcgggagcgtggactttcgcgatcgcgtgagtttgaccagggacagggacttgttcacggcccatatggatatcaggggactgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 57045 - RNA, 384 nt, synthetic construct
  misc_feature 1..384: note = derived and/or modified sequence opt11 from anti-HIV-1_HeavyChain
  source 1..384: mol_type = other RNA
tcgcacacggtagagcaatcgggctcggccatgaaaaagcccggggcctcggtcagggtatcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacagaatctcgctctcgcgcgatcgcgatctctcgaccgcgtacatggacatacgcgggctcacgcaagatgacacggccacgtacttttgcgcgcgccagaaatttgcctcgcgctatagcggggaccagggatcgtactttgacttgtgggggcgcgggaccctgatcgtggtctcgagc

SEQ ID NO: 57046 - RNA, 384 nt, synthetic construct
  misc_feature 1..384: note = derived and/or modified sequence opt11 from anti-HIV-1_HeavyChain
  source 1..384: mol_type = other RNA
aggcacacgtggaataaatcgggctcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57047 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgacaggcaccgggccagcgcttggaatggatcgggtgggtgaaaacggtcacgggcgcggtcaatttcgggagcccgaactttcgccatcgcgtgagcttgaccagggacagggacttgagcacggcctatatggatatcaggggcttgacccaggacgataccgcgacctatttctgtgccaggcaaaagttcgcgagcaggtactcgggcgatcaagggagctatttcgatctctggggcaggggcacgctcatagtagtgagctcg

SEQ ID NO: 57048 - RNA, 384 nt, synthetic construct
  misc_feature 1..384: note = derived and/or modified sequence opt11 from anti-HIV-1_HeavyChain
  source 1..384: mol_type = other RNA
tcgcacgacctcgagcaatcgggctcagccatgaaaaagcccggggcatcggtcagggtctcgtgctggacctcggaagatatctttgacacgaccgagctcatatactgggtcaggcaagcgcccgggcaaggactcgagtggataggctgggtcaagatcgtgagcgggaccgtgaactttgcctcgctcgacttcaggaacaggatctcgctctcgcgcgaccgcgatctctcaaccgcgcacatggacatacgcgggctcaggcaagatgacacggccacgtacttttgcgcgcgccagaaatttgaatcgcgctacagcggggaccagggctcgtacttcgacttatgggggcgcgggaccctgatcatagtctccagc

SEQ ID NO: 57049 - RNA, 384 nt, synthetic construct
  misc_feature 1..384: note = derived and/or modified sequence opt11 from anti-HIV-1_HeavyChain
  source 1..384: mol_type = other RNA
aggcatacgtggaacgagagcgggagcggggtgaagaagccgggggcgagcgtgagggtgagctgctggagtagcgaggacatattcgagaggacggagttgatacattgggtgaggcaggcgccggggcaggggttggagtggatagggtgggtgaagacggtgacgggggcggtgaatttcgggagcttggactttaggcataggataagtttgacgagggacagggacttgttcacggcgcatatggatataagagggttgacgcagggggatacgacgacgtatttctgtgcgaggcagaagttcgagagcaggtacacgggagggcaggggtggtatttcgatctgtgggggagggggacgcacatagtggtgagcagc

SEQ ID NO: 57050 - RNA, 384 nt, synthetic construct
  misc_feature 1..384: note = derived and/or modified sequence opt11 from anti-HIV-1_HeavyChain
  source 1..384: mol_type = other RNA
aggcatacgtgggagcaggtgtggagtggggtgaagaagccgggggcgagtgtgagggtgagttgttggagcagtgaggatatatttgagaggacggagctgatacattgggtgaggcaggcgccggggcaggggttggagtggatagggtgggtgaagacggtgacgggggcggtgaattttgggagtttggattttaggcataggataagtttgacgagagacagggatttgtttacggcgcatatggatataagggggttgacgcagggggatacggcgacgtatttctgtgcgaggcagaagtttgagagtaggtatacgggggggcaggggtggtattttgacttgtgggggagggggacgcatatagtggtgagtagt

SEQ ID NO: 57051 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggcaatgaaaaagcccggggcctcggtcacggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatctcactctcgcgcgatcgcgatctctcgaccgcgtacatggacatacgcgggctcacgcaagatgacacggccacgtacttttgcgcgcgccagaaatttgcctcgcgctatagcggggaccagggctcgtactttgacctgtgggggcgcgggaccttgatcgtggtctcgagc

SEQ ID NO: 57052 - RNA, 384 nt, synthetic construct
  misc_feature 1..384: note = derived and/or modified sequence opt11 from anti-HIV-1_HeavyChain
  source 1..384: mol_type = other RNA
aggcatgacttggagcagagtgggagcggggtgaagaagccgggggcgagtgtgagggtgagctgttggagtagcgaggacatattcgagaggacggagttgatacattgggtgaggcaggcgccggggcaggggttggagtggatagggtgggtgaagacggtgacgggggcggtgaatttcgggagcctggactttaggcataggataagtttgacgagggacagggacttgttcacggcgcatatggatataagggggttgacgcagggggatacggcgacgtatttctgtgcgaggcagaagtttgagagcaggtacacgggggggcaggggtggtattttgatttgtgggggagggggacgcacatagtggtgagtagt

SEQ ID NO: 57053 - RNA, 384 nt, synthetic construct
  misc_feature 1..384: note = derived and/or modified sequence opt11 from anti-HIV-1_HeavyChain
  source 1..384: mol_type = other RNA
gtcacgacctggaacaagagcgggagcgcaatgaagaaaccgggcgcgagcgtgcgcgtgagctgttggacgagcgaggacatattcgataccacggaattgatctattgggtgcgccaggccccgggcaggggcctggaatggatcggatgggtgaaaacggtctcaggcacggtcaatttcgggagctcggactttcgaaatcgaataagcctgaccagggacagagacctgagcacggcccatatggatatcaggggcctgacccaggacgataccgcgacctatttctgtgccagacaaaagttcgagagcttgtactcggacgatcaagggagctatttcgatctctggggcaggggcacgctcataatcgtgagctcg

SEQ ID NO: 57054 - RNA, 384 nt, synthetic construct
  misc_feature 1..384: note = derived and/or modified sequence opt11 from anti-HIV-1_HeavyChain
  source 1..384: mol_type = other RNA
aggcacacgtggaataacacgggatcgggcgtgaaaaagcccggggcctcggtcagggtctcgtgcttggcctcggaagatatctttgaaaggaccgagctcatacactgggtcaggcaagcgcccgggcaagggctagagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacatacttttgcgcgcgccagaaatttgaatcgcgctataccgggggccagggctggtactttgacttgtgggggcgcgggacccatatcgtggtctcgagc

SEQ ID NO: 57055 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgcctagcctccgaagacatcttcgaacgcaccgaactcatctactgggtccgccaagcccccggccgcggccccgaatggatcggctgggtcaaaaccgtctccggcaccgtcaacttcggctcctccgacttccgcaaccgaatctccctcacccgcgaccgcgacctctccaccgcccacatggacatccgcggcctcacccaagacgacaccgccacctacttctgcgcacgccaaaaattcgaatcactctactccgacgaccaaggatcctacttcgacctctggggccgcggcaccctcatcatcgtctcctcc

SEQ ID NO: 57056 - RNA, 384 nt, synthetic construct
  misc_feature 1..384: note = derived and/or modified sequence opt11 from anti-HIV-1_HeavyChain
  source 1..384: mol_type = other RNA
cgccacacctggaacaacaccggaagcggagtcaaaaaaccaggcgccagcgtacgcgtaagctgctggacaagcgacgacatcttcgaacgcacagaactcatccactgggtacgacaagccccaggccaaggcctagaatggatcggctgggtaaaaacagtctcaggcacagtcaacttcgccagcctagacttccgcaaccgcatatccctaagcagagacagagacctcagcacagcctacatggacatcagaggcctaacccaagacgacacagcaacctacttctgcgccagacaaaaattcgccagccgatactcaggcgaccaaggaagctacttcgacctctggggcagaggcacactcatagtcgtcagctcc

SEQ ID NO: 57057 - RNA, 384 nt, synthetic construct
  misc_feature 1..384: note = derived and/or modified sequence opt11 from anti-HIV-1_HeavyChain
  source 1..384: mol_type = other RNA
gggacgccggggaacaagagcgggagcggggtgaagaagccgggggcgagcgtgagggtgagctgttggagtagcgaggacatattcgagagaacggagttgatacattgggtgaggcaggcaccggggcaggggttggagtggatagggtgggtgaagacggtgacgggggcggtgaatttcgggagtttggactttaggcataggataagcttgacgagggacagggacttgttcacggcgcatatggatataagggggttgacgcagggggatacggcgacgtatttctgtgcgaggcagaagttcgagagcaggtacacgggggggcaggggtggtatttcgatctgtgggggagggggacgcacatagtggtgagcagt

SEQ ID NO: 57058 - RNA, 384 nt, synthetic construct
  misc_feature 1..384: note = derived and/or modified sequence opt11 from anti-HIV-1_HeavyChain
  source 1..384: mol_type = other RNA
ggaacgccagggagcgagagcgggagcggggtcaagagaccgggcgcgagcgtgcgagtgagctgttggacgagcgaggacatattcgagaccacggaattgatccattgggtgcgacaggccccgggccagggcttggaatggatagggtgggtgaaaacggtctcgggagcggtcaatttcgggagcttgaactttagacatcgagtgagcctgaccagggacagggacctgttcacggcccatatggatatcaggggcttgacccagggcgatacagcgacatatttctgtgccaggcaaaagttcgagagcaggtacacgggcgggcaagggtggtatttcgatctctggggaaggggcacgcacatagtagtgagctcg

SEQ ID NO: 57059 - RNA, 384 nt, synthetic construct
  misc_feature 1..384: note = derived and/or modified sequence opt11 from anti-HIV-1_HeavyChain
  source 1..384: mol_type = other RNA
gtgaccccgggcacgaacttgggcttgcgcatgaaaaagcccggggcctcggtcagggtctcgtgctggacctcggaagatatctttgacacgaccgagctaatatactgggtcaggcaagcgcccgggcaagggctcgagtggataggctgggtcaagatcgtaagcgggaccgtgaactttgcctcgctcgatttcaggaacaggatctcgctctcgcgcgatcgcgatctctcgaccgcgtacatggacatacgcgggctcacgcaagatgacacggccacgtacttttgcgcgcgccagaaatttgcctcgcgctatagcggggaccagggctcgtactttgacctgtgggggcgcggaaccttgatcgtggtctcgagc

SEQ ID NO: 57060 - RNA, 384 nt, synthetic construct
  misc_feature 1..384: note = derived and/or modified sequence opt11 from anti-HIV-1_HeavyChain
  source 1..384: mol_type = other RNA
aggcacgatctcgagcaatcgggcgcgggcgtgaaaaagcccggggcctcggtcagggtctcgtgctggagctcagaagatatctttgaaaggaccgagctaatacactgggtcaggcaagcgcccgggcaagggctcgagtggataggctgggtcaagaccgtgaccggggccgtgaactttggctcgctagatttcaggcacaggatctcgctcacgcgcgatcgcgatctctttaccgcgcacatggacatacgcgggctcacgcaaggggacacggccacgtacttttgcgcgcgacagaaatttgaatcgcgctataccgggggccagggctggtactttgacttgtgggggcgcgggacccatatcgtggtctcgagc

SEQ ID NO: 57061 - RNA, 384 nt, synthetic construct
  misc_feature 1..384: note = derived and/or modified sequence opt11 from anti-HIV-1_HeavyChain
  source 1..384: mol_type = other RNA
caagtgcacttggagcagagcgggagcggggtaaagaaaccgggagcgagcgtgagagtgagctgttggacgagcgaggacatattcgagaaaagtgaattgatacattgggtgagacaggcgccgggacagggactggaatggatagggtgggtgaaaacggtaacgggagcggtgaatttcgggagcagtgactttagacagagagtgagcttgacaccggacagggacttgttcacggcacatatggatataagggggttgacacagggggatacagcgacatatttctgtgcaagacaaaagttcgagagcaggtacacgggagggcaagggtggtatttcgatctgtgggggaggggaacgcacatagtggtgagctcg

SEQ ID NO: 57062 - RNA, 384 nt, synthetic construct
  misc_feature 1..384: note = derived and/or modified sequence opt11 from anti-HIV-1_HeavyChain
  source 1..384: mol_type = other RNA
gggaccacgtgggagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgacaggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57063 - RNA, 384 nt, synthetic construct
  misc_feature 1..384: note = derived and/or modified sequence opt11 from anti-HIV-1_HeavyChain
  source 1..384: mol_type = other RNA
agccacgacctagaacaaagcggaagcgaatggaaaaaaccaggcgccagcgtgcgagtaagctgctggacaagcgaagacatattcgacaccacagaactgatccactgggtacgccaggccccaggccaaggcctagaatggatcggatgggtaaaaacagtcacaggcgcagtcaacttcggaagcctagacttccgccaccgcataagcctaaccagagacagagacctattcacagcccacatggacatcagaggactgacccaaggcgacaccgcaacatacttctgcgccagacaaaaattcgaaagcagatacacaggcggacaaggatggtacttcgacctctggggcagaggcacacacatagtcgtaagcagc

SEQ ID NO: 57064 - RNA, 384 nt, synthetic construct
  misc_feature 1..384: note = derived and/or modified sequence opt11 from anti-HIV-1_HeavyChain
  source 1..384: mol_type = other RNA
cagagcaggcccgggaacaagagcgggagcgcgatgaagaaaccgggcgcgagcgtgcgcgtgagctgttggacgagcgaggacatattcgagcgcacggaattgctctgggtcaggcaagcgcccgggcgcgggctcgagtggataggctgggtcaagaccgtgagcgggaccgtgaactttggctcgagcgatttcaggaacaggatctcactcacgcgcgatcgcgatctctcgaccgcgcacatggacatacgcgggctcacgcaagatgacacggccacgtacttttgcgcgcgccagaaatttgaatcgctctatagcgatgaccagggctcgtactttgacctgtgggggcgcgggaccttgatcatagtctcgagc

SEQ ID NO: 57065 - RNA, 384 nt, synthetic construct
  misc_feature 1..384: note = derived and/or modified sequence opt11 from anti-HIV-1_HeavyChain
  source 1..384: mol_type = other RNA
ggaacgacctggagcaagagcgggagcggggtcaagaaaccgggcgcgagcgtgcgcgtgagctgttggacgagcgaggacatattcgagcgcacggaattgatctattgggtgcgccaggccccgggccagggcttggaatggatcgggtgggtgaaaatagtctcgggcacggtcaatttcgcgagcttggactttcgcaatcgcatcagcttgagcagggacagggacttgagcacggcacatatggatataaggggcttgacccaggacgataccgcaacctatttctgtgccaggcaaaagttcgcgagcaggtactcgggcgatcaagggagctatttcgatctctggggcaggggcacgctcataatcgtgagctcg

SEQ ID NO: 57066 - RNA, 387 nt, synthetic construct
  misc_feature 1..387: note = derived and/or modified sequence opt11 from anti-HIV-1_HeavyChain
  source 1..387: mol_type = other RNA
caagcgcacttggaacagagcgggagcggggtcaagaaaccgggcgcgagcgtgcgcgtgagctgttggacgagcgaggacatactcaggaaaaagcgcgtggactcggtcgggtgcgatacagcgcccgggcaagggctcgagtggataggctgggtcaagaccgtgaccggggccgtgaactttggctcgagcgatttcaggcaaagggtctcgctcacgcgagatcgcgatctctttacagcgcacatggacatacgcgggctcacgcaagatgacacggccacgtacttttgcgcgcgccagaaatttgcctcgcgctatagcggggaccagggctcgtactttgacttgtgggggcgcgggaccttgatcgtggtctcgagc

SEQ ID NO: 57067 - RNA, 387 nt, synthetic construct
  misc_feature 1..387: note = derived and/or modified sequence opt11 from anti-HIV-1_HeavyChain
  source 1..387: mol_type = other RNA
aaagcgcacttgggcaataaatcgggctcgggcgtgaaaaagcccggggcctcggtcagggtctcgtgctggagctcggaagatatctttgaaaggaccgagctcatacactgggtcaggcaagcgcccgggcaagggctcgagtggataggctgggtcaagaccgtgaccggggcagtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57068 - RNA, 384 nt, synthetic construct
  misc_feature 1..384: note = derived and/or modified sequence opt11 from anti-HIV-1_HeavyChain
  source 1..384: mol_type = other RNA
accacggtcgggaccatactcgggcgcgcgatgaagaaaccgggcgcgagcgtgagagtgagctgttggacgagcgaggacatattcgataccacggaattgatctattgggtgcgacaggccccgggccagggcttggaatggatcgggtgggtgaaaatagtctcgggcacggtcaatttcgcgagcttggactttcgcaatcgcataagcctgagcagggacagggacttgagcacggcctatatggatatcaggggcttgacccaggacgataccgcgacctatttctgtgccaggcaaaagttcgcgagcaggtactcgggcgatcaagggagctatttcgatctctggggcaggggcacgctcatagtcgtgagctcg

SEQ ID NO: 57069 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcaaggtctcgtgctggacctcggaagatatctttgacacgaccgagctaatatactgggtcaggcaagcgcccgggcaagggctcgagtggataggctgggtcaagatcgtgagcgggaccgtgaacttcgcctcgctagatttcaggaacaggatctcgctctcacgcgatcgcgatctctcgaccgcgtacatggacatacgcgggctcacgcaagatgacacggccacgtacttttgcgcgcgccagaaatttgcctcgcgctatagcggggaccagggctcgtactttgacttgtgggggcgcgggaccttgatcgtggtctcaagc

SEQ ID NO: 57070 - RNA, 387 nt, synthetic construct
  misc_feature 1..387: note = derived and/or modified sequence opt11 from anti-HIV-1_HeavyChain
  source 1..387: mol_type = other RNA
cagagccatctcgaacaagtgtgggtgtgccagagcaagaaaccgggcgcgagcgtgcgcgtgagctgttggacgagcgaggacatattcgataccacggaattgatctattgggtgcgccaggccccgggccagggcttggaatggatcgggtgggtgaaaatagtctcaggcacggtcaatttcgcgagcttggactttcgcaatcgcatcagcttgagcagggacagggacttgagcacggcccatatggatataaggggcctgacccaggacgataccgcgacctatttctgtgccagacaaaagttcgcgagcaggtactcaggcgatcaagggagctacttcgatctctggggaaggggcacgctcataatcgtgagctcg

SEQ ID NO: 57071 - RNA, 384 nt, synthetic construct
  misc_feature 1..384: note = derived and/or modified sequence opt11 from anti-HIV-1_HeavyChain
  source 1..384: mol_type = other RNA
aggcacacggtcgagcaatcgggctcgggcgtgaaaaagcccggggcctcggtcagggtctcgtgctggagctcggaagatatctttgaaaggaccgagctcatacactgggtcaggcaagcgccagggcaagggctagagtggatgggctgggtcaagaccgtgaccggggccgtgaactttggctcgctagatttcaggcacaggatctcgctcacgcgcgatcgcgatctctttacagcgcacatggacatacgcgggctaacgcaaggggacacggccacgtacttttgcgcgcgccagaaatttgaatcgcgatataccgggggccagggctggtactttgacttgtgggggcgcgggacccatatcgtggtctcgagc

SEQ ID NO: 57072 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctccgcccgagaagacatcttcgacaccaccgaactcatctactgggtccgccaagcccccggccaaggcctcgaatggatcggctgggtcaaaatcgtctgcggcaccgtcaacttcgcctccctagacttccgcaaccgcatctccctctcccgagaccgcgacctctccaccgcccacatggacatccgcggcctcacccaagacgacaccgccacctacttctgcgcccgccaaaaattcgcctcccgatactcaggcgaccaaggctcctacttcgacctctggggccgcggcaccctaatcatcgtctcatcc

SEQ ID NO: 57073 - RNA, 387 nt, synthetic construct
  misc_feature 1..387: note = derived and/or modified sequence opt11 from anti-HIV-1_HeavyChain
  source 1..387: mol_type = other RNA
gaagtgcaaaggggcgggcgcgtggtcgggcgcgatgtcaagaaaccgggcgcgagcgtgcgcgtgagctgttggacgagcgaggacatattccataccgagctcatatactgggtcaggcaagcgcccgggcaagggctcgagtggataggctgggtcaagatagtgagcgggaccgtgaactttgcctcgctcgatttcaggaacagaatctcgctctcgcgagatcgcgatctctcgaccgcgtacatggacatacgcgggctcacgcaagatgacacggccacgtacttttgcgcgcgccagaaatttgcctcgcgctatagcggggaccagggctcgtactttgacttgtgggggcgcgggaccctgatcgtggtctcgagc

SEQ ID NO: 57074 - RNA, 384 nt, synthetic construct
  misc_feature 1..384: note = derived and/or modified sequence opt11 from anti-HIV-1_HeavyChain
  source 1..384: mol_type = other RNA
ggcacgacctggaacgagagcgggagcggggtcaagaaaccgggcgcgagcgtgcgcgtgccctgttggtcgagcgaggacatattcgagcgcacggaattgatccatcgcgtgcgccaggccccgggccagggcttggaatggatcgggtgggtgaaaacggtcacgggcgcggtcaatttcgggagcccgaactttcgccatcgcatcagcttgaccagggacagggacttgttcacggcccatatggatataaggggcctgacccagggcgataccgcgacctatttctgtgccaggcaaaagttcgagagcaggtacacgggcgggcaagggtggtatttcgatctctggggcagaggcacgcacatagtcgtgagctcg

SEQ ID NO: 57075 - RNA, 384 nt, synthetic construct
  misc_feature 1..384: note = derived and/or modified sequence opt11 from anti-HIV-1_HeavyChain
  source 1..384: mol_type = other RNA
agaagcaattgggtgcaatcgggcgcggacgtgaaaaagcccggggcctcagtcaagagctcgtgctggacctcggaagatatctttgacacgaccgagctcatatactgggtcagacaagcgcccgggcaagggctagagtggataggctgggtcaagatcgtgagcgggaccgtgaactttgcctcgctcgatttcaggaacaggatctcgctctcgcgcgatcgcgatctctcgaccgcgtacatggacatacgcgggctcacgcaagatgacacggccacgtacttttgcgcgcgccagaaatttgcctcgcgctatagcggggaccagggatcgtactttgacttgtgggggcgcgggaccttgatcgtggtctcgagc

SEQ ID NO: 57076 - RNA, 384 nt, synthetic construct
  misc_feature 1..384: note = derived and/or modified sequence opt11 from anti-HIV-1_HeavyChain
  source 1..384: mol_type = other RNA
ccagtgcaattggtccagagcggggccgaggtcaagaaaccgggcgcgagcgtgaaagtgagctgttggacgagcgaggacatattcgagcgcacggaattgatccattgggtgcgccaggccccgggccagggcttggaatggatcgggtgggtgaaaacggtcacgggcgcggtaaatttcgggagcttggactttcgccatcgcatcagcttgaccagggacagagacctgttcacggcccatatggatataaggggcctgacccagggcgataccgcgacatatttctgtgccaggcaaaagttcgagagcaggtacacgggcgggcaagggtggtatttcgatctatggggcaggggcacgcacatagtcgtgagctcg

SEQ ID NO: 57077 - RNA, 399 nt, synthetic construct
  misc_feature 1..399: note = derived and/or modified sequence opt11 from anti-HIV-1_HeavyChain
  source 1..399: mol_type = other RNA
cgcgaatacctcgaacaatccggcggcggcgtcaaaaaactcggcgcctccgtccgcgtctcctgccgcgcctccgaagacctcttcggcgacgaagccatctacgacgacgaactcatccactggctccgccaagtccccggccaacgccccgaatggatgggctggatccgccccaaaaccggcgcccgcaaccaagcccgccaattccaaccccgcatcaacctctcccgcgaccgcgccctcaacaccgcctacctcgacctatcctccctcacctccgccgactcagccacctacttctgcgcccgccaaaccttcaaacccgacttctacttcgccgaccaaggctggtccttcaacctctggggccgcggcgctcgcgtcatcgtctcctcc

SEQ ID NO: 57078 - RNA, 399 nt, synthetic construct
  misc_feature 1..399: note = derived and/or modified sequence opt11 from anti-HIV-1_HeavyChain
  source 1..399: mol_type = other RNA
caagtccaactcgtccaatcaggcaccgaagtcaaaaaacccggcgcctcactccgcgtctcatgccgcgcctccgaagacctcttcggcgacaaaatcatctacgacgacgaagtcatccactggctccgccaactccccggccaacgccccgaatggatgggctggatccgccccaaatccggcgcccgcaaccaagcccgccaattccaaccccgcatctccctcacccgcgaccgagccctctccaccgcctacctcgacctcaactccctcacctccgccgactccggcacctacttctgcgcccgccaaaccttcaaacccgacttctacttcgccgaccaaggctggtccttcaacctctggggccgcggcgcccacttcatcgtctcctcc

SEQ ID NO: 57079 - RNA, 399 nt, synthetic construct
  misc_feature 1..399: note = derived and/or modified sequence opt11 from anti-HIV-1_HeavyChain
  source 1..399: mol_type = other RNA
caagcccacctcgaacaatcaggctccggagtcaaaaaacccggcgcctccgtccgagtctcctgccgcgcctccgaagacctcttcggcgacgaaatcatctacgacgacgaagtcatccactggctccgccaagtccccggccaacgccccgaatggatgggctggatccgccccaaaaccggcgcccgcaaccaagcccgccaattccaaccccgcatctccctcacccgagaccgcgccctctccaccgcctacctcgacctcaactccctcacctccgccgactccggcacctacttctgcgcccgccaaaccttcaaacccgacttctacttcgccgaccaaggctggtcattcaacctctggggccgcggcgcccacttcatcgtctcctcc

SEQ ID NO: 57080 - RNA, 399 nt, synthetic construct
  misc_feature 1..399: note = derived and/or modified sequence opt11 from anti-HIV-1_HeavyChain
  source 1..399: mol_type = other RNA
ggcaatatatggagcgagagcgggggcggggtcaagaaaccgggcgcgagcgtgcgcgtgagctgtcgagcgagcgaggacttgttcggggacgagatcatatacgatgacgaggtcatacactggctcaggcaagtgcccgggcaaaggcccgagtggatgggctggatcaggcccaagaacgggggcaggaaccaggccaggcaatttcaaccgcgcatcagcttgacaagggacagggccttgaacacggcctatctcgatctcaatagcctgacctcggccgatagcgggacctatttctgtgccaggcaaacgttcaagcccgatttctacttcgcggaccagggctggagctttaacttgtgggggcgcggggccagggtcatagtctcgagc

SEQ ID NO: 57081 - RNA, 399 nt, synthetic construct
  misc_feature 1..399: note = derived and/or modified sequence opt11 from anti-HIV-1_HeavyChain
  source 1..399: mol_type = other RNA
caagtccaactagtccaatccggcgccgaagtcaaaaaacccggcgcctccctccgcgtcccctgccgcgcctccgaagacctcttcggcgacgaaatcatctacgacgacgaagtcatccactggctccgccaagtccccggccaacgccccgaatggatgggctggatccgccccaaaaccggcgcccgcaaccaagcccgccaattccaaccccgcatctcactcacccgcgaccgcgccctctccaccgcctacctcgacctcaactccctcacctccgcagactccggcacatacttctgcgcccgccaaaccttcaaacccgacttctacttcgccgaccaaggctggtcattcaacctatggggccgcggcgcacacttcatcgtctcctcc

SEQ ID NO: 57082 - RNA, 390 nt, synthetic construct
  misc_feature 1..390: note = derived and/or modified sequence opt11 from anti-HIV-1_HeavyChain
  source 1..390: mol_type = other RNA
caagcgcacctggaacagagcgggagcggggtcaagaaaccgggcgcgagcgtgcgcgtgagctgttggacgagcgaggacatattcgagcgaacggaattgatccattgggtgcgccaggccccgggccagggattggaatggatcgggtgggtgaaaatagtctcgggcgcggtcaatttcgggagcccgaactttcgccagcgcgtgagcttgacaagggacagggacttgttcacggcccatatggatatcaggggattgacacagggcgatacagcgacctatttctgtgccaggcaaaagttcgagcgcgggggccagggctggatctttgacttgtgggggcgcgggacattgatcgcggtatcgagcgcgagcaggagcgcg

SEQ ID NO: 57083 - RNA, 393 nt, synthetic construct
  misc_feature 1..393: note = derived and/or modified sequence opt11 from anti-HIV-1_HeavyChain
  source 1..393: mol_type = other RNA
caagcacacctggaacagagcggaagcggagtcaaaaaactgggcgcaagcgtacgcgtaagctgctggacaagcgaagacatattcgaacgcacagaactaatccactgggtacgccaggccccaggccaaggcctagaatggatcggatgggtaaaagcagtctcaggcgcagtcaactacggaagcctagacttccgccaccgcgtgagcctaaccagagacagagacctaagcacagcccacatggacatcagaggcctaacccaagacgacaccgccacctacttctgcgcccgacaaaaattcgcgcgcggagaccaaggctggttcttcgacctatggggacgcggaaccctaatcgtagtctcaagcgcaagcacacgctcgacc

SEQ ID NO: 57084 - RNA, 414 nt, synthetic construct
  misc_feature 1..414: note = derived and/or modified sequence opt11 from anti-HIV-1_HeavyChain
  source 1..414: mol_type = other RNA
caagtgcaattggtccagagcggggccgaggtcaagaaaccgggcgcgagcgtgaccgtgagctgtaaagcgagcaggtacacgttcataaactattacatacactgggtcaggcaagcgcccgggcaagggctagagtggataggctgggtcaagcccgtgagcggggccgtgaactttggctcgcccaatttcaggcacagggtctcgctcacgcgcgatcgcgatctatttaccgcgcacatggacatacgcgggctcacgcaaggggacacggccacgtacttttgcgcgcgccagaaattcgccagaggcgatcaagggtggtttttcgatctctggggcaggggcacgctcatagtcgtgagctcggcctcgaccaagggcccgagcgtgttcccgcacgatctcagg

SEQ ID NO: 57085 - RNA, 414 nt, synthetic construct
  misc_feature 1..414: note = derived and/or modified sequence opt11 from anti-HIV-1_HeavyChain
  source 1..414: mol_type = other RNA
caagtgcaattggtccagagcggggccgaggtcaagaaaccgggcgcgagcgtgaaagtgagctgtaaagcgagcgggtacacgatcacgagacattacatgcactgggtcaggcaagcgcccgggcaagggctcgagtggataggctgggtcaagaccgtgaccggggccgtgaactttggctcgcccaacttcagacacagggtctcgctcacgcgcgatcgcgatctctttaccgcgcacatggacatacgcgggctcacgcaaggggacacggccacgtacttttgcgcgcgccagaaatttgaaaggggcgggcaagggtggtatttcgacctctggggcaggggaacgctcatagtcgtgagctcggcctcgaccaagggcccgagcgtattcccgcacgatctcagg

SEQ ID NO: 57086 - RNA, 408 nt, synthetic construct
  misc_feature 1..408: note = derived and/or modified sequence opt11 from anti-HIV-1_HeavyChain
  source 1..408: mol_type = other RNA
caggcccatctcgaacaatcgggctcgggcgtgaaaaagcccggggcctcggtcagggtctcgtgctggacctcggaagatatctttgaaaagagcgagctaatacactgggtcaggcaagcgcccgggcaagggctcgagtggataggctgggtcaagaccgtgaccggggccgtgaactttggctcgcccaatttcaggcacagggtctcactcacgcgcgatcgagatctctttaccgcgcacatggacatacgcgggctcacgcaaggggacacggccacgtacttttgcgcgcgccagaaatattacgcgggcgggcaagggtggtatttcgatctctggggcaggggcacgctcatagtcgtgagctcggcttcgaccaagggcccgagcgatgacctgcga

SEQ ID NO: 57087 - RNA, 411 nt, synthetic construct
  misc_feature 1..411: note = derived and/or modified sequence opt11 from anti-HIV-1_HeavyChain
  source 1..411: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagatagtgagtggggcggtgaatttcgggagcccgaactttaggcagagggtgagcttgacaagggacagggacttgttcacggcgcatatggatataagggggttgacacagggggatacggcgacgtatttctgtgcgaggcagaagttcgagaggggggggcaggggtggatatttgacttgtgggggagagggacgttgatagcggtgagtagcgcgagcacgaaggggccgagtgtgtatgacttgagg

SEQ ID NO: 57088 - RNA, 417 nt, synthetic construct
  misc_feature 1..417: note = derived and/or modified sequence opt11 from anti-HIV-1_HeavyChain
  source 1..417: mol_type = other RNA
caagtacaactagtccaaagcggaagcggagtcaaaaaaccaggcgcaagcgtacgcgtaagctgctggacaagcgaagacatattcgaacgcacagaactaatccactgggtacgacaagccccaggccaaggcctagaatggataggatgggtaaaaacagtctcgggcgccgtcaacttcggaagcccaaacttccgccaccgcgtaagcctaaccagagacagagacctattcacagcccacatggacatcagaggcctaacccaaggcgacaccgcaacctacttctgcgccagacaaaaattcgaacgcggcggccaaggctggtacttcgacctatggggacgcggaaccctaatcgtagtctcaagcgcaagcacaaaaggaccctcagtcttcccccacgacctacgc

SEQ ID NO: 57089 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggcgcgagcgtgcgagtgagctgttggacgagcgaggacatattcgagaaatcggaattgatccattgggtgcgccaggccccgggccagggcttggaatggatcgggtgggtgaaaacggtcacgggcgcggtcaatttcgggagcccgaactttcgccatcgcgtgagcttgaccagggacagagacttgttcacggcccatatggatatcaggggcttgacccagggcgataccgcgacctatttctgtgccaggcaaaagttcgagcgagggggccagggctggtactttgacttgtgggggcgcgggaccctgatcgtggtctcaagcgcgagcacgaaagggccctcagtctttcccacgatctatgtc

SEQ ID NO: 57090 - RNA, 417 nt, synthetic construct
  misc_feature 1..417: note = derived and/or modified sequence opt11 from anti-HIV-1_HeavyChain
  source 1..417: mol_type = other RNA
caagtgcaattggaacagagcgggagcggggtcaagaaattgggcgcgagcgtgcgcgtgagctgttggacgagcgaggacatattcgaggacgagctcatacactgggtcaggcaagcgcccgggcaagggctcgagtggataggctgggtcaaggccgtgagcggggccgtgaactatggctcactcgatttcaggcacagagtctcgctcacgcgcgatcgagatctctttaccgcgcacatggacatacgcgggctaacgcaagatgacacggccacgtacttttgcgcgcgccagaaatttgccaggggcgatcaagggtggtttttcgatctctggggcaggggcacgctcatagtcgtgagctcgggcttgcaccagggcccgatcgggctcccgcccaggctctcgcgc

SEQ ID NO: 57091 - RNA, 417 nt, synthetic construct
  misc_feature 1..417: note = derived and/or modified sequence opt11 from anti-HIV-1_HeavyChain
  source 1..417: mol_type = other RNA
caggcgcacctggagcagagcgggagcggagtgaagaagccgggggcgagcgtgagggtaagctgctggacgagcgaggacatattcgagaggacggagctgatacactgggtgaggcaggcgccggggcagggactggagtggatagggtgggtaaagatagtgagtggggcagtgaacttcgggagcccgaactttaggcagagggtgagcctgacgagggacagagacctgttcacggcgcatatggacataagagggctgacgcagggggacacggcgacgtatttctgtgcgagacagaagttcgaaaggggagggcaggggtggatattcgacctgtgggggagggggacgctgatagcggtgagcagcgcgagcccgagggcacacagaagcagcccgacaatatgtgtg

SEQ ID NO: 57092 - RNA, 417 nt, synthetic construct
  misc_feature 1..417: note = derived and/or modified sequence opt11 from anti-HIV-1_HeavyChain
  source 1..417: mol_type = other RNA
caggcgcacttagagcaaagcggaagcggagtgaaaaagccaggggcaagcgtaagggtaagctgctggacgagcgaagacatattcgaaaggacagagctaatacactgggtaaggcaggcgccagggcaagggctagagtggataggatgggtaaagacagtgacaggggcagtgaacttcggaagcagcgacttcaggcaaagggtaagcctgacgagagacagggacctgttcacggcgcacatggacataagagggctaacgcaaggggacacggcaacgtacttctgcgcgagacagaaattctacgcgggagggcaagggtggtacttcgacctatggggaagagggacgctaatagtagtgagcagcgcaagcacaaagggaccgagtgtgttcccgcacgacctgagg

SEQ ID NO: 57093 - RNA, 414 nt, synthetic construct
  misc_feature 1..414: note = derived and/or modified sequence opt11 from anti-HIV-1_HeavyChain
  source 1..414: mol_type = other RNA
caagtgcacttggtccagagcggggccgaggtcaagcgcccgggcgcgagcgtgaaagtgagctgtaaagcgagcgggtacacgttcacggactatttcatacactgggtcaggcaagcgcccgggcaagggctagagtggataggctgggtcaagaccgtgagcggggccgtgaactttggctcgctcaatttcaggcacagggtctcgctcacgcgtgatcgcgatctctttaccgcgcacatggacatacgcgggctaacgcaaggggacacggccacgtacttttgcgcgcgccagaaatttgccaggggcgatcaagggtggtttttcgatctctggggaaggggcacgctcatagtcgtgagctcggcctcgacaaagggaccgagcgtgttcccgcacgatctcagg

SEQ ID NO: 57094 - RNA, 420 nt, synthetic construct
  misc_feature 1..420: note = derived and/or modified sequence opt11 from anti-HIV-1_HeavyChain
  source 1..420: mol_type = other RNA
caagtgcaactggtccagagcggggccgaggtcaagaaaccgggcgcgagcgtgaaagtgagctgtaaagcgagcgggtacatattcacgggctcgtacatgcactgggtcaggcaagcgcccggacaaacgttcgagtggttgggctggatgaagcccgtgaccggggccgtgaactatgccaggcaatttcaagggcgcgtgagtttttacaggaccagggaattgggcatagcctatatggatctcagggacctgaaatttgacgataccgcggtctatttctgtgccaggaaaacgaaaggggacgtgagcggagacgatcgcgggttctttttcgatctctggggcaggggcacgcgcgtgatcgtgagctcggcctcgaccaagggcccgagcgtgttcccgcacgatctcagg

SEQ ID NO: 57095 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaaccaggcgcctccgtccgcgtctcctgctggacctccgaagacatcttcgaaaaatccgaactaatccactgggtccgccaagcccccggccaaggcctcgaatggatcggctgggtcaaaaccgtcaccggcgcagtcaacttcggctcccccaacttccgccaccgcgtctcactcacccgcgaccgcgacctcttcaccgcccacatggacatccgcggcctaacccaaggcgacaccgccacctacttctgcgcccgccaaaaattcgaacgcggcggccaaggctggtacttcgacctatggggccgcggaaccctcatcgtagtctcctcagcctccaccaaaggcccctccgtcttcccccacgacctccgc

SEQ ID NO: 57096 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatcttcgaagggagcgagctcatacactgggtcaggcaagcgcccgggcaaggactcgagtggataggctgggtcaagaccgtgaccggggccgtgaacttcggctcgcccaatttcaggcacagggtatcgctcacgcgagaccgcgatctctttaccgcgcacatggacatacgcgggctcacgcaaggggacacggccacatacttttgcgcgcgccagaaatttgaaaggggcgggcaagggtggtatttcgatctatggggcaggggcacactaatagtcgtgagctcggcctcgaccaagggcccgagcgtattcccgcacgatctcaga

SEQ ID NO: 57097 - RNA, 420 nt, synthetic construct
  misc_feature 1..420: note = derived and/or modified sequence opt11 from anti-HIV-1_HeavyChain
  source 1..420: mol_type = other RNA
caagtccaactcgtccaatccggagcagaagtcaaaaaacccggagcctccgtcaaagtctcctgcaaagcctccggctacaccttcaccggctactacatccactgggtccgacaagcccccggccaaggcctcgaatggatgggctggatcaaccccaactccggcgccaccaactacgcccaaaaattccaaggccgcctcaccatcgcccgcgacacctccatctccaccgcctacatggacctccgcaacctccgcttcgacgacaccgccgtctacttctgcgccagaaaaaccgccggcgacgtctccggcgacaaccgaggctacttcttcgacctctggggccgcggctcccgcgtcatcgtctcctccgcctccaccaaaggcccctccgtcttcccccacgacctccgc

SEQ ID NO: 57098 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgaccaagggcccgagcgtgttccatgacttgcgc

SEQ ID NO: 57099 - RNA, 414 nt, synthetic construct
  misc_feature 1..414: note = derived and/or modified sequence opt11 from anti-HIV-1_HeavyChain
  source 1..414: mol_type = other RNA
caagcgaccttggaacagagcgggagcggggtcaagaaaccgggcgcgagcgtgcgcgtgagctgttggtcaagcgaggacatattcaagaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgagatctctcgaccgcgcacatggacatacgcgggctcacgcaagatgacacggccacgcacttttgcgcgcgccagaaatttgccaggggcgatcaagggtggtttttcgatctctggggcaggggcacgctcatagtcgtgagctcggcctcgaccaagggcccgagcgtgttcccgaccatatacgtg

SEQ ID NO: 57100 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaacccggcgcctcagtccgagtctcatgctggacctccgaagacatcttcgaacgaaccgaactcatccactgggtccgccaagcccccggccaaggcctcgaatggatcggctgggtcaaaaccgtcaccggcgccgtaaacttcggctcccccaacttccgacaccgcgtctccctcacccgcgaccgcgacctcttcaccgcccacatggacatccgcggcctcacccaaggagacaccgccacctacttctgcgcccgccaaaaattcgaacgcggcggccaaggctggtacttcgacctctggggccgcggcaccctaatcgtcgtctcatccgcctccaccaaaggcccctccgtcttccccaccatctgcgtc

SEQ ID NO: 57101 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgcgtgagctgttggacgagcgaggacatattcgagcgaacggaattgatccattgggtgcgccaggccccgggccagggcttggaatggatcgggtgggtgaaaacggtctcgggcgcggtcaatttcgggagcccgaactttcgccatcgcgtgagcttgaccagggacagggacttgttcacggcacatatggatatcaggggcttgacccagggcgataccgcgacctatttctgtgccaggcaaaagttcgagcgcgggggccagggctggatatttgacttgtgggggcgcgggaccttgatcgcggtctcgagcgcgagcccgcgcgcgcacaggagctcgcccaggagcgcg

SEQ ID NO: 57102 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagtgtgcgcgtgagctgttggacgagcgaggacatattcaagagcgagctaatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacatacttttgcgcgcgccagaaatttgaaaggggcgggcaagggtggatattcgatctctggggcaggggcacgctcatagccgtgagctcggcctcgaccaagggcccgagcgtgttcccgaccatatgcgtg

SEQ ID NO: 57103 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggcccggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtcaattacgggagcctggactttcgccatcgcgtgagcttgaccagggacagggacttgttcacggcccatatggatatcaggggcttgacccaggacgataccgcgatctatttctgtgccaggcaaaagttcgcgcgcggggaccagggctggttctttgacttgtgggggcgcgggaccttgatcgtggtctcgagcgcgagcacgaaagcgcacagaagctcgcccagaagcaca

SEQ ID NO: 57104 - RNA, 420 nt, synthetic construct
  misc_feature 1..420: note = derived and/or modified sequence opt11 from anti-HIV-1_HeavyChain
  source 1..420: mol_type = other RNA
caagtccaactcgtccaatccggcgccgaaatgaaaaaacccggcgcctccgtcaaactctcctgcatgacctcaggctacgtcttcaccgacttctacatccactgggtccgccaagcccccggccaaggcctcgaatggatgggctggatcaaccccggcaccggaggcaccatctccgccccccgcttcctcggccgcgtcaccctcacccgcgacacctccatctccgccgcctacatcgaaatcaaccgcgtcaccatcgacgacaccgccacctacttctgcgcccgacaaaaattcgcctcccgatactccggcgaccaaggctcatacttcgacctctggggccgaggaaccctcatcgtcgtctcctccgcctccaccaaaggccccctcggcctacccccccgctccgcc

SEQ ID NO: 57105 - RNA, 414 nt, synthetic construct
  misc_feature 1..414: note = derived and/or modified sequence opt11 from anti-HIV-1_HeavyChain
  source 1..414: mol_type = other RNA
caagcgcacctggaacagagcgggagcggggtcaagaaaccgggcgcaagcgtgcgcgtgagctgttggacgcccgaggacatattcgagcgcacggaattaatccattgggtgcgacaggccccgggccagggcctggaatggatcgggtgggtgaaaatagtctcgggcgcggtcaatttcgggagcccgaactttcgccagcgcgtgagcttgaccagggacagggacttgttcacggcccatatggatatcaggggcttgacccagggcgacaccgcgacctatttctgtgccaggcaaaagttcgagcgcgggggccagggctggatctttgacttgtgggggcgcgggaccttaatcgcggtctcgagcgcgagcccgcgcgcgcacaggagctcgcccaggagcgcg

SEQ ID NO: 57106 - RNA, 414 nt, synthetic construct
  misc_feature 1..414: note = derived and/or modified sequence opt11 from anti-HIV-1_HeavyChain
  source 1..414: mol_type = other RNA
caagcgcacctggaacagagcgggagcggggtcaagaaaccgggcgcgagcgtgcgcgtgagctgttggacgagcgaggacatattcgagcgcacggaactgatccattgggtgcgccaggccccgggacagggcctggaatggatcgggtgggtgaaaccggtcacgggcgcggtcaatctcgcgcccaatttcaggcacagggtctcgctcacgcgcgatcgcgatctctttaccgcgcacatggacatacgcgggctcacgcaaggggacacggccacatacttttgcgcgcgccagaaatttgaaaggggcgggcaagggtggtatttcgatctctggggcaggggcacgctcatagtcgtgagctcggcctcgaccaagggcccgagcgtgttcccgcacgatctcaga

SEQ ID NO: 57107 - RNA, 417 nt, synthetic construct
  misc_feature 1..417: note = derived and/or modified sequence opt11 from anti-HIV-1_HeavyChain
  source 1..417: mol_type = other RNA
caggcccatctcgaacaatcgggctcgggcgtgaaaaagcccggggcctcggtcagggtctcgtgctggagctcggaagatatctttgaaaggaccgagctcatacactgggtcaggcaagcgcccgggcaagggctcgagtggataggatgggtcaaggccgtaagcggggccgtgaactatggatcgctcgatttcaggcacagggtctcgctcacgcgcgatagagatctctcgaccgcgcacatggacatacgcgggctcacgcaagacgacacggccacgtacttttgcgcgcgccagaaatttgccaggggcgatcaagggtggtttttcgatctatggggcaggggcacgctcatagtcgtgagctcggcctcgaccaagggcccgagcgtgttcccgcacgatctcagg

SEQ ID NO: 57108 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgcgtaagctgttggacgagcgaggacatattcgagagatcggaactgatccattgggtgcgccaggccccgggccagggcctggaatggatcgggtgggtgaaaacggtcacgggcgcggtcaatttcgggagcccgaactttcgacagcgagtgagcttgaccagggacagggacttgttcacggcccatatggatatcaggggcttgacccagggcgataccgcgacctatttctgtgccaggcaaaagttctatgccgggggccagggctggtactttgacttgtgggggcgcgggaccttgatcgtggtctcgagcgcgagcacgaaagcgcacaggagctcgcccaggagcacg

SEQ ID NO: 57109 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgcgtgagctgttggacgagcgaggacatattcaagagcgagctcatacactgggtcaggcaagcgcccgggcaagggctcgagtggataggctgggtcaagaccgtgaccggggccgtgaactttggctcgagcgatttcaggcaaagggtctcgctcacgcgagatcgcgatctctttaccgcgcacatggacatacgagggctaacgcaaggggacacggccacgtacttttgcgcgcgccagaaattttacgcgggcgggcaagggtggtatttcgatctatggggcaggggcacgctaatagtagtgagctcggcctcgaccaagggcccgagcgtgttcccgaccatatgcgta

SEQ ID NO: 57110 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaactgggcgcgagcgtgcgcgtgagctgttggacgagcgaggacatattcaagaccgagctcatacactgggtcaggcaagcgcccgggcaagggctcgagtggataggctgggtcaaggccgtgagcggggccgtgaactatggctcgctcgatttcaggcacagagtctcactcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcggcctcgaccaaaggcccgagcgtgttcccgcacgatctaagg

SEQ ID NO: 57111 - RNA, 417 nt, synthetic construct
  misc_feature 1..417: note = derived and/or modified sequence opt11 from anti-HIV-1_HeavyChain
  source 1..417: mol_type = other RNA
caagcacacttggaacagagcgggagcggggtcaagaaaccgggagcgagcgtgcgagtgagctgttggacgagcgaggacatattcgagaaatcggaattgatccattgggtgcgccaggccccgggccagggcttggaatggatcgggtgggtgaaaacggtcacgggcgcggtcaatttcgggagctcggactttcgccagcgagtgagcttgaccagggacagggacttgttcacggcccatatggatatcaggggcctgacccagggcgataccgcgacatatttctgtgccaggcaaaagttctatgcagggggccagggctggtactttgacctgtgggggagagggaccttgatcgtggtctcgagcgcgagcacgaaagggccctcggtatttcccacgatctatgtc

SEQ ID NO: 57112 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccgggacctcggtcagggtctcgtgctggacctcggaagatatctttgaaagaaccgagctcatacactgggtcaggcaagcgcccgggcaagggctcgagtggataggctgggtcaagaccgtgaccggggccgtgaacttcggctcgcccaatttcaggcacagggtctcgctaacacgcgatcgcgatctatttaccgcgcacatggacatacgagggctcacgcaaggggacacggccacgtacttttgcgcgcgccagaaatttgccaggggcgatcaagggtggtttttcgatctctggggcaggggcacgctcatagtcgtaagctcggcctcgaccaagggcccgagcgtgttcccgaccatatgcgta

SEQ ID NO: 57113 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatcttcgaaaagagcgagctcatacactgggtcagacaagcgccagggcaagggctcgagtggataggctgggtcaaaaccgtgaccggggccgtgaactttggctcgagcgatttcaggcaaagggtctcgctcacgcgcgatcgcgatctatttaccgcgcacatggacatacgcgggctcacgcaaggggacacggccacgtacttttgcgcgcgccagaaattttacgcgggcgggcaagggtggtatttcgatctctggggcagaggcacgctcatagtcgtgagctcggcctcgaccaagggcccgagcgtgttcccgcaaatatacgtg

SEQ ID NO: 57114 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcaggctcgggcgtcaaaaagcccggggcctcggtaagggtctcgtgctggacctcggaagatatctttgaaaagagcgagctcatacactgggtcaggcaaacgcccgggcaagggctcgagtggataggctgggtcaagacagtgaccggggccgtgaactttggctcgagcgatttcaggcaaagggtctcgctcacgcgagatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgaccaagggcccgagcgtgttcccgaccatatacgtg

SEQ ID NO: 57115 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcaggcgtgaaaaagccaggggcctcggtcagggtctcgtgctggacctcggaagatatctttgaaaggaccgagctaatacactgggtcaggcaagcgcccgggcaagggctcgagtggataggctgggtcaagatcgtgagcggggccgtgaactttggctcgcccaatttcaggcaaagggtctcgctcacgcgcgatcgcgatctctttaccgcgcacatgggcatacgcgggctcacgcaaggggacacggccacatacttttgcgcgcgccagaaatttgaaaggggcgggcaagggtggatattcgatctctggggcaggggcacgctcatagccgtgagctcggcctcgaccaagggcccgagcgtgttcccgaccatatacgtg

SEQ ID NO: 57116 - RNA, 417 nt, synthetic construct
  misc_feature 1..417: note = derived and/or modified sequence opt11 from anti-HIV-1_HeavyChain
  source 1..417: mol_type = other RNA
caagcacacctagaacaaagcggcagcggagtcaaaaaactaggcgcaagcgtacgcgtaagctgctggacaagcgaagacatattcgaacgcacagaactaatccactgggtacgccaagccccaggccaaggcctagaatggatcggatgggtaaaagcagtctcaggcgcagtaaactacggaagcctagacttccgacaccgcgtaagcctcaccagagacagagacctattcacagcccacatggacatcagaggcctaacccaagacgacaccgcaacctacttctgcgccagacaaaaattcgcccgaggagaccaaggctggttcttcgacctatggggacgcggaaccctaatcgtagtctccagcgcaagcacaaaaggaccctcagtcttcccccacgacctacgc

SEQ ID NO: 57117 - RNA, 417 nt, synthetic construct
  misc_feature 1..417: note = derived and/or modified sequence opt11 from anti-HIV-1_HeavyChain
  source 1..417: mol_type = other RNA
caggcgcacctggaacagagcgggagcggggtgaagaagccgggggcgagcgtgagggtaagctgttggacgagcgaggacatattcgagaggacggagttgatacattgggtgaggcaggcgccggggcaggggctggagtggatagggtgggtaaagacggtgacgggggcggtgaatttcgggagcccgaactttaggcatagggtgagcttgacgagggacagggacttgttcacggcacatatggatataagggggttgacgcagggggatacggcgacgtatttctgtgcgaggcagaagttcgagaggggggggcaggggtggatatttgacttgtgggggagggggacgttgatagcggtgagtagcgcgagcacgaaggggccaagtgtgtttccgaggagcgcggtg

SEQ ID NO: 57118 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggagtcaagaaaccgggcgcgagcgtgcgcgtgagctgttggacgagcgaggacatattcgagcgcacggaattgatccattgggtgcgacaggcaccgggccagggcttggaatggatcgggtggatgaaaatagtctcgggcgcggtcaatttcgggagcccgaactttcgccagcgcgtgagcttgaccagggacagggacttgttcacggcccatatggatatcaggggcttgacccagggcgataccgcgacctatttctgtgccaggcaaaagttcgagcgcgggggccagggatggatctttgacttgtgggggcgcgggaccttgatcgcggtctcgagcgcgagcacgaaagggccatcggtatttccccatgacttgcga

SEQ ID NO: 57119 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggagcctcggtcagagtctcgtgctggacctcggaagatatctcagaagggagcgagctcatacactgggtcaggcaagcgcccgggcaagggctcgagtggataggctgggtcaagaccgtgaccggggccgtgaactttggctcggcctatttcagacacagggtctcgctcacgcgcgatcgcgatctctttaccgcgcacatggacatacgcgggctcacgcaaggggacacggccacgtacttttgcgcgcgccagaaattttacaagggcgggcaagggtggtatttcgatctctggggcaggggcacgctaatagtcgtgagctcggcctcgaccaagggcccgagcgtgttcccgaccatatgcgtg

SEQ ID NO: 57120 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactatggctcgctcgatttcaggcacagggtctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatctcagg

SEQ ID NO: 57121 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggcgcgagcgtgcgcgtgagctgttggtcgagcgaggacatattcgagcgcacggaattgatccattgggtgcgacaggccccgggccagggcctggaatggatcgggtgggtgaaaatagtctcgggcgcggtcaatttcgggagcccgaacttccgccagcgcgtgagcttgaccagggacagggacttgttcacggcccatatggatatcaggggcctgacacagggcgataccgcgacctatttctgtgcaaggcaaaagttcgagcgcggaggccagggctggatctttgacttgtgggggcgcgggaccttgatagcggtctcgagcgcgagcacgaaagggccctcggtatttcccacgatctatgtc

SEQ ID NO: 57122 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaggcccggggcctcagtcagggtctcgtgctggacctcggaagatatctttgaaacgaccgagctcatacactgggtcagacaagcgcccgggcaagggctcgagtggataggctgggtcaagaccgtgagcggggccgtgaacttcggctcactcaatttcaggcacagggtctcgctcacgcgcgaccgagacctctttaccgcgcacatggacatacgcgggctaacgcaaggggacacggccacgtacttttgcgcgcgacagaaatttgccaggggcgatcaagggtggtttttcgatctctggggcaggggcacgctcatagtcgtgagctcggcctcgaccaagggcccgagcgtgttcccgaccatatgcgtg

SEQ ID NO: 57123 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaacccggcgcctccgtccgcgtctcctgctggacctctgaagacatcttcgaacgcaccgaactcatccactgggtccgccaagcccccggccaaggcctcgaatggatcggctgggtcaaaaccgtcaccggcgccgtcaacctcggctcccccaacttccgccaccgcgtctccctcacccgagaccgcgacctattcaccgcccacatggacatccgaggcctaacccaaggcgacacagccacctacttctgcgcccgccaaaaattcgaacgcggcggccaaggctggtacttcgacctctggggaagaggcaccctcatcgtagtctcctccgcctccaccaaaggcccctccgtcttcccccacgacctccgc

SEQ ID NO: 57124 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcaggctcgggcgtgaaaaagctcggggcctcggtcagggtctcgtgctggacctcagaagatatctttgaaaggacagagctcatacactgggtcaggcaagcgcccgggcaagggctcgagtggataggctgggtcaaggccgtgagcggggccgtgaactatggctcgctcgatttcaggcacagggtatcgctcacgcgagatcgcgatctatcgaccgcgcacatggacatacgcgggctcacgcaagatgacacggccacgtacttttgcgcgcgccagaaatttgaaaggggcgggcaagggtggatattcgatctctggggcaggggcacgctcatagccgtgagctcggcctcgaccaagggcccgagcgtgttcccgaccatatgcgtg

SEQ ID NO: 57125 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtatcgtgctggacctcggaagatatctttgaaaggacagagctcatacactgggtcaggcaagcgcccgggcaagggctcgagtggataggctgggtcaagaccgtgaccggggccgtgaactttggctcgcccaatttcaggcacagagtctcgctaacacgagatcgcgatctctttaccgcgcacatggacatacgcgggctaacgcaaggggacacggccacgtacttctgcgcgcgccagaaatttgaaaggggcgggcaagggtggtatttcgatctctggggcaggggcacgctcatagtcgtgagctcagcctcgaccaagggcccgagcgtgttcccgcacgatctcgtg

SEQ ID NO: 57126 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagagtctcgtgctggagctcggaagatatctttgaaaggaccgagctcatacactgggtcaggcaagcgcccgggcaagggctcgagtggataggctgggtcaaggccgtgagcggggccgtgaactacggctcgctcgatttcaggcacagagtctcactcacgcgcgatcgcgacctctttaccgcgcacatggacatacgcgggctcacgcaagatgacacagccacgtacttttgcgcgcgccagaaatttgccaggggcgatcaaggatggtttttcgatctctggggcaggggcacgctcatagtcgtgagctcggcctcgaccaagggcccgagcgtattcccgaccatatacgtg

SEQ ID NO: 57127 - RNA, 420 nt, synthetic construct
  misc_feature 1..420: note = derived and/or modified sequence opt11 from anti-HIV-1_HeavyChain
  source 1..420: mol_type = other RNA
caggtccatctcgagcaatcgggatcaggcgtgaaaaagccaggggccccggtaagggtatcgtgctggagcagtgaagatatatttgaaaggaccgagctaatacactgggtcaggcaagcgccagggcaagggctagagtggataggatgggtaaagacagtgacaggggccgtgaactttggatcgctagacttcaggcacaggatatcgctaacgcgagatagagatctatttacagcgcacatggacataagggggctaacgcaaggggacacggcaacgtacttttgcgcgagacagaaattttacgcgggcgggcaagggtggtatttcgatctgtggggcaggggcacgctaatagtagtgagctcggcctcgacaaaggcacatagcgtgctaccgcccaggagcagggtc

SEQ ID NO: 57128 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggagtgaaaaagcccggggccctggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacacgcgatcgcgatctctttaccgcgcacatggacatacgcgggctcacgcaaggggacacggccacgtacttctgcgcgcgccagaaattttacgcgggcgggcaagggtggtatttcgatctctggggcaggggcacgctcatagtcgtgagctcggcctcgaccaagggcccgagcgtgttcccgcacgatctcagg

SEQ ID NO: 57129 - RNA, 414 nt, synthetic construct
  misc_feature 1..414: note = derived and/or modified sequence opt11 from anti-HIV-1_HeavyChain
  source 1..414: mol_type = other RNA
caagtgcaactggtccagagcggggccgaggtcaagaaaccgggcgcgagcgtaaaagtaagctgtcaagtgagcgggtacacgctcacggaattgagcatgcactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgacagaaatttgaaaggggcgggcaagggtggtatttcgatctctggggcaggggcacgctaatagtcgtgagctcggcctcgaccaagggcccgagcgtgttcccgcacgatctaagg

SEQ ID NO: 57130 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgcgtgagctgttggacgagcgaggacatattcaagaccgagctcatacactgggtcaggcaagcgcccgggcaagggctcgagtggataggctgggtcaagatagtgagcggggccgtgaactttggctcgcccaatttcaggcaaagggtctcgctcacgcgcgatcgcgatctctttaccgcgcacatggacatacgcgggctcacgcaaggggacacggccacatacttttgcgcgcgccagaaatttgaaaggggcgggcaagggtggatattcgatctctggggcaggggcacgctcatagccgtgagctcggcctcgaccaagggcccgagcgtgttcccgcacgatctaagg

SEQ ID NO: 57131 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtaaaggccgtgagcggggccgtgaactatggctcgctcgatttcaggcacagggtctcgctcacgcgcgatcgcgatctctttaccgcgcacatggacatacgcgggctcacgcaagatgacacggccacgtacttttgcgcgagacagaaatttgccaggggcgatcaagggtggtttttcgatctctggggcagaggcacgctcatagtcgtgagctcggcctcgaccaagggcccgagcgtgttcccgaccatatgcgtg

SEQ ID NO: 57132 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagccaggggcctcggtcagggtctcgtgctggacctcggaagatatctttgaaaagagcgagctcatacactgggtcaggcaagcgcccgggcaagggctcgagtgggtgggctgggtcaaaaccgtgaccggggccgtgaactttggctcgagcgatttcaggcaaagggtctcgctcacgcgcgatcgcgatctatttaccgcgcacatggacatacgcgggctaacgcaaggggacacggccacgtacttttgcgcgcgccagaaattttacgcgggcgggcaagggtggtatttcgatctctggggcaggggcacgctcatagtcgtgagctcggcctcgaccaagggcccgagcgtgttcccgcacgatctcagg

SEQ ID NO: 57133 - RNA, 417 nt, synthetic construct
  misc_feature 1..417: note = derived and/or modified sequence opt11 from anti-HIV-1_HeavyChain
  source 1..417: mol_type = other RNA
caggcgcacttggagcagagcgggagcggggtgaagaagccgggggcgagcgtgagagtgagctgttggacgagtgaggacatattcgagaagagtgagttgatacattgggtgaggcaggcgccggggcaggggttggagtggatagggtgggtgaagacggtgacgggggcggtgaatttcgggagcagtgactttaggcagagggtgagcttgacgagggacagggacttgttcacggcgcatatggatataaggggattgacgcagggggatacggcgacgtatttctgtgcgaggcagaagttcgagaggggagggcaggggtggtactttgatttgtgggggagggggacgttgatagtggtgagtagcgcgagcacgaaggggccgagtgtgtttccgacgatatgtgtg

SEQ ID NO: 57134 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtcaagaaattgggcgcgagcgtgcgcgtgagctgttggacgagcgaggacatattcgagcgaacggaactgatccattgggtgcgacaggccccgggccagggcttggaatggatcggatgggtgaaagcggtctcgggagcggtcaattacgggagcttggactttcgccatcgcgtgagcttgaccagggacagggacttgagcacggcccatatggatatcaggggcctgacccaggacgataccgcgacatatttctgtgcaaggcaaaagttcgcgcgaggggaccagggctggttctttgacttgtgggggcgcgggaccttgatcgtggtctcgagcgcgagcacgaaagggccctcggtatttccacagatctgtgtc

SEQ ID NO: 57135 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcgggagcggggtcaagaaaccgggcgcgagcgtgcgcgtgagctgttggacgagcgaggacatattcgagaaatcggaattgatccactgggtgcgccaggccccgggccagggcttggaatggatcgggtgggtgaaaacggtcacaggcgcggtcaatttcgggcaccagatctcggacagggtctcgctcacgcccgatcgcgatctctttaccgcgcacatggacatacgcgggctcacacaaggggacacggccacgtacttttgcgcgcgccagaaattttacgcgggcgggcaagggtggtatttcgatctctggggcaggggaacgctcatagtcgtgagctcggcctcgaccaagggcccgagcgtgttcccgaccatatgcgtg

SEQ ID NO: 57136 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacatcggaagatatctttgaaaagagcgagctcatacactgggtcaggcgcgcgcccgggcaagggctcgagtggataggctgggtcaagaccgtgaccggggccgtgaactttggctcgagcgatttcaggcaaagggtctcgctcacgcgcgatcgcgatctctttaccgcacacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgaccaaggcccatcgctcgagcccgaccatatgcgtg

SEQ ID NO: 57137 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcaggctcgggcgtgaaaaagctcggggcctcggtcagggtctcgtgctggacctcggaagatatctttgaaaggaccgagctcatacactgggtcaggcaagcgcccgggcaaggactcgagtggataggctgggtcaaggccgtgagcggggccgtgaactatggctcgctcgatttcaggcacagggtctcgctcacgcgcgatcgcgatctctttaccgcgcacatggacatacgagggctcacgcaagatgacacggccacgtacttttgcgcgcgccagaaattcgccaggggcgatcaagggtggtttttcgatctatggggcaggggcacgctcatagtcgtgagctcggccccgaccaagggcccgagcgtgttcccgaccatatgcgtg

SEQ ID NO: 57138 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggaaggggcacgctcatagtcgtgagctcggcctcgaccaagggcccgagcgtgttcccgcaaatatacgtg

SEQ ID NO: 57139 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcaggctcgggcgtgaaaaagcccggggcctcagtcagggtctcgtgctggacctcggaagatatctttgaaaagagcgagctcatacactgggtcaggcaagcgcccgggcaagggctcgagtggataggctgggtaaagaccgtgaccggggccgtgaacttcggctcgagcgatttcaggcaaagggtctcgctaacgcgcgggcgcgatctctttaccgcgcacatggacatacgcggactcacgcaaggggacacggccacgtacttttgcgcgcgccagaaattttacgcgggcgggcaagggtggtatttcgatctctggggcaggggcacgctcatagtcgtgagctcggcctcgaccaagggaccgagcgtgttcccgaccatatgcgtg

SEQ ID NO: 57140 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaacccggcgcctccgtccgagtctcctgctggacctccgaagacatcttcgaacgcaccgaactcatccactgggtccgccaagcccccggacaaggcctcgaatggatcggctgggtcaaaaccgtcaccggcgccgtcaacttcggctcaccaaacttccgacacagagtctccctcacccgcgaccgcgacctctccaccgcccacatggacatccgcggcctcacccaagacgacaccgccacctacttctgcgcccgccaaaaattcgcccgcggcgaccaaggctggttcttcgacctctggggccgcggcaccctcatcgtcgtctcctccgcctccaccaaaggcccctccgtcttcccccacgaccacgtc

SEQ ID NO: 57141 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcctggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgacaccgcgacctatttctgtgccaggcaaaagttctatgccgggggccagggctggtactttgacttgtgggggcgcgggaccttgatcgtggtctcgagcgcgagcacgaaagggccctcggtcttcccccagatctgtgtc

SEQ ID NO: 57142 - RNA, 417 nt, synthetic construct
  misc_feature 1..417: note = derived and/or modified sequence opt11 from anti-HIV-1_HeavyChain
  source 1..417: mol_type = other RNA
caggcccatctagagcaatcgggctcgggcgtgaaaaagcccggggcctcggtcagggtctcatgctggacctcggaagatatctttgaaaggaccgagctcatacactgggtcaggcaagcgcccgggcaagggctcgagtggataggctgggtcaagatcgtgagcggggccgtgaacttcggctcgcccaatttcaggcaaagggtctcgctcacgcgcgatcgagatctatttaccgcgcacatggacatacgcgggctcacgcaaggggacacggccacgtacttttgcgcgcgacagaaatttgaaagaggcgggcaagggtggatattcgatctctggggcaggggcacgctcatagtcgtgagctcggcctcgaccaagggcccgagcgtgttcccgaccatatgcgtg

SEQ ID NO: 57143 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtaagggtctcgtgctgggcatcggaagatatctttgaaaggaccgagctaatacactgggtcaggcaagcgcccgggcaagggctcgagtggataggatgggtcaagaccgtgaccggggcagtgaactttggctcgcccaatttcaggcacagggtctcgctaacgcgcgatcgcgatctctttaccgcgcacatggacatacgcgggctcacgcaaggggacacggccacgtacttttgcgcgcgacagaaattttacgcgggcgggcaagggtggtatttcgatctctggggcaggggcacgctcatagtcgtaagctcggcctcgaccaagggcccgagcgtgttcccgcacgatctcttg

SEQ ID NO: 57144 - RNA, 417 nt, synthetic construct
  misc_feature 1..417: note = derived and/or modified sequence opt11 from anti-HIV-1_HeavyChain
  source 1..417: mol_type = other RNA
caggcccatctagagcaatcaggctcgggcgtgaaaaagccaggggcctcggtcagagtctcgtgctggacctcggaagatatcttcgaaaagagcgagctcatacactgggtcaggcaagcgcccgggcaagggctcgagtggataggatgggtcaagaccgtgacaggggccgtgaacttcggatcgagcgacttcaggcaaagggtctcgctcacgcgcgatcgcgatctctttaccgcgcacatggacataagagggctcacgcaaggggacacggccacgtacttttgcgcgcgccagaaatttgaaaggggcgggcaagggtggatattcgatctctggggcaggggcacgctcatagccgtgagctcggcctcgaccaagggcccgagcgtgttcccgcacgatctcagg

SEQ ID NO: 57145 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggagcgagcgtgcgagtgagctgttggacgagcgaggacatattcgagcgcacggaattgatccattgggtgcgccaggccccgggccagggcctggaatggatcgggtgggtgaaagcggtctcgggcgcggtaaattacgggagcttggactttcgacatcgcgtgagcttgaccagggacagggacttgagcacggcccatatggatatcaggggcttgacccaggacgatacagcgacctatttctgtgccaggcaaaagttcgcgcgcggggaccagggctggttctttgacttgtgggggcgcgggaccttgatcgtggtctcgagcgcgagcacgaaagggccctcggtctttccccatgacttgcgc

SEQ ID NO: 57146 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagagtctcgtgctggacctcggaagatatctttgaaaggagcgagctcatacactgggtcaggcaagcgcccgggcaagggctcgagtggataggctgggtcaagaccgtgaccggggccgtgaactttggctcgcccaatttcaggcacagggtctcgctcacgcgcgatcgagatctctttaccgcgcacatggacatacgcgggctcacgcaaggggacacggccacgtacttttgcgcgcgacagaaatattacgcgggcgggcaagggtggtatttcgatctctggggcaggggcacgctcatagtcgtaagctcggcctcgaccaagggcccgagcgtgttcccgaccatatgcagg

SEQ ID NO: 57147 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggagcctcggtcagagtctcgtgctggacctcggaagatatctttgaaaagagcgagctcatacactgggtcaggcaagcgcccgggcaagggctcgagtggataggctgggtcaagacagtgaccggggccgtgaactttggctcaagcgatttcaggcaaagggtctcgctcacgcgcgatcgcgatctctttacagcgcacatggacatacgcgggctcacgcaaggggacacggccacgtacttttgcgcgcgccagaaattcgaaaggggcgggcaagggtggtatttcgatctatggggcaggggcacgctcatagtcgtgagctcggcatcgaccaagggaccgagcgtgttcccgcacgatctcagg

SEQ ID NO: 57148 - RNA, 417 nt, synthetic construct
  misc_feature 1..417: note = derived and/or modified sequence opt11 from anti-HIV-1_HeavyChain
  source 1..417: mol_type = other RNA
caggcccacctcgagcaatcgggctcgggcgtgaaaaagctcggggcctcggtccgggtctcgtgctggacctcggaagacatctttgaaaggacagagctaatacactgggtcaggcaagcgccagggcaagggctagagtggataggctgggtcaaggccgtgagcggggccgtgaactatggctcgctcgatttcaggcacagggtctcgctcacgcgcgatcgcgatctctttaccgcgcacatggacatacgcggactaacgcaagatgacacggcaacgtacttctgcgcgcgccagaaatttgccaggggcgaccaagggtggtttttcgatctctggggcaggggcacgctcatagtcgtgagctcggcctcgaccaagggcccgagcgtgttcccgaccatatacgtg

SEQ ID NO: 57149 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcagtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgaccgcgatctctttaccgcgcacatggacatacgcggactcacgcaaggggacacggccacgtacttttgcgcgcgccagaaattttacaagggcgggcaagggtggtatttcgatctctggggcaggggcacgctcatagtcgtaagctcggcctcgaccaagggcccgagcgtgttcccgcacgatctcagg

SEQ ID NO: 57150 - RNA, 417 nt, synthetic construct
  misc_feature 1..417: note = derived and/or modified sequence opt11 from anti-HIV-1_HeavyChain
  source 1..417: mol_type = other RNA
caagcacacctagaacagagcggaagcggggtcaaaaaaccaggagcgagcgtacgcgtgagctgctggacaagcgaagacatattcgaacgcacagaactgatccactgggtgcgccaggccccaggccaaggcctagaatggatcggatgggtaaaaacggtcacaggcacagtcaacttcggaagcctaaacttccgccagcgcgtaagcctgaccagggacagagacctattcacagcccacatggacatcagaggcctgacccaggacgacaccgcgacctacttctgcgccaggcaaaaattcgcacgcggagaccagggctggttcttcgacctatggggacgcgggaccctaatcgtagtctcaagcgcaagcacgaaaggaccctcggtcttcccccacgacctacga

SEQ ID NO: 57151 - RNA, 417 nt, synthetic construct
  misc_feature 1..417: note = derived and/or modified sequence opt11 from anti-HIV-1_HeavyChain
  source 1..417: mol_type = other RNA
caggcccacctcgagcaatcgggctcgggcgtgaaaaagcccggggcctcggtcagggtctcgtgctggccctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgagatctctttacagcgcacatggacatacgcgggctcacgcaaggagacacggccacgtacttttgcgcgcgccagaaatttgaaaggggcgggcaagggtggatattcgatctatggggcaggggcacgctcatagccgtgagctcggcctcaaccaagggcccgagcgtgttcccgcacgatctcagg

SEQ ID NO: 57152 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagcgcccgggcgcgagcgtgcgagtgagctgttggacgagcgaggacatattcgagaccacggaattgatccattgggtgcgccaggccccgggccagggcttggaatggatcgggtgggtgaaaacggtctcgggcgcggtcaatttcgggagcttgaactttcgccatcgcgtgagcttgaccagggacagggacttgttcacggcccatatggatatcaggggcttgacccagggcgataccgcgacctatttctgtgccaggcaaaagttcgcgcgcggggaccagggctggttctttgacttgtgggggcgcgggaccttgatcgtggtctcgagcgcgagcacgaaagggccctcggtctttccccatgacttgcgc

SEQ ID NO: 57153 - RNA, 417 nt, synthetic construct
  misc_feature 1..417: note = derived and/or modified sequence opt11 from anti-HIV-1_HeavyChain
  source 1..417: mol_type = other RNA
caggcacacctagagcaaagtggaagcggagtggaaaagccaggggcatcagtaagggtgagctgctggacaagcgaagatatatttgaaaggagcgagctgatacactgggtaaggcaagcgccagggcaagggctagagtggataggatgggtaaagaccgtgacaggggcagtgaacttcggatcgccaaacttcaggcacagggtaagcctaacgagagacagagacctatttacagcgcacatggacataagagggctgacgcaaggggacacggcaacgtacttctgcgcgagacagaaatactacgcgggagggcaagggtggtacttcgatctatggggaaggggaacgctaatagtcgtgagcagcgcaagcacaaaggggccgagcgtgttcccgcacgacctaagg

SEQ ID NO: 57154 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaatagtctcaggcgcggtaaatttcgggagcccgaactttcgccagcgcgtgagcttgaccagggacagggacttgttcacggcccatatggatatcaggggcttgacccagggcgacaccgcgacctatttctgtgccaggcaaaagttcgagcgcgggggccagggctggatctttgacttgtgggggcgagggaccctgatcgcggtctcgagcgcgagcacgaaagggccctcggtctttccccatgacttgcgc

SEQ ID NO: 57155 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtaaagaaaccgggcgcgagcgtgcgcgtgagctgttggacgagcgaggacatattcgagcgcacggaactgatccattgggtgcgccaggccccgggccagggcttggaatggatcgggtgggtgaaaacggtcacgggcgcggtcaatttcgggagcccgaactttcgccatcgcgtgagcttgaccagggacaggaacttgttcacggcccatatggatatcaggggcttgacccagggcgataccgcgacctatttctgtgccagacaaaaattcgagcgcgggggccagggctggtactttgacttgtgggggcgcgggaccttgatcgtggtctcgagcgcgagcacgaaagggccctcggtctttccccatgacttgcgc

SEQ ID NO: 57156 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggatgggtcaagatcgtgagcggggccgtgaactttggctcgccaaatttcaggcaaagggtctcgctcacgcgcgatcgcgatctctttaccgcgcacatggacatacgcgggctcacgcaaggggacacggcaacatacttttgcgcgcgccagaaattttacgcgggcgggcaagggtggtatttcgatctatggggcaggggcacgctcatagtcgtgagctcggcctcgaccaagggcccgagcgtgttcccgcacgatctcagg

SEQ ID NO: 57157 - RNA, 417 nt, synthetic construct
  misc_feature 1..417: note = derived and/or modified sequence opt11 from anti-HIV-1_HeavyChain
  source 1..417: mol_type = other RNA
caggcacacctagagcaaagcggaagcggagtgaaaaagccaggggcaagcgtaagggtaagctgctggacaagcgaagacatattcgaaaggacagagctgatacactgggtaaggcaggcgccagggcaagggctagagtggataggatgggtaaagacagtgacaggggcagtgaactacggaagcctaaacttcagaagcaggataagcctgacgagggacagggacctattcacagcgcacatggacataagagggctgacgcaaggggacacggcaacgtacttctgcgcgagacagaaattcgaaaggggagggcaagggtggatattcgacctatggggaaggggaacgctaatagcagtgagcagcgcaagcacaaagggaccgagcgtgttcccgcacgacctaaga

SEQ ID NO: 57158 - RNA, 417 nt, synthetic construct
  misc_feature 1..417: note = derived and/or modified sequence opt11 from anti-HIV-1_HeavyChain
  source 1..417: mol_type = other RNA
cagagccatctcgagcaatcgggctcggccatgaaaaagcccggggcctcggtcagggtctcgtgctggacctcggaagatatctttgacacgaccgagctaatatactgggtaaggcaagcgcccgggcaagggctcgagtggataggctgggtcaagatcgtgagcgggaccgtgaactttgcctcgctagatttcaggaacaggatctcgctctcgcgcgatcgcgacctctcgaccgcgcacatggacatacgcgggctaacgcaaggggacacggccacgtacttttgcgcgagacagaaattttacgcgggcgggcaagggtggtatttcgatctctggggcagaggcacgctcatagtcgtgagctcggcctcgaccaagggcccgagcgtgttcccgcacgatctcagg

SEQ ID NO: 57159 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaacccggcgcctccgtccgcgtctcctgctggacctccgaagacatcttcgaacgcatcgaactcatccactgggtccgccaagcccccggccaaggcctcgaatggatcggctgggtcaaaaccgtcaccggagccgtcaacttcggctcccccaacttccgccaccgcgtctccctcacccgcgaccgcgacctcttcaccgcccacatggacatccgaggcctcacccaaggcgacaccgccacatacttctgcgcccgccaaaaattcgaacgcggcggccaaggctggtacttcgacctctggggccgcggcaccctaatcgtcgtctcctccgcctccaccaaaggcccctcagtcttcccccacgacctccgc

SEQ ID NO: 57160 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcaggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcaaagggtctcgctcacgcgcgatcgagatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgaccaagggaccgagcgtgttcccgcacgatctcaga

SEQ ID NO: 57161 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggatccggcgtcaaaaaacccggagcctccgtccgcgtctcctgctggtcctccgaagacatcttcgaacgcgccgaactcatccactgggtccgccaagcccccggccaaggcctcgaatggatcggctgggtcaaaaccgtcaccggcgccgtcaacttcggctcccccaacttccgccaacgcgtctccctcacccgcgaccgcgacctcttcaccgcccacatggacatccgcggcctcacccaaggcgacaccgccacctacttctgcgcccgccaaaaattcgaacgcggcggccaaggctggatcttcgacctctggggccgcggcaccctcatcgccgtctcctccgcctccaccaaaggcccctccgtcttcccccacgacctccga

SEQ ID NO: 57162 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatcaggctccggcgtcaaaaaacccggcgcatccgtccgcgtctcctgctggacctcagaagacatcttcgaacgcaccgaactcatccactgggtccgccaagcccccggccaaggcctcgaatggatcggctgggtcaaagccgtctccggcgcagtcaactacggctccctcgacttcagacaccgagtctccctcacacgcgaccgcgacctcttcaccgcccacatggacatccgcggcctcacccaagacgacacagccacctacttctgcgcccgccaaaaattcgcccgcggcgaccaaggctggttcttcgacctctggggccgcggcaccctaatcgtcgtctcctccgcctccaccaaaggcccctccgtcttcccacacgacctacgc

SEQ ID NO: 57163 - RNA, 417 nt, synthetic construct
  misc_feature 1..417: note = derived and/or modified sequence opt11 from anti-HIV-1_HeavyChain
  source 1..417: mol_type = other RNA
cagagccatctcgagcaatcgggctcggccatgaaaaagcccggggcctcggtcagggtctcatgctggacctcggaagatatctttgacacgaccgagctcatatactgggtcagacaagcgcccgggcaaggactcgagtggataggctgggtcaagatcgtgagcgggaccgtgaactttgcctcactcgatttcaggaacaggatctcgctctcgcgcgatcgcgatctctcgaccgcgcacatggacatacgcgggctcacgcaagatgacacggccacgtacttttgcgcgcgccagaaatttgaaaggggcgggcaagggtggtatttcgatctctggggcaggggcacgctcatagtcgtgagctcggcctcgaccaagggcccgagcgtgttcccgcacgatctcagg

SEQ ID NO: 57164 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggagctcggaagatatctttgaaaggaccgagctaatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgacagaaattttacgcgggcgggcaagggtggtatttcgatctctggggcaggggcacgctcatagtcgtgagctcggcctcgaccaagggcccgagcgtgttcccgcacgatctcagg

SEQ ID NO: 57165 - RNA, 417 nt, synthetic construct
  misc_feature 1..417: note = derived and/or modified sequence opt11 from anti-HIV-1_HeavyChain
  source 1..417: mol_type = other RNA
caggcccatctagagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaagatgacacggccatatacttttgcgcgcgccagaaatttgccaggggcgatcaagggtggtttttcgacctctggggcaggggcacgctcatagtcgtgagttcggcctcgaccaagggcccgagcgtgttcccgcacgatctcagg

SEQ ID NO: 57166 - RNA, 417 nt, synthetic construct
  misc_feature 1..417: note = derived and/or modified sequence opt11 from anti-HIV-1_HeavyChain
  source 1..417: mol_type = other RNA
caagcacacttggaacagagcgggagcggggtcaagggcccgggcgcgagcgtgcgagtgagctgttggacgagcgaggacatattcgagaccacggaattgatccattgggtgcgccaggccccgggccagggcttggaatggatcgggtgggtgaaaacggtctcgggcgcggtcaatttcgggagcttgaactttcgccatcgcgtgagcttgaccagagacagggacttgttcacggcccatatggatatcaggggcttgacccagggcgataccgcgacctatttctgcgccaggcaaaagttcgcgcgcggggaccagggctggttctttgacctgtgggggcgcgggaccctgatcgtggtctcgagcgcgagcacgaaagggccctcggtctttccccatgacttgcgc

SEQ ID NO: 57167 - RNA, 417 nt, synthetic construct
  misc_feature 1..417: note = derived and/or modified sequence opt11 from anti-HIV-1_HeavyChain
  source 1..417: mol_type = other RNA
caggcccacctcgagcaatcaggctcgggcgtgaaaaagcccggggcctcggtcagggtctcgtgctggacctcggaagatatctttgaagggagcgagctcatacactgggtcaggcaagcgcccgggcaaggactcgagtggataggctgggtcaagacagtgaccggggccgtgaactttggctcggcctatttcaggcacagggtcccgctcacgcgagatagagatctctttaccgcgcacatggacatacgagggctcacgcaaggggacacggccacgtacttttgcgcgcgccagaaattttacaagggcgggcaagggtggtatttcgatctctggggcaggggcacgctcatagtcgtgagctcggcctcgaccaagggcccgagcgtgttcccgcacgatctaagg

SEQ ID NO: 57168 - RNA, 417 nt, synthetic construct
  misc_feature 1..417: note = derived and/or modified sequence opt11 from anti-HIV-1_HeavyChain
  source 1..417: mol_type = other RNA
caagcacacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgacatcgcgtgagcttgaccagggacagggacttgttcacggcccatatggatatcaggggcttaacccagggagatacagcgacctatttctgtgccaggcaaaagttcgagcgcgggggccagggctggtactttgacttgtgggggcgcgggaccttgatcgtggtctcgagcgcgagcacgaaagggccctcggtctttccacatgacttgcgc

SEQ ID NO: 57169 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggatcgggagtgaaaaaggtcggggcctcggtcagggtctcgtgctggacctcagaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgaccgcgatctctttaccgcgcacatggacatacgagggctcacgcaaggagacacggccacgtacttttgcgcgcgccagaaattttacgcgggcgggcaaggatggtatttcgatctctggggcaggggcacgctcattgtcgtgagctcggcctcgaccaagggcccgagcgtgttcccgcacgatctaagg

SEQ ID NO: 57170 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggacagggcttggaatggatcgggtgggtgaaaacggtcacgggcgcagtcaatttcgggagcccgaactttcgccatcgcgtgagcttgaccagggacagggacttgttcacggcccatatggatatcaggggcttgacccaggacgataccgcgacctatttctgtgccaggcaaaagttcgcgcgcggggaccagggctggttctttgacctgtgggggcgcgggaccttgatcgtggtctcgagcgcaagcacgaaagggccatcggtctttccccatgacctgcgc

SEQ ID NO: 57171 - RNA, 417 nt, synthetic construct
  misc_feature 1..417: note = derived and/or modified sequence opt11 from anti-HIV-1_HeavyChain
  source 1..417: mol_type = other RNA
cagagccatctcgagcaatcgggctcggccatgaaaaagcccggggcctcggtcagggtctcgtgctggacatcggaagatatctttgaaaggaccgagctcatatactgggtcaggcaagcgcccgggcgcgggctagagtggataggctgggtcaagaccgtgagcgggacagtgaactttggctcgagcgatttcaggaacaggatctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatctcaga

SEQ ID NO: 57172 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgagagcggggtaaagaaattgggcgcgagcgtacgcgtgagctgttggacgagcgaggacatattcgagcgcacggaattgatccattgggtgcgccaggccccgggccagggattggaatggatcgggtgggtgaaagcggtatcgggcgcggtcaattacgggagcttggactttcgccatcgcgtgagcttgaccagggacagggacttgttcacggcccatatggatatcaggggcctgacccaggacgataccgcgacctatttctgtgccaggcaaaagttcgcgcgcggggaccagggctggttctttgacttgtgggggcgcgggaccttgatcgtggtatcgagcgcgagcacgaaagggccctcggtctttccccatgacttgcgc

SEQ ID NO: 57173 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctaacgcgcgatcgcgatctctttaccgcgcacatggacatacgagggctcacgcaaggggacacggccacgtacttttgcgcgcgccagaaattttacgcgggcgggcaagggtggtatttcgatctctggggcaggggaacgctaatagtcgtgagctcggcctcgaccaagggcccgagcgtgttcccgaccacgctcagg

SEQ ID NO: 57174 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcaggcgtgaaaaaggtcggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgaccaagggcccgagcgtgttcccgcacgatctcagg

SEQ ID NO: 57175 - RNA, 420 nt, synthetic construct
  misc_feature 1..420: note = derived and/or modified sequence opt11 from anti-HIV-1_HeavyChain
  source 1..420: mol_type = other RNA
caagcgcgcccgggcgcgaacaggggctcgggcgtgaaaaagcccggggcctcggtcagggtctcgtgctggacctcagaagatatctttgaaaggaccgagctcatacactgggtcaggcaagcgcccgggcaagggctcgagtggataggctgggtcaagatcgtgagcggggccgtgaactttggctcgcccaatttcaggcaaagggtctcgctcacgcgagatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcggcctcaacaaagggcccgagcgtgttcccgcacgatctcagg

SEQ ID NO: 57176 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaacccggcgcctccgtacgcgtctcctgctggacctccgaagacatcttcgaacgctccgaactcatccactgggtccgccaagccccaggccaaggcctagaatggatcggctgggtcaaaaccgtcaccggcgccgtcaacttcggctcccccaacttccgccaccgcgtctccctcacccgcgaccgagacctcttcaccgcccacatggacatccgcggcctcacccaaggcgacaccgccacctacttctgcgcccgccaaaaatactacgcaggcggccaaggctggtacttcgacctctggggccgcggcaccctcatcgtagtctcctccgcctccaccaaaggaccctcagtcttcccccacgacctccgc

SEQ ID NO: 57177 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcagaagatatctttgaagggagcgagctcatacactgggtcaggcaagcgcccgggcaagggctcgagtggataggctgggtcaagaccgtgaccggggccgtgaactttggctcggcctatttcaggcacagggtctcgctaacgcgcgatcgcgatctctttaccgcgcacatggacatacgagggctcacgcaaggggacacggccacgtacttttgcgcgcgccagaaattttacaagggcgggcaagggtggtatttcgatctctggggcaggggcacgctcatagtcgtaagctcggcctcgaccaagggcccgagcgtgttcccgcacgatctcagg

SEQ ID NO: 57178 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagctcggggcctcggtcagggtctcgtgctggacctcggaagatatctttgaaaggaccgagctcatacactgggtcagacaagcgcccgggcaagggctcgagtggataggctgggtcaaggccgtaagcggggcagtgaactatggctcactcgatttcaggcacagggtctcgctcacgcgcgaccgcgatctctcgaccgcgcacatggacatacgcgggctcacgcaagatgacacggccacgtacttttgcgcgcgccagaaatttgccaggggcgatcaagggtggtttttcgatctctggggcaggggcacactcatagtcgtgagctcggcctcgaccaagggcccgagcgtgctcccgcccaggagcgcg

SEQ ID NO: 57179 - RNA, 417 nt, synthetic construct
  misc_feature 1..417: note = derived and/or modified sequence opt11 from anti-HIV-1_HeavyChain
  source 1..417: mol_type = other RNA
caggcacacctagagcaaagcggatcaggcatgaaaaagccaggggcatcagtaagggtaagctgctggagctcggaagacatctttgaaaggacagagctaatacactgggtcagacaagcgccagggcaagggctagagtggataggatgggtaaagacagtgacaggggcagtgaacttcggctcgagcgacttcaggcaaagggtatcgctaacgcgcgaccgagacctattcaccgcgcacatggacataagagggctaacgcaaggggacacggcaacgtacttctgcgcgcgccagaaattttacgcgggagggcaagggtggtacttcgacctctggggaaggggaacgctaatagtagtgagcagcgccagcaccaaaggaccgagcgtgttcccgcacgacctcagg

SEQ ID NO: 57180 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcaggcgtgaaagagcccgggacctcggtcagggtatcgtgctggacctcggaagatatctttgaaaggaccgagctcatacactgggtcaggcaagcgcccgggcaagggctcgagtggataggctgggtcaagaccgtgaccggggccgtgaacttcggctcgcccaatttcagacacagggtctcgctcacacgcgaccgcgacctcttcaccgcgcacatggacatacgcgggctaacgcaaggggacacggccacgtacttttgcgcgagacagaaatttgaaaggggcgggcaagggtggatattcgatctctggggcaggggcacgctcatagccgtgagctcggcctcgaccaagggcccgagcgtattcccgcaaacgctcagg

SEQ ID NO: 57181 - RNA, 417 nt, synthetic construct
  misc_feature 1..417: note = derived and/or modified sequence opt11 from anti-HIV-1_HeavyChain
  source 1..417: mol_type = other RNA
caatcccacctcgaacaatccggctccgccatgaaaaaacccggcgcctcagtccgcgtctcatgctggacatccgaagacatcttcgacaccaccgaactcatctactgggtccgccaagcccccggccaaggcctcgaatggatcggctgggtaaaaatcgtctccggcaccgtcaacttcgcctccctcgacttccgccaccgagtctccctcacccgcgaccgcgacctctcaaccgcccacatggacatccgcggcctcacccaagacgacaccgccacctacttctgcgcccgccaaaaattcgcccgcggcgaccaaggctggttcttcgacctctggggccgaggcaccctaatcgtcgtctcctccgcctccaccaaaggcccctccgtcttcccccacgacctccgc

SEQ ID NO: 57182 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggagtcaaaaaacccggcgcctccgtccgcgtctcctgctggacctccgaagacatcttcgaaaccaccgaactcatccactgggtccgccaagcccccggccaaggactagaatggatcggctgggtcaaaaccgtctccggcgccgtcaacttcggctccctcaacttccgccaccgcgtctcactcacacgcgaccgcgacctcttcaccgcccacatggacatccgcggcctcacccaaggcgacaccgccacctacttctgcgcacgacaaaaattcgcccgcggcgaccaaggctggttcttcgacctctggggccgcggcacactcatcgtcgtctcctccgcctccaccaaaggcccctccgtcttcccccacgacctccgc

SEQ ID NO: 57183 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaagtcggcgcctcagtccgcgtctcctgctggacctcagaagacatcttcgaacgcaccgaactcatccactgggtccgccaagcccccggccaaggcctcgaatggatcggctgggtcaaaaccgtcaccggcgccgtcaacttcggctcccccaacttccgccaccgagtctccctcacccgcgaccgagacctcttcaccgcccacatggacatccgcggcctcacccaaggcgacaccgccacctacttctgcgcccgccaaaaattcgaacgcggcggacaaggctggtacttcgacctatggggccgcggcaccctcatcgtcgtctcatcagcctccaccaaaggcccctccgtcttcccacacgacctccga

SEQ ID NO: 57184 - RNA, 417 nt, synthetic construct
  misc_feature 1..417: note = derived and/or modified sequence opt11 from anti-HIV-1_HeavyChain
  source 1..417: mol_type = other RNA
caggcccacctagagcaatcgggagcgggagtgaaaaagcccggggcatcggtcagggtatcgtgctggacctcggaagatatctttgaaaggacagagctaatacactgggtcaggcaagcgcccgggcaagggctagagtggataggctgggtaaagacagtgagcggggccgtgaactttggctcacccaatttcaggcacagggtctcgctaacgcgcgatcgcgatctatttaccgcgcacatggacatacgggggctaacgcaaggggacacggcaacgtacttttgcgcgcgacagaaatttgaaaggggagggcaagggtggtatttcgatctatggggcaggggcacgctaatagtagtgagctcggcctcaaccaagggcccgagcgtgttcccgcacgatctaagg

SEQ ID NO: 57185 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactatggctcgctcaatttcagaagcaggatctcgctcacgcgcgatcgagatctctttaccgcgcacatggacatacgcgggctaacggaaggggacacggccacgtacttttgcgcgcgccagaaattttacgcgggcgggcaagggtggtatttcgatctctggggcaggggcacgctcatagtcgtgagctcggcctcgaccaagggcccgagcgtgttcccgcacgatctcagg

SEQ ID NO: 57186 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtcaagaaaccaggcgcgagcgtgcgcgtaagctgtctcgcgagcgaggacatattcgagcgcacggaattgatccattgggtgcgccaggccccgggccagggcttggaatggatagggtgggtgaaaacggtcacgggcgcggtcaatttcgggagcccgaactttcgccatcgcgtgagcttgaccagggacagggacctgttcacggcccatatggatatcagaggcttgacccagggcgatacagcgacctatttctgtgccaggcaaaagttcgagcgcgggggccagggctggtactttgacttgtgggggcgcgggaccctgatcgtggtctcgagcgcgagcacgaaagggccctcggtctttccccatgacttgcgc

SEQ ID NO: 57187 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggagctcggaagatatctttgaaaggaccgagctcatacactgggtcaggcaagcacccgggcaagggctagagtggataggctgggtcaagaccgtgaccggggccgtgaactttggctcgctcgatttcagacacaggatctcgctcacgcgagatcgcgatctctttaccgcgcacatggacatacgagggctcacgcaaggggacacggccacgtacttttgcgcgcgccagaaatttgaaaggggcgggcaagggtggatattcgatctatggggcaggggcacgctaatagccgtgagctcggcctcgaccaagggcccgagcgtgttcccgcacgatctaagg

SEQ ID NO: 57188 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacaaagcgggagcggggtaaagaaaccgggcgcgagcgtgcgagtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccagcgcgtgagcttgaccagggacagggacttgttcacggcccacatggatatcaggggcttaacacagggcgataccgcgacctatttctgtgccaggcaaaagttcgagcgcgggggccagggctggtactttgacttgtgggggcgagggaccttgatcgtggtctcgagcgcaagcacgaaagggccctcggtctttccccatgacttgcgc

SEQ ID NO: 57189 - RNA, 417 nt, synthetic construct
  misc_feature 1..417: note = derived and/or modified sequence opt11 from anti-HIV-1_HeavyChain
  source 1..417: mol_type = other RNA
caagtacacctagaacagagcggaagcggagtcaaaaaaccaggcgcgagcgtacgcgtgagctgctggacaagcgaagacatattcgaacgcacagaactaatccactgggtacgccaggccccaggccaaggcctagaatggatcggatgggtaaaaacagtcacaggcgcagtcaacttcggaagcccaaacttccgccaccgcgtaagcctaaccagagacagggacctattcacagcccacatggacatcagaggcctaacccaaggcgacaccgcaacatacttctgcgccagacaaaaattcgaacgcggaggccagggctggtacttcgacctgtggggacgcggaaccctaatcgtagtctcaagcgcaagcacaaaaggaccctcagtcttcccccacgacctacgc

SEQ ID NO: 57190 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtctcaggcgcggtcaatttcgggagcccgaactttcgccagcgcgtgagcttgaccagggacagggacttgttcacggcacatatggatatcaggggcttgacccagggcgataccgcgacctatctctgtgccaggcaaaagttcgagcgcgggggccagggctggatctttgacttgtgggggcgcgggaccttgatcgcggtctcaagcgcgagcacgaaagggccctcggtatttccccatgacttgcgc

SEQ ID NO: 57191 - RNA, 417 nt, synthetic construct
  misc_feature 1..417: note = derived and/or modified sequence opt11 from anti-HIV-1_HeavyChain
  source 1..417: mol_type = other RNA
cagagccacctcgagcaatcgggctcggccatgaaaaagcccggggcctcggtcagggtctcgtgctggacatcggaagatatctttgaaaggaccgagctcatatactgggtcagacaagcgcccgggcgcgggctcgagtggataggctgggtaaagaccgtgagcgggaccgtgaactttggctcgagcgatttcaggcacagggtctcgctaacgcgcgatcgcgatctctttaccgcgcacatggacatacgcggactcacgcaaggggacacggccacgtacttttgcgcgcgacagaaattttacaagggcgggcaagggtggtatttcgatctctggggcaggggcacgctaatagtcgtgagctcggcctcgaccaagggcccgagcgtgttcccgcacgatctcagg

SEQ ID NO: 57192 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggagtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcccgatcgcgatctctttaccgcgcacatggacatacgagggctcacgcaaggggacacggccacgtacttttgcgcgcgccagaaattctacgcgggcgggcaagggtggtatttcgatctatggggcaggggcacgctcatagtagtgagctcggcctcgaccaagggctcgagcgtgttcccgcacgatctcagg

SEQ ID NO: 57193 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcatcggtcagagtctcgtgctggacctcggaagatatctttgaaaagagcgagctcatacactgggtcaggcaagcgcccgggcaaggactcgagtggataggctgggtcaagacagtgaccggggccgtgaactttggctcgagcgatttcaggcaaagagtctcgctcacgcccgatcgagatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcaaccaagggcccgagcgtgttcccgcacgatctcagg

SEQ ID NO: 57194 - RNA, 417 nt, synthetic construct
  misc_feature 1..417: note = derived and/or modified sequence opt11 from anti-HIV-1_HeavyChain
  source 1..417: mol_type = other RNA
caggcgcacctagagcaaagcggaagcggagtgaaaaagctaggggcaagcgtaagggtaagctgctggacaagcgaagacatattcgaaaggacagagctaatacactgggtaagacaagcgccagggcaagggctagagtggataggatgggtaaaggcagtgagcggggcagtgaactacgggagcctagacttcaggcacagagtaagcctaacgagggacagagacctaagcacagcgcacatggacataagaggactaacgcaagacgacacggcaacgtacttctgcgcgagacagaaattcgcaaggggagaccaagggtggttcttcgacctatggggaaggggaacgctaatagtagtgagcagcgcaagcacaaagggaccgagcgtgttcccgcacgacctgagg

SEQ ID NO: 57195 - RNA, 417 nt, synthetic construct
  misc_feature 1..417: note = derived and/or modified sequence opt11 from anti-HIV-1_HeavyChain
  source 1..417: mol_type = other RNA
caagtacacctcgaacaaagcggcagcggagtcaaaaaactaggcgcatccgtacgcgtcagctgctggacaagcgaagacatattcgaacgcacagaactaatccactgggtccgccaagccccaggccaaggcctagaatggatcggctgggtaaaagcagtctcaggcgcagtcaactacggcagcctcgacttccgccaccgcgtcagcctaaccagagacagagacctcttcacagcccacatggacatccgcggcctgacccaagacgacaccgcaacctacttctgcgccagacaaaaattcgcccgcggagaccaaggctggttcttcgacctatggggacgcggaaccctaatcgtagtatcaagcgccagcacaaaaggaccctcagtcttcccccaccgctcaacc

SEQ ID NO: 57196 - RNA, 420 nt, synthetic construct
  misc_feature 1..420: note = derived and/or modified sequence opt11 from anti-HIV-1_HeavyChain
  source 1..420: mol_type = other RNA
caggtgtatatggagcaggcgggggcgggggtgaaaaagccgggggcgtcggtgacgctgagttgcaagacggcggacgaggacgtgttcgatgcggcgtacatgcactgggtaagacaggcgccggggcagacgttcgagtggttgggatggatgaagccggtgacaggggcagtgagctatgcgaggaaatttcaggggagggtgagcttttacatgacaagggagttggggatggcatatatggatctgaggaacctgagatttgacgatacggcggtatatttctgtgcaaggaagacggcgggggacgtgagcggggacaatagagggtactttttcgatctatgggggaggggaagtagagtgatagtgagcagtgcgagtacgaaggggccgagcgtattcacgatatatgta

SEQ ID NO: 57197 - RNA, 417 nt, synthetic construct
  misc_feature 1..417: note = derived and/or modified sequence opt11 from anti-HIV-1_HeavyChain
  source 1..417: mol_type = other RNA
caggcacatctcgagcaatcgggctcaggcgtgaaaaagctcggggcctcggtaagggtctcatgctggacctcggaagatatctttgaaagaaccgagctcatacactgggtcaggcaagcgcccgggcaagggctcgagtggataggctgggtcaaggccgtgagcggggccgtgaactacggctcgctcgatttcaggcacagggtctcgctcacgcgcgatcgcgatctctttaccgcgcacatggacatacgcgggctaacgcaagatgacacggccacgtacttttgcgcgcgccagaaatttgccaggggcgatcaagggtggtttttcgatctctggggcaggggcacgctcatagtcgtgagctcggcctcgacaaagggcccgagcgtgttcccgcacgatcccgcg

SEQ ID NO: 57198 - RNA, 417 nt, synthetic construct
  misc_feature 1..417: note = derived and/or modified sequence opt11 from anti-HIV-1_HeavyChain
  source 1..417: mol_type = other RNA
caagcacacttggaacagagcggaagcggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtcaattacgggagcttggactttcgccatcgcgtgagcttgaccagggacagggacttgagcacggcccatatggatatcagaggcttgacccaggacgataccgcgacctatttctgtgccaggcaaaagttcgcgcgcggggaccagggctggttctttgacttgtgggggcgcgggaccttgatcgtggtctcgagcgcgagcacgaaagggccctcggtcttgcccccgcgctcgacc

SEQ ID NO: 57199 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtcaagaaaccgggcgcgagcgtgcgcgtgagctgttggtcgagcgaggacatattcgagcgcacagaattgatccattgggtgcgacaggccccgggccagggcttggaatggatcgggtgggtgaaagcggtctcgggagcggtcaattacgggagcttggactttcgccaccgcgtgagcttgaccagggacagggacttgttcacggcccatatggatatcaggggcctgacccaggacgataccgcgacctatttctgtgccagacaaaagttcgcgcgcggggaccagggctggttctttgacttgtgggggcgcggaaccttgatcgtggtctcgagcgcgagcacgaaagggccctcggtctttccccatgacctacga

SEQ ID NO: 57200 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcgagtggaagaaattgggcgcgagcgtgcgcgtgagctgctggacgagcgaggacatattcgagcgcacggaattgatccattgggtgcgccaggccccgggccagggcctggaatggatcgggtgggtgaaagcggtctcgggcgcggtcaattacgggagcttggactttcgccatcgcgtgagcttgaccagggacagggacctgagcacggcccatatggatatcaggggcctgacccaggacgataccgcgacctatttctgtgccaggcaaaagttcgcgcgcggggaccagggctggttctttgacttatggggacgcgggaccctgatcgtggtctcgagtgcgagcacgaaagggccctcggtctttccacatgacttgcgc

SEQ ID NO: 57201 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcggaagtgaaaaagcccggggcctcggtcagggtctcgtgctggacctcggaagatatctttgaaaagagcgagctcatacactgggtcaggcaagcgcccgggcaagggctagagtggataggctgggtcaagaccgtgaccggggccgtgaactttggctcgagcgatttcaggcaaagggtctcgctcacgcgagatcgcgatctctttaccgcgcacatggacatacgcgggctcacgcaaggggacacggcaacgtacttttgcgcgcgccagaaattttacgcgggcgggcaagggtggtatttcgatctctggggcagaggcacgctcatagtcgtgagctcggcctcgacaaagggaccgagcgtgttcccgcacgatctcagg

SEQ ID NO: 57202 - RNA, 417 nt, synthetic construct
  misc_feature 1..417: note = derived and/or modified sequence opt11 from anti-HIV-1_HeavyChain
  source 1..417: mol_type = other RNA
caggcccatctagagcaatcaggctcgggcgtgaaaaagctcggggcctcggtcagggtctcgtgctggacctcggaagatatctttgaaaggaccgagctcatacactgggtcaggcaagcgcccgggcaagggctagagtggataggctgggtcaagaccgtgaccggggccgtgaacttcggctcgcccaatttcagacacagggtctcgctcacgcgcgatcgcgatctatttaccgcgcacatggacatacgagggctcacgcaaggggacacggccacgtacttttgcgcgcgccagaaatttgaaaggggcgggcaaggatggtatttcgacctctggggcaggggcacgctcatagtcgtgagctcggcctcgaccaagggcccgagcgtgttcccgcacgatctcagg

SEQ ID NO: 57203 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatcttgcgcaagagcgagctcatacactgggtcaggcaagcgcccgggcaaggactcgagtggataggctgggtcaagaccgtgaccggggccgtgaactttggctcgagcgatttcaggcaaagagtctcgctcacgcgcgatcgcgatctctttacagcgcacatggacatacgcgggctcacgcaaggggacacggccacgtacttttgcgcgcgccagaaattctacgcgggcgggcaagggtggtatttcgatctctggggcaggggcacgctcatagtcgtgagctcggcctcgaccaagggcccgagcgtgttcccgcacgatctcagg

SEQ ID NO: 57204 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgcgagcggggtcaagcgcccgggcgcgagcgtgcgcgtgagctgtctcgcgagcgaggacatattcgagcgatcggaattgatctattgggtacgccaggccccgggccagggcttggaatggatcgggtgggtgaaaatagtctcaggcgcggtcaatttcgggagcccgaactttcgccagcgcgtgagcttgaccagggacagggacttgttcacggcccatatggatatcaggggcttgacccagggcgataccgcgacctatttctgtgccaggcaaaagttcgagcgcgggggccagggctggatctttgacttgtgggggcgcgggaccttgatcgcggtctcgagcgcgagcacgaaagggccctcggtctttccccatgacttgcgc

SEQ ID NO: 57205 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaagacccggcgcctccgtccgcgtctcatgctggacctccgaagacatcttcgaaaccaccgaactcatccactgggtccgccaagcccccggccaaggcctcgaatggatcggctgggtcaaaaccgtcaccggcgccgtaaacttcggctccgcctacttccgccaccgagtctccctcacccgcgaccgcgacctattcaccgcccacatggacatccgcggcctcacccaaggcgacacagccacctacttctgcgcccgccaaaaattctacaaaggcggccaaggctggtacttcgacctctggggccgcggcacactcatcgtcgtctcatccgcctccaccaaaggcccctcagtcttcccccacgacctccgc

SEQ ID NO: 57206 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgcgagcggggtcaagcgcccgggcgcgagcgtacgcgtgagctgttggacgagcgaggacatattcgagcgctcggaattgatctattgggtgcgccaggccccgggacagggcttggaatggatcgggtgggtgaaaacggtctcgggagcggtcaatttcgggagcacggactttcgccatcgcgtgagcttgaccagggacagggacttgttcacggcacatatggatatcaggggcttgacccagggcgataccgcgacctatttctgtgccaggcaaaagttcgagcgcgggggccagggctggtactttgacttgtgggggcgcgggaccttgatcgtggtctcgagcgcgagcacgaaagggccctcggtctttccccatgacttgcga

SEQ ID NO: 57207 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaattgggcgcgagcgtgcgcgtgagctgttggacgagcgaggacatattcgagcgcacggaactgatccattgggtgcgccaggccccgggccagggcttggaatggatcgggtgggtgaaagcggtctcgggcgcggtcaattacgggagcttggactttcgccatcgcgtgagcttgaccagggacagagacttgagcacggcccatatggatatcagaggcttgacacaggacgataccgcgacctatttctgtgccaggcaaaagttcgcgcgcggggaccagggctggttctttgacttgtgggggcgcgggaccttgatcgtggtctcgagcgcgagcacgaaagggccctcgggcttgcccccgcgctcggcc

SEQ ID NO: 57208 - RNA, 417 nt, synthetic construct
  misc_feature 1..417: note = derived and/or modified sequence opt11 from anti-HIV-1_HeavyChain
  source 1..417: mol_type = other RNA
cagagccatctcgagcaatcgggctcggccatgaaaaagcccggggcatcggtcagggtctcgtgctggacctcggaagatatctttgacacgaccgagctcatatactgggtcaggcaagcgcccgggcaagggctcgagtggataggctgggtcaagatcgtgagcgggaccgtgaactttgcctcgctcgatttcaggaacaggatatcgctttcgcgcgatcgcgatctctcgaccgcgcacatggacatacgagggctcacgcaaggggacacggccacgtacttttgcgcgcgccagaaatttgaaaggggcgggcaagggtggatattcgatctctggggcaggggcacgctcatagccgtgagctcggcctcgaccaagggcccgagcgtgttcccgctcaggagcgcg

SEQ ID NO: 57209 - RNA, 423 nt, synthetic construct
  misc_feature 1..423: note = derived and/or modified sequence opt11 from anti-HIV-1_HeavyChain
  source 1..423: mol_type = other RNA
caggtacagatggagcaagcgggcgcgggaatgaaaaagcccggggcctcgatgacggtctcgtgcaagacagcggacgaggacatattcgatgccgcgtacatgcactgggtcaggcaagcgcccgggcaaacgttcgagtggctgggctggatgaagcccgtgaccggggccgtgaactatgcaaggcaatttcaagggcgcgcgagcttttacaggacaagagaattgggcatagcatatatggatctcagagacttgaaatttgacgatacagcggtatatttctgtgccaggaaaacgaaaggggacgtgagcggggacgatagagggttctttttcgatctatggggaaggggaacgcgcgtgatcgtgagctcggcatcaaccaagggaccgagcgtgttcccgcacgatctaaga

SEQ ID NO: 57210 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagccaggggcctcagtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgagggctcacgcaaggggacacggccacgtacttttgcgcgcgccagaaattttacaagggcgggcaaggatggtatttcgatctctggggcaggggcacgctcatagtcgtgagctcggcctcaaccaagggcccgagcgtgttcccgcaaatatgcagg

SEQ ID NO: 57211 - RNA, 414 nt, synthetic construct
  misc_feature 1..414: note = derived and/or modified sequence opt11 from anti-HIV-1_HeavyChain
  source 1..414: mol_type = other RNA
caagcgcacttggaacagagcggggccggggtcaagaaaccgggcgcgagcgtgcgcgtgagctgttggacgagcgaggacatattcgagaaatcggaattgatccattgggtgcgccaggccccgggccagggcctggaatggatcgggtgggtgaaaacggtcacgggcgcggtcaatctcgtgcaccagatctcggacagggtctcgctcacgcgcgatcgcgatctctcaaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatctcagg

SEQ ID NO: 57212 - RNA, 420 nt, synthetic construct
  misc_feature 1..420: note = derived and/or modified sequence opt11 from anti-HIV-1_HeavyChain
  source 1..420: mol_type = other RNA
caagcgcacttggaacagagcggaagcggggtcaagaaattgggcgcgagcgtgcgcgtgagctgttggacgagcgaggacatattcgagcgcacggaattgatccattgggtgcgacaggccccgggccagggcttggaatggatcgggtgggtgaaagcggtctcgggcgcggtcaattacgggagcctggactttcgccatcgcgtgagcttgaccagggacagggacttgagcacggcccatatggatatcaggggcttgacccaggacgataccgcgacctatttctgtgccagacaaaagttcgcgagaggggaccagggctggttctttgacttgtgggggcgagggaccttgatagtggtctcgagcgcgagcacgaaagggccctcgggcttgccaccgcgcttgtgcgta

SEQ ID NO: 57213 - RNA, 417 nt, synthetic construct
  misc_feature 1..417: note = derived and/or modified sequence opt11 from anti-HIV-1_HeavyChain
  source 1..417: mol_type = other RNA
caggccaggctcgagcaatcgggctcgggcgtgaaaaagcccggggcctcggtcagggtctcgtgctggacctcggaagatatctttgaagggagcgagctcatacactgggtcaggcaagcgcccgggcaagggctcgagtggataggctgggtcaagaccgtgaccggggccgtgaacttcggctcggcctatttcaggcacagggtctcgctaacgcgcgatcgcgatctctttaccgcgcacatggacatacgcgggctcacgcaaggggacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatagcgca

SEQ ID NO: 57214 - RNA, 414 nt, synthetic construct
  misc_feature 1..414: note = derived and/or modified sequence opt11 from anti-HIV-1_HeavyChain
  source 1..414: mol_type = other RNA
caagtgcaattggtccagagcggggccgaggtcaagaaaccgggctcgagcgtgaaagtgagctgtaaagtgagcgggggcgtgttcacgagctatgccgtgacctgggtcagacaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccatatacttttgcgcgcgacagaaatttgccaggggagatcaagggtggtttttcgatctctggggcaggggcacgctcatagtcgtgagctcggcctcgaccaagggcccgagcgtgttcccgcacgatctcagg

SEQ ID NO: 57215 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggagtgaaaaagcccggggcctcggtcagggtctcgtgctggacctcggaagatatctttgaaaggaccgagctcatacactgggtcaggcaagcgcccgggcaaggactcgagtggataggctgggtaaagaccgtgagcggggccgtgaactttggctcgcccaatttcaggcaaagggtctcgctcacgcgcgatcgcgatctctttaccgcgcacatggacatacgcgggctaacgcaaggggacacggccacgtacttttgcgcgcgccagaaatttgaaaggggcgggcaagggtggatattcgatctatggggcaggggcacgctaatagccgtgagctcggcctcgaccaagggcccgagcgtgttcccgcacgatctcagg

SEQ ID NO: 57216 - RNA, 417 nt, synthetic construct
  misc_feature 1..417: note = derived and/or modified sequence opt11 from anti-HIV-1_HeavyChain
  source 1..417: mol_type = other RNA
caatcccacctcgaacaatccggctccgccatgaaaaaacccggcgcctccgtcaccgtctcctgctggacctcagaagacatcttcgacacaaccgaactcatctactgggtccgccaagcccccggccaaggcctagaatggatcggctgggtcaaaatcgtctccggcaccgtcaacttcgcctccctcgacttccgcaaccgcatctccctctcccgcgaccgcgacctctccaccgcccacatggacatccgcggcctcacacaagacgacaccgccacctacttctgcgcccgacaaaaattcgcctcccgctactccggcgaccaaggatcctacttcgacctctggggccgcggcaccctcatcatcgtctcatccgcctcaaccaaaggcccctccgacgacctccgc

SEQ ID NO: 57217 - RNA, 414 nt, synthetic construct
  misc_feature 1..414: note = derived and/or modified sequence opt11 from anti-HIV-1_HeavyChain
  source 1..414: mol_type = other RNA
caagtgcaattggtccagagcggggccgaggtcaagaaaccgggcgcgagcgtgaaagtgagctgtaaatcgagcgggtactcgttcacgcgctttgacataacctgggtcaggcaagcgcccgggcaagggctcgagtggataggctgggtcaagaccgtgagcggggccgtgaactttggctcgctcaatttcaggcacagggtctcgctcacgcgcgatcgcgatctctttaccgcgcacatggacatacgcgggctcacgcaaggggacacggccacgtacttttgcgcgcgacagaaatttgccaggggcgatcaagggtggtttttcgatctctggggcaggggaacgctcatagtcgtgagctcggcctcgaccaagggcccgagtgtgttcccgcacgatctcagg

SEQ ID NO: 57218 - RNA, 420 nt, synthetic construct
  misc_feature 1..420: note = derived and/or modified sequence opt11 from anti-HIV-1_HeavyChain
  source 1..420: mol_type = other RNA
caggcacacctagagcaaagcggaagcggagtgaaaaagccaggggcaagcgtaagggtaagctgctggacaagcgaagacatattcgaaaagagcgagctaatacactgggtaaggcaagcgccagggcaagggctagagtggataggatgggtaaagacagtgacaggggcagtgaacttcggaagcagcgacttcaggcaaagggtaagcctaacgagagacagagacctattcacagcgcacatggacataagagggctaacacaaggggacacggcaacgtacttctgcgcgagacagaaattctacgcaggagggcaagggtggtacttcgacctatggggaaggggaacgctaatagtagtgagcagcgcaagcacaaagggaccgatagggctgccaccaaggctatgcgta

SEQ ID NO: 57219 - RNA, 417 nt, synthetic construct
  misc_feature 1..417: note = derived and/or modified sequence opt11 from anti-HIV-1_HeavyChain
  source 1..417: mol_type = other RNA
caagcacacctagaacaaagcggagccggagtcaaaaaaccaggcgcaagcgtacgcgtaagctgctggacaagcgaagacatattcgaacgcacagaactaatccactgggtacgccaggccccaggccagggcctagaatggatcggatgggtaaaaacagtcacgggcgcggtcaacttcgggagcccaaacttccgccaccgcgtaagcctaaccagagacagagacctgttcacagcccacatggacatcaggggcctgacccaaggcgacaccgcaacctacttctgcgccagacaaaaattcgaacgcggaggccaaggctggtacttcgacctgtgggggcgcgggaccctaatcgtggtctcaagcgcaagcacaaaaggaccctcagtcttcccccacgacctacgc

SEQ ID NO: 57220 - RNA, 420 nt, synthetic construct
  misc_feature 1..420: note = derived and/or modified sequence opt11 from anti-HIV-1_HeavyChain
  source 1..420: mol_type = other RNA
caagcgcacttggaacagagcgggagcggggtcaagaaattgggcgcgagcgtgcgcgtgagctgttggacgagcgaggacatattcgagcgcacggaattgatacattgggtgcgccaggccccgggccagggcttggaatggatcgggtgggtgaaagcagtctcgggcgcggtcaattacgggagcttggactttcgccatcgagtgagcttgaccagggacagggacttgttcacggcccatatggatatcaggggcttgacccaggacgataccgcgacctatttctgtgccaggcaaaagttcgcgcgcggagaccagggctggttctttgacttgtgggggcgcgggaccttgatcgtggtctcgagcgcaagcacgaaagggccctcgggcccgagcccggaaatatgcgtg

SEQ ID NO: 57221 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggcgcgggcgtgaaaaggcccggggcctcggtcagggtctcgtgctggacctcggaagatatctttgaaacgaccgagctcatacactgggtcaggcaagcgcccgggcaagggctagagtggataggctgggtcaagaccgtgagcggggccgtgaactttggctcgctcaatttcagacacagggtctcgctcacgcgagatcgcgatctctttaccgcgcacatggacatacgcggactcacgcaaggggacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatctcaga

SEQ ID NO: 57222 - RNA, 417 nt, synthetic construct
  misc_feature 1..417: note = derived and/or modified sequence opt11 from anti-HIV-1_HeavyChain
  source 1..417: mol_type = other RNA
agggcccacctcgagcaatcgggctcgggcgtcaaaaagctcggggcctcagtaagagtatcgtgctggacctcggaagatatctttgaaaggaccgagctcatacactgggtaaggcaagcgcccgggcaagggctcgagtggataggctgggtcaaggccgtgagcggggccgcgaactatggctcgcccaatttcaggcaaagggtctcgctcacgcgcgatcgcgatctctttaccgcgcacatggacatacgcgggctcacgcaaggagacacggccacgtacttctgcgcgcgccagaaatttgaaaggggcgggcaagggtggatattcgatctctggggcaggggcacgctcatagccgtgagctcggcctcgaccaagggcccgagcgtgttcccgcacgatctcagg

SEQ ID NO: 57223 - RNA, 417 nt, synthetic construct
  misc_feature 1..417: note = derived and/or modified sequence opt11 from anti-HIV-1_HeavyChain
  source 1..417: mol_type = other RNA
caagtgcacctggaacagagcggaagcggagtaaaaaaactaggcgcaagcgtacgcgtaagctgctggacaagcgaagacatattcgaacgcacagaactgatccactgggtaagacaggccccgggccagggcctggaatggatcggatgggtaaaagcagtctcgggcgcagtcaactacgggagcctagacttccgacaccgagtaagcctgacaagagacagagacctattcacggcccacatggacatcagaggcctgacccaggacgacaccgcaacctacttctgcgccagacaaaaattcgcacgcggagaccagggctggttcttcgacctgtggggacgagggaccctgatcgtagtctcaagcgcaagcacgaaagggccctcggtcttcccccacgacctgcgc

SEQ ID NO: 57224 - RNA, 417 nt, synthetic construct
  misc_feature 1..417: note = derived and/or modified sequence opt11 from anti-HIV-1_HeavyChain
  source 1..417: mol_type = other RNA
cgcgcgcacttggaacagagcgggagcggggtcaagaaaccgggcgcgagcgtgcgcgtgagctgttggacgagcgaggacatattcgagcgaacggaattgatccattgggtgcgacaggccccgggccagggcttggaatggatcgggtgggtgaaaatagtctcgggcgcggtcaatttcgggagcccgaactttcgccagcgcgcgagcctgaccagggacagggacttgttcacggcccatatggatatcaggggcttgacccagggcgatacagcgacctatttctgtgccaggcaaaagttcgagcgcgggggccagggctggatctttgacttgtgggggcgcgggaccttgatcgcggtctcgagcgcgagcacgaaagggccatcggtctttcccacgatctatgtc

SEQ ID NO: 57225 - RNA, 414 nt, synthetic construct
  misc_feature 1..414: note = derived and/or modified sequence opt11 from anti-HIV-1_HeavyChain
  source 1..414: mol_type = other RNA
caagtgcaactggtccagagcgaggccgaggtcaagaaaccaggcgcgagcgtgaaaataagctgcgccacaagcgggtacgcgttcacgctctactacttgcactgggtcaggcaagcgcccggccaaggactcgagtggataggctgggtaaaaaccgtgaccggggccgtgaacttcggctcggcctacttcaggcacagggtctcactcacgcgcgaccgcgacctcttcaccgcgcacatggacatacgcgggctcacgcaaggagacacagccacgtacttctgcgcacgccagaaattctacaagggcgggcaagggtggtacttcgacctctggggcagaggcacgctcatagtcgtgagctcggcctcgaccaagggcccgagcgtgttcccacacgacctcaga

SEQ ID NO: 57226 - RNA, 420 nt, synthetic construct
  misc_feature 1..420: note = derived and/or modified sequence opt11 from anti-HIV-1_HeavyChain
  source 1..420: mol_type = other RNA
caggcacacccggagcaaagcggaagcggagtgaaaaagccgggggcaagcgtaagggtaagctgctggacaagcgaagacatattcgaaaggacggagctgatacactgggtaaggcaggcgccggggcaggggctggagtggataggatgggtaaagatagtgagcggggcagtgaacttcggaagcccgaacttcaggcagagggtaagcctgacgagagacagagacctgttcacggcgcacatggacataagagggctgacgcagggggacacggcgacgtacttctgcgcgagacagaaattcgaaaggggagggcaggggtggatattcgacctgtggggaagggggacgctgatagcagtgagcagcgcaagcacaaaggggccgagcgggctgccgccgaggctatgcgtg

SEQ ID NO: 57227 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagaccgtgagcggggccgtaaactttggctcgcccaatttcaggcacagggtctcgctcacgcgcgatcgcgatctctttaccgcgcacatggacatacgcgggctcacgcaaggggacacggccacatacttctgcgcgcgccagaaatttgaaaggggcgggcaagggtggtatttcgatctctggggcaggggcacgctcatagtcgtgagctcggcctcgaccaagggcccgagcgtgttcccgcccaggagcacg

SEQ ID NO: 57228 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcggaagcggggtcaagcgcccgggcgcgagcgtgcgagtgagctgttggacgagcgaggacatattcgagaaatcagaattgatccattgggtgcgccaggccccgggccagggcttggaatggatcgggtgggtgaaaacggtcacaggcgcggtcaatttcgggagcccgaactttcgccatcgcgtgagcttgaccagagacagggacctgttcacggcccatatggatatcaggggcttgacccagggcgataccgcgacctatttctgtgccaggcaaaagttcgagcgcgggggccagggctggtactttgacttgtgggggcgaggaaccttgatcgtggtctcgagcgcgagcacgaaagggccctcggtctttccccatgacctgcgc

SEQ ID NO: 57229 - RNA, 417 nt, synthetic construct
  misc_feature 1..417: note = derived and/or modified sequence opt11 from anti-HIV-1_HeavyChain
  source 1..417: mol_type = other RNA
ggggcccatctcgagcaatcgggctcgggcgtgaaaaagcccggggcctcagtcagggtctcgtgctggacctcagaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgagggctcacgcaaggggacacggccacgtacttttgcgcgcgccagaaattttacgcgggcgggcaagggtggtatttcgatctctggggcaggggcacgctcatagtcgtgagctcggcctcgaccaagggcccgagcgtgttcccgcacgatctcagg

SEQ ID NO: 57230 - RNA, 417 nt, synthetic construct
  misc_feature 1..417: note = derived and/or modified sequence opt11 from anti-HIV-1_HeavyChain
  source 1..417: mol_type = other RNA
aggcacgatctcgagcaatcgggctcgggcgtgaaaaagcccggggcctcggtcagggtctcgtgctggacctcggaagacatctttgaaaggaccgagctcatacactgggtcaggcaagcgcccgggcaagggctcgagtggataggctgggtcaagatcgtgagcggggccgtgaacttcggctcgcccaatttcaggcaaagggtctcgctcacgcgcgaccgcgatctcttcaccgcgcacatggacatacgcgggctcacgcaaggggacacggccacgtacttctgcgcgcgccagaaatttgaaaggggcgggcaagggtggatattcgatctctggggcaggggcacgctaatagccgtgagctcggcctcgacaaagggcccgagcgtgttcccgcacgacctcagg

SEQ ID NO: 57231 - RNA, 420 nt, synthetic construct
  misc_feature 1..420: note = derived and/or modified sequence opt11 from anti-HIV-1_HeavyChain
  source 1..420: mol_type = other RNA
caagcgcacttggaacagagcgggagcggggtcaagaaaccgggcgcgagcgtgcgagtgagctgttggtcgagcgaggacatattcgagcgcacggaattgatccattgggtgcgccaggccccgggccagggcttggaatggatagggtgggtgaaaacggtcacgggcgcggtcaatttcgggagcttggactttcgccatcgcatcagcttgaccagggacagggacttgttcacggcccatatggatataaggggactgacccagggcgataccgcgacctatttctgcgccaggcaaaagttcgagagcaggtacacgggcgggcaagggtggtatttcgatctctggggcaggggcacgcacatagtcgtgagctcggcctcgaccaagggcccgagcgtgaccatatacgtg

SEQ ID NO: 57232 - RNA, 414 nt, synthetic construct
  misc_feature 1..414: note = derived and/or modified sequence opt11 from anti-HIV-1_HeavyChain
  source 1..414: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttttgcgcgcgccagaaattttacgcgggcgggcaagggtggtatttcgatctctggggcaggggcacgctcatagtcgtgagctcggcctcgcccgggcccataggcccgagcccgcgctcggcc

SEQ ID NO: 57233 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcggcctcgggagtgaaaaggcccggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgagcgatttcaggcaaagggtctcgctcacacgagatcgcgatctctttaccgcgcacatggacatacgcgggctcacgcaaggggacacggccacgtacttttgcgcgcgccagaaattttacgcgggcgggcaaggatggtatttcgatctatggggcaggggcacgctcatagtcgtgagctcggcctcgaccaagggcccgagcgtgttcccgcacgatctcagg

SEQ ID NO: 57234 - RNA, 417 nt, synthetic construct
  misc_feature 1..417: note = derived and/or modified sequence opt11 from anti-HIV-1_HeavyChain
  source 1..417: mol_type = other RNA
caggtccagctcgtgcaatcgggcgcggaagtgaaaaagcccggggcctcggtcagggtctcgtgctggacctcggaagatatctttgaaaagagcgagctcatacactgggtcagacaagcgcccgggcaagggctcgagtggataggctgggtcaagaccgtgaccggggccgtgaactttggctcgagcgatttcaggcaaagggtatcgctcacgcgcgatcgagatctctttaccgcgcacatggacatacgcgggctcacgcaaggggacacggccacgtacttttgcgcgcgacagaaattttacgcgggcgggcaagggtggtatttcgatctctggggcaggggcacgctcatagtcgtgagctcggcctcgaccaagggcccgagcgtgttcccgaccatatacgtg

SEQ ID NO: 57235 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctcaggcgtcaaaaaacccggcgcatccgtccgcgtctcctgctggacctcagaagacatcttcgaacgcaccgaactcatacactgggtccgccaagcccccggccaaggcctcgaacgaatcggctgggtcaaaaccgtcaccggcgccgtcaacttcggctcccccaacttccgccaccgcgtctccctcacccgcgaccgcgacctcttcaccgcccacatggacatccgcggcctaacccaaggcgacaccgccacctacttctgcgcccgacaaaaattcgaacgcggcggccaaggctggtacttcgacctatggggccgcggcaccctcatcgtcgtctcctccgcctccaccaaaggcccctccgtcttccccaccatctgcgtc

SEQ ID NO: 57236 - RNA, 420 nt, synthetic construct
  misc_feature 1..420: note = derived and/or modified sequence opt11 from anti-HIV-1_HeavyChain
  source 1..420: mol_type = other RNA
caatcccacctcgaacaatccggctccgccatgaaaaaacccggcgcctccgtccgcgtctcctgctggacctccgaagacatcttcgacaccaccgaactcatccactgggtccgccaagcccccggccaaggcctcgaatggatcggctgggtcaaaaccgtctccggcgccgtcaacttcggctccctaaacttccgccaccgcgtctccctcacccgcgaccgcgacctattcaccgcccacatggacatccgaggcctcacccaaggcgacaccgccacctacttctgcgcccgccaaaaattcgcccgcggcgaccaaggctggttcttcgacctctggggccgcggcaccctaatcgtcgtctcctccgcatccaccaacggccccatcggcccctcccccaccgacctccgc

SEQ ID NO: 57237 - RNA, 417 nt, synthetic construct
  misc_feature 1..417: note = derived and/or modified sequence opt11 from anti-HIV-1_HeavyChain
  source 1..417: mol_type = other RNA
caggcacacctagagcaaagcggaagcggagtgaaaaagctaggggcaagcgtaagggtaagctgctggacaagcgaagacatattcgaaaggacagagctaatacaatgggtaagacaagcgccgggacaaggactagagtggatgggatgggtaaaggcggtgagcggggcagtgaactacggaagcctagacttcaggcacagggtaagcctaacgagagacagagacctattcacagcgcacatggacataagagggctaacacaagacgacacggcgacgtacttctgcgcgagacagaaattcgcaaggggagaccaagggtggttcttcgacctatggggaagaggaacgctaatagtagtgagcagcgcaagcacaaagggaccgagcgtgttcccacacgacctaagg

SEQ ID NO: 57238 - RNA, 417 nt, synthetic construct
  misc_feature 1..417: note = derived and/or modified sequence opt11 from anti-HIV-1_HeavyChain
  source 1..417: mol_type = other RNA
caatcccacctcgaacaatccggctccgccatgaaaaaacccggcgcctcagtccgcgtctcctgctggacctccgaagacatcttcgacaccaccgaactcatctactgggtccgccaagcccccggccaaggactagaatggatcggctgggtcaaagccgtctccggcgccgtcaactacggctccctcgacttccgccaccgagtctccctcacccgcgaccgcgacctatccacagcccacatggacatccgcggcctcacccaagacgacacagccacctacttctgcgcccgccaaaaattcgcacgcggcgaccaaggctggttcttcgacctctggggccgcggcaccctcatcgtcgtctcctccgcctccaccaaaggcccctccgtcttcccccacgacctccgc

SEQ ID NO: 57239 - RNA, 417 nt, synthetic construct
  misc_feature 1..417: note = derived and/or modified sequence opt11 from anti-HIV-1_HeavyChain
  source 1..417: mol_type = other RNA
caagcccacctcgaacaatccggctccggcgtcaaaaaactcggcgcctccgtccgcgtctcctgctggacctcagaagacatcttcgaacgcaccgaactcatccactgggtacgccaagcccccggccaaggactcgaatggatcggctgggtcaaagccgtctccggcgccgtcaactacggctccctcgacttccgccaccgcgtctccctcacccgcgaccgcgacctatccaccgcccacatggacatccgcggcctaacccaagacgacaccgccacctacttctgcgcccgccaaaaattcgcccgcggcgaccaaggctggttcttcgacctctggggccgcggcaccctcatcgtcgtctcctccgcctccacaaaaggaccctccgtcttccccaccatctacgtc

SEQ ID NO: 57240 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacaaagcggaagcggagtcaaaaaaccaggcgcaagcgtacgcgtatcctgctggacaagcgaagacatattcgaacgcacagaactaatccactgggtacgccaggccccaggccaaggcctagaatggatcggatgggtaaaaacagtcacaggcgcagtcaacttcggaagcccaaacttccgccaccgcgtaagcctaaccagagacagagacctattcacagcccacatggacatcagaggcctgacccaaggcgacaccgcaacctacttctgcgccagacaaaaattcgaacgcggaggccaaggctggtacttcgacctatggggacgcggaaccctaatcgtagtctcaagcgcaagcacaaaaggaccctcagtcttcccccacgacccacgc

SEQ ID NO: 57241 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgcgggcatgaaaaagcccggggcctcgatgacggtctcgtgcaagaccgcggacgaggacatattcgatgccgcgtacatgcactgggtcaggcaagcgcccgggcaaacgttcgagtggttgggctggatgaagcccgtgaccggggcagtgaactatgccaggcaatttcaagggcgcgtgagcttttacaggaccagggaattgggcatagcctatatggatctaagggacttgaaatttgacgataccgcggtctatttctgtgccaggaaaacgaaaggggacgtgagcggggacgatcgcgggttctttttcgatctctggggcaggggcacgcgcgtgatcgtgagctcggcctcgaccaagggcccgagcgtgttcccgcacgatctcagg

SEQ ID NO: 57242 - RNA, 423 nt, synthetic construct
  misc_feature 1..423: note = derived and/or modified sequence opt11 from anti-HIV-1_HeavyChain
  source 1..423: mol_type = other RNA
caggtgtatatggagcaggcggggggggggatgaagaagccgggggcgagtatgacggtgagttgtaagacggcggatgaggatatatttgatgcggcgtatatgcattgggtgaggcaggcaagggggcagacgtttgagtggttggggtggatgaagccggtgacgggggcggtgaattatgcgagacagttccaggggagggtgagtttttataggacgagggagctggggatagcgtatatggatttgagggatctgaagtttgatgacacggcggtgtatttttgtgcgaggaagacgaagggggatgtgagtggggatgatagggggtttttttttgatttgtgggggagggggacgagggtgatagtgagtagtgcgagtacgaaggggccgagtgtgtttccgacgatatatgtg

SEQ ID NO: 57243 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgcgggcgtgaaaaagcccggggcctcggtaacgctctcatgcaaaaccgcagacgaggacgtgttcgatgccgcgtacatgcactgggtcaggcaagcgcccgggcaaacgttcgagtggttgggctggatgaagcccgtgaccggggccgtgagctatgccaggaaatttcaagggcgagtgagcttttacatgacaagggaattgggcatggcctatatggatctcaggaacctgcgctttgacgataccgcggtctatttctgtgccaggaaaacggccggggacgtgagcggggacaatcgcgggtactttttcgatctatggggcaggggctcacgcgtgatcgtgagctcggcctcgaccaagggcccgagcgtgttcccgaccatatacgtg

SEQ ID NO: 57244 - RNA, 423 nt, synthetic construct
  misc_feature 1..423: note = derived and/or modified sequence opt11 from anti-HIV-1_HeavyChain
  source 1..423: mol_type = other RNA
caagtgtactcgggcgcgggcaggggcggggtcaagaaaccgggcgcgagcgtgaccctgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacctgcgcaatctcaggttcgatgacacggccgtgtacttttgcgcgcgcaagaccgcgggcgatgtctcaggcgataaaaggggctttttctttgacttgtgggggcgcggaagcagggtcatagtctcgagcgcgagcacgaaagggccctcggtctttcccacgatctatgtc

SEQ ID NO: 57245 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggatcgggcgtgaaaaagcccggggcctcggtcagggtctcgtgctggacctcggaagatatctttgaaagaaccgagctcatacactgggtccggcaagcgcccgggcaagggctcgagtggataggctgggtcaagaccgtgagcggggccgtgaactttggctcgcccaatttcaggcacagggtctcgctaacgcgcgatcgcgatctctttaccgcgcacatggacatacgcgggctaacgcaaggggacacggccacgtacttttgcgcgcgccagaaatttgaaaggggcgggcaagggtggtatttcgatctctggggcaggggcacgctcatagtcgtgagctcggcctttaccaagggcccaagcgtgttcccgcacgatctaagg

SEQ ID NO: 57246 - RNA, 414 nt, synthetic construct
  misc_feature 1..414: note = derived and/or modified sequence opt11 from anti-HIV-1_HeavyChain
  source 1..414: mol_type = other RNA
caagtgcaactgggacagagcggggccgagatgaagaaaccgggctcaagcgtgaaagtgagctgtaaagcgagcgggggcacgttcaggcactcgcccataagctgggtcaggcaagcgcccgggcaagggctcgagtggataggctgggtcaaggccgtgagcggggccgtgaactatggctcgctcgatttcaggcacagggtctcgctcacgcgcgatcgcgatctatcgaccgcgcacatggacatacgcgggctcacgcaagatgacacggccacgtacttttgcgcgcgccagaaatttgccaggggcgatcaagggtggtttttcgatctatggggcaggggcacgctcatagtcgtgagctcggcctcgaccaagggcccgagcgtgttcccgcacgatctcagg

SEQ ID NO: 57247 - RNA, 417 nt, synthetic construct
  misc_feature 1..417: note = derived and/or modified sequence opt11 from anti-HIV-1_HeavyChain
  source 1..417: mol_type = other RNA
caatcccacctcgaacaatccggctccgccatgaaaaaacccggcgcctccgtccgcgtctcctgctggacctccgaagacatcttcgacaccaccgaactcatctactgggtccgccaagccccaggccaaggcctagaatggatcggctgggtcaaaaccgtcaccggcgcagtcaacttcggcagcccaaacttccgccaccgcgtcagcctcacccgcgaccgcgacctcttcaccgcccacatggacatccgcggactcacacaaggcgacaccgccacctacttctgcgccagacaaaaattcgaacgcggcggccaaggctggtacttcgacctctggggccgcggcaccctcatcgtcgtctcctccgccagcacaaaaggcccctcagtcttcccccacgacctccga

SEQ ID NO: 57248 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgcgggcgtgaaaaagcccggggcctcagtcacgctatcgtgcaagacagcagacgaggacgtgttcgatgccgcgtacatgcactgggtcaggcaagcgcccgggcaaacgttcgagtggttgggctggatgaagcccgtgaccggggcagtgagctatgccaggaaatttcaagggcgagtgagcttttacatgaccagggaactgggcatggcctatatggatctcaggaacttgcgatttgacgataccgcggtctatttctgtgccaggaaaacggccggggacgtgagcggggacaatcgcgggtactttttcgatctatggggcagaggctcgtgggtgatcgtgagctcggcctcgaccaagggcccgagcgtgttcccgcacgatctaagg

SEQ ID NO: 57249 - RNA, 423 nt, synthetic construct
  misc_feature 1..423: note = derived and/or modified sequence opt11 from anti-HIV-1_HeavyChain
  source 1..423: mol_type = other RNA
caggtgtatatggagcaggcagggggaggggtgaagaagccgggggcgagcgtgacgctgagttgcaagacggcggacgaggacgtgttcgatgcggcgtacatgcactgggtgaggcaggcgccggggcagacgttcgagtggctggggtggatgaagccggtgacgggggcggtgaactatgcgaggaagtttcaggggagggtgagcttttacaggacgagagaattggggatagcgtatatggacctaagaaacctgagatttgacgatacggcggtgtatttctgtgcaaggaagacggcgggggacgtgagcggggacaagagggggttctttttcgatctatgggggagggggagcagagtaatagtgagcagcgcaagtacgaagggaccgagcgtgttcccgacgatatgcgtg

SEQ ID NO: 57250 - RNA, 417 nt, synthetic construct
  misc_feature 1..417: note = derived and/or modified sequence opt11 from anti-HIV-1_HeavyChain
  source 1..417: mol_type = other RNA
caagcccacctagaacaatccggctcaggcgtcaaaaaactcggcgcctccgtacgcgtctcctgctggacctccgaagacatcttcgaacgcaccgaactcatccactgggtccgccaagccccaggccgcggcctcgaatggatcggctgggtcaaagccgtctccggcgccgtcaactacggctccctcgacttccgccaccgcgtctccctcacccgagaccgcgacctattcaccgcccacatggacatccgcggcctcacccaagacgacaccgccacctacttctgcgcccgccaaaaattcgcccgcggcgaccaaggctggttcttcgacctctggggccgcggcaccctcatcgtcgtctcctccgcctcaaccaaaggcccctccgtcttcccccacgacctccgc

SEQ ID NO: 57251 - RNA, 423 nt, synthetic construct
  misc_feature 1..423: note = derived and/or modified sequence opt11 from anti-HIV-1_HeavyChain
  source 1..423: mol_type = other RNA
caggtgtatatggagcaggcgggggggggggtgaagaagccgggggcgagcgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagagagttggggatagcgtatatggatctgaggaatttgaggtttgatgatacggcggtgtatttttgtgcgaggaagacggcgggagatgtgagtggggataagagggggtttttttttgatctgtgggggagggggagcagggtgatagtgagtagtgcgagtacgaaggggccgagtgtgtttccgacgatatatgtg

SEQ ID NO: 57252 - RNA, 423 nt, synthetic construct
  misc_feature 1..423: note = derived and/or modified sequence opt11 from anti-HIV-1_HeavyChain
  source 1..423: mol_type = other RNA
caagtgttcatggaacaggccggggccgggatgaagaaaccgggcgcgagcatgaccgtgagctgtaaaacggccgatgaagatgtctttgacgcggcatatatgcattgggtgcgacaggccccgggccagacctttgaatggctcgggtggatgaaaccggtcacgggcgcggtcaattacgcgcgcaagttccagggcagggtatcgttctatcgcacgcgagagctcgggatcgcgtacatggacttgcgcaatctcaggttcgatgacacggccgtgtacttttgcgcgcgcaagaccgcgggcgatgtctcgggcgataaaaggggctttttctttgacttgtgggggcgcgggagcagggtcatagtctcgagcgcgagcacgaaagggccctcggtctttccccatgacttgcgc

SEQ ID NO: 57253 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccggggccggggtcaagaaaccgggcgcgagcgtgacactgagctgtaaaacggccgatgaagatgtctttgacgcggcctatatgcactgggtgcgccaggccccgggccagacatttgaatggctcgggtggatgaaaccggtcacgggcgcggtcaattacgcgcgcaagttccagggcagggtctcgttctatcgcacgcgcgagctcgggatcgcatacatggacctgcgcaatctcaggctcgatgacacggccgtgtacttttgcgcgcgcaagaccgcaggcgatgtctcgggcgataaaaggggctttttctttgacttgtgggggcgagggagcagggtcatagtctcgagcgcgagcacgaaagggccctcggtctttccccatgacttgcgc

SEQ ID NO: 57254 - RNA, 420 nt, synthetic construct
  misc_feature 1..420: note = derived and/or modified sequence opt11 from anti-HIV-1_HeavyChain
  source 1..420: mol_type = other RNA
caatcccacctcgaacaatccggctccgccatgaaaaaacccggcgcctccgtccgcgtctcctgctggacctccgaagacatcttcgaacgcaccgaactcatctactgggtccgccaagcccccggccgcggcctcgaatggatcggctgggtcaaaaccgtctccggcaccgtcaacttcggctcatccgacttccgcaaccgcatctccctcacccgcgaccgagacctctccaccgcccacatggacatccgaggcctcacccaagacgacaccgccacctacttctgcgcccgccaaaaattcgaatccctctactccgacgaccaaggctcctacttcgacctctggggccgaggcaccctcatcatcgtctcctcagcctccaccaaaggcccctcagtcttccccaccatc

SEQ ID NO: 57255 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgggggcgtgaaaaagcccggggcctcggtcacgctatcgtgcaagaccgcggacgaggacgtgttcgatgccgcgtacatgcactgggtcaggcaagcgccagggcaaacgttcgagtggttgggctggatgaagcccgtgaccggggccgtgagctatgccaggaaatttcaagggcgcgtgagcttttacatgacaagggaattgggcatggcctatatggatctcaggaacttgcgctttgacgatacagcggtctatttctgtgccaggaaaacggccggggacgtgagcggggacaatcgcgggtactttttcgatctatggggcaggggctcgcgcgtgatcgtgagctcggcctcgaccaagggcccgagcgtgttcccgaccatatgcgtg

SEQ ID NO: 57256 - RNA, 417 nt, synthetic construct
  misc_feature 1..417: note = derived and/or modified sequence opt11 from anti-HIV-1_HeavyChain
  source 1..417: mol_type = other RNA
caggcccatctagagcaatcgggctcgggcgtgaaaaagcccggggcctcggtcagggtctcgtgctggacctcagaagatatctttgaaaagagcgagctcatacactgggtaaggcaagcgcccgggcaagggctcgagtggataggctgggtcaagacagtgaccggggccgtgaactttggctcgagcgatttcaggcaaagggtctcgctcacgcgcgatcgcgatctatttaccgcgcacatggacatacgcgggctcacgcaaggggacacggccacgtacttttgcgcgcgccagaaatattacgcgggcgggcaagggtggtatttcgatctctggggcaggggcacgctcatagtcgtgagctcggcctcgaccaagggcccgagcgtgttcccgcacgatctcagg

SEQ ID NO: 57257 - RNA, 426 nt, synthetic construct
  misc_feature 1..426: note = derived and/or modified sequence opt11 from anti-HIV-1_HeavyChain
  source 1..426: mol_type = other RNA
caagcgcacctggaacagagcgggagcggagtcaagaaaccgggcgcgagcgtgagagtgagctgttggtcgagcgaggacatattcgagcgcacggaattgatccattgggtgcgacaggccccgggccagggcttggaatggatcgggtgggtgaaaacggtcacgggcgcggtcaatttcgggagcttggactttcgccatcgcatcagcttgaccagggacagagacttgttcacggcccatatggatataaggggcttgacacagggcgatacagcgacctatttctgtgcaaggcaaaagttcgagagcaggtacacgggcgggcaagggtggtatttcgatctctggggcaggggcacgcacatagtcgtgagctcggcctcgaccaagggcccgagcgtgttcccgcacgatctcagg

SEQ ID NO: 57258 - RNA, 423 nt, synthetic construct
  misc_feature 1..423: note = derived and/or modified sequence opt11 from anti-HIV-1_HeavyChain
  source 1..423: mol_type = other RNA
caagtgtacatgggcgcgggcaggggcggggtcaagaaaccgggcgcgagcgtgaccttgagctgtaaaacggccgatgaagatgtctttgacgcagcctatatgcattgggtgcgccaggccccgggccagacctttgaatggctagggtggatgaaaccggtcacgggcgcggtaaattacgcgcgcaagttccagggcagggtctcgttctatcgcacgcgcgagctcgggatcgcgtacatggacttgcgcaatctcaggttcgatgacacggccgtgtacttttgcgcgcgcaagaccgcgggcgatgtctcgggcgataaaaggggatttttctttgacctgtgggggcgcgggagcagggtcatagtatcgagcgcgagcacgaaagggccctcggtctttcccacgatctatgtc

SEQ ID NO: 57259 - RNA, 423 nt, synthetic construct
  misc_feature 1..423: note = derived and/or modified sequence opt11 from anti-HIV-1_HeavyChain
  source 1..423: mol_type = other RNA
caggtgtacatggagcaggcgggaggggggatgaagaagccgggggcgagtatgacggtgagctgtaagacggcggatgaggatatatttgatgcggcgtatatgcattgggtgagacaggcgccggggcagacgtttgagtggctggggtggatgaagccggtgacgggggcggtgaattatgcgaggcagtttcaggggagggtgagtttttataggacgagggagctggggatagcgtatatggatttgagggatctgaagtttgatgatacggcggtgtatttttgtgcgagaaagacgaagggggatgtgagtggggatgatagggggtttttttttgatttgtgggggagagggacgagggtgatagtgagtagcgcgagcacgaaggggccgagtgtgtttccgacgatatgtgta

SEQ ID NO: 57260 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccgggggcgggatgaagaaaccgggcgcgagcatgacagtgagctgtaaaacggccgatgaagatatctttgacgcggcctatatgcactgggtgcgccaggccccgggccagacctttgaatggcttgggtggatgaaaccggtcacgggcgcggtcaattacgcgcgacagttccagggcagggtctcgttctatcgcacgcgagagctcgggatcgcgtacatggacttgcgagatctcaagttcgatgacacggccgtgtacttttgcgcgcgaaagaccaagggcgatgtctcgggcgatgacaggggctttttctttgacttgtgggggcgcgggaccagggtcatagtctcgagcgcgagcacgaaagggccctcggtctttccccacgacttgcgc

SEQ ID NO: 57261 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgcgggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagccagtgaccggggccgtgaactatgccaggaaatttcaagggaaagtgagcttttacaggaccagggaattgggcatagcatatatggatctcaggaacttgcgctttgacgataccgcggtctatttctgtgccagaaaaacggccggggacgtgagcggggacaagcgcgggttctttttcgatctctggggcaggggatcgcgcgtgatcgtgagctcggcctcgacaaagggaccgagcgtgttcccgcacgatctcagg

SEQ ID NO: 57262 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgcgggcgtgaaaaagccaggggcctcggtcacgctctcgtgcaagaccgcggacgaggacgtgttcgatgccgcgtacatgcactgggtcaggcaagcgcccggacaaacgttcgagtggctgggctggatgaagcccgtgaccggggccgtgaactatgcaaggaaatttcaatcgcgcgtgagcttttacgggaccagggaattgggcatagcctatatggatctaaggaacttgcgctttgacgataccgcggtctatttctgtgcaaggaaaacggccggggacgtgagcggggacaagcgcgggttctttttcgatctctggggcagaggctcgcgagtgatcgtgagctcggcctcgaccaagggcccgagcgtgttcccgcacgatctcagg

SEQ ID NO: 57263 - RNA, 420 nt, synthetic construct
  misc_feature 1..420: note = derived and/or modified sequence opt11 from anti-HIV-1_HeavyChain
  source 1..420: mol_type = other RNA
caagggcacacggtcgagcaatcgggctcgggcgtgaaaaagctcggggcctcggtcagggtctcgtgctggacctcggaagatatctttgaaacgaccgagctaatacactgggtcagacaagcgcccgggcaagggctcgagtggataggctgggtcaagaccgtgagcggggcagtgaactttggctcgctcaatttcaggcacagggtctcgctcacgcgcgatcgagatctctttaccgcgcacatggacataagagggctcacgcaaggggacacggccacgtacttttgcgcgcgccagaaatttgccaggggcgatcaagggtggtttttcgatctctggggcaggggcacgctcatagtcgtgagctcggcctcgaccaagggcccgagcgtgttcccgcacgatctcagg

SEQ ID NO: 57264 - RNA, 420 nt, synthetic construct
  misc_feature 1..420: note = derived and/or modified sequence opt11 from anti-HIV-1_HeavyChain
  source 1..420: mol_type = other RNA
caagcgaccccgtggtcgaacttgggcaggggcgtgaaaaagctcggggcctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcaccaaatttcagacacagggtctcgctaacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcagcctcgaccaagggcccgagcgtgttcccgcacgatctcagg

SEQ ID NO: 57265 - RNA, 423 nt, synthetic construct
  misc_feature 1..423: note = derived and/or modified sequence opt11 from anti-HIV-1_HeavyChain
  source 1..423: mol_type = other RNA
caggtctttatggagcaagcgggcgcgggcatgaaaaagcccggggcctcaatgacggtctcgtgcaagaccgcggacgaggacgtgttcgatgccgcgtacatgcactgggtcaggcaagcgcccgggcaaacgttcgagtggttgggctggatgaagccagtgaccggggccgtgagctatgccaggaaatttcaagggcgagtgagcttttacatgaccagggaattgggcatggcctatatggatctcaggaacttgcgctttgacgatacagcggtctatttctgtgccaggaaaacggccggggacgtgagcggggacaatcgcgggtactttttcgatctctggggcaggggctcgcgcgtgatcgtgagctcggcctcgaccaagggcccgagcgtgttcccgcacgatctaagg

SEQ ID NO: 57266 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacagagcgggggcggggtcaagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcggtctcgtacgcgcgcaagttccagggcagggtctcgttctatcgcacgcgcgagctcgggatcgcgtacatggacttgcgcaatctcaggttcgatgacacggccgtgtacttttgcgcacgcaagaccgcgggagatgtctcgggcgataaaaggggctttttctttgacttgtgggggcgagggagcagggtcatagtctcgagcgcgagcacgaaagggccatcggtctttccccatgacctgcgc

SEQ ID NO: 57267 - RNA, 423 nt, synthetic construct
  misc_feature 1..423: note = derived and/or modified sequence opt11 from anti-HIV-1_HeavyChain
  source 1..423: mol_type = other RNA
caggtatacatggagagggggagggggggggtgaagaagccgggggcgagtgtgacgctgagctgcaagacggcggacgaggacgtgtttgatgcggcgtacatgcactgggtgaggcaggcgccggggcagacgttcgagtggttggggtggatgaagccagtgacaggggcggtgaattacgcgaggaagtttcaggggagggtgagcttttacaggacgagggagttggggatagcgtatatggatctgaggaatttgaggtttgacgatacggcggtgtatttctgtgcgaggaagacggcgggggacgtgagcggggataagagggggtttttttttgatttgtgggggagggggagtagggtgatagtgagcagtgcgagcacgaaggggccgagtgtgtttccgcatgatttgagg

SEQ ID NO: 57268 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgggggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgacaggggccgtgagctatgccaggcgatttcaagggcgcgtgagcttttacatgaccagggaattgggcatggcctatatggatctcaggaacttgcgctttgacgataccgcggtctatttctgtgccaggaaaacggccggggacgtgagcggggacaatcgcgggtactttttcgatctctggggcaggggctcgcgcgtgatagtgagctcggcctcgaccaagggcccgagcgtgttcccgaccatatgcgtg

SEQ ID NO: 57269 - RNA, 423 nt, synthetic construct
  misc_feature 1..423: note = derived and/or modified sequence opt11 from anti-HIV-1_HeavyChain
  source 1..423: mol_type = other RNA
caggtgtatatggagcaagcgggggggggggtgaagaagccgggggcgagtgtgacgttgagttgtaagacggcggatgaggatgtgtttgatgcggcgtatatgcattgggtgaggcaggcgccggggcagacgtttgagtggttggggtggatgaagccggtgacgggggcggtgagttatgcgaggaagtttcaggggagggtgagtttttatatgacgagggagttggggatggcgtatatggatttgaggaatttgaggtttgatgatacggcggtgtatttttgtgcgaggaagacggcgggggatgtgagtggggataatagggggtatttttttgatttgtgggggagggggagtagggtgatagtgagtagtgcgagtacgaaggggccgagtgtgtttccgcatgatttgagg

SEQ ID NO: 57270 - RNA, 423 nt, synthetic construct
  misc_feature 1..423: note = derived and/or modified sequence opt11 from anti-HIV-1_HeavyChain
  source 1..423: mol_type = other RNA
caagtattcatggaacaggccgggggcgggatgaagaaaccgggagcgagcatgaccgtgagctgtaaaacggccgatgaagatatatttgacgcggcctatatgcattgggtgcgccaggccccgggccagacctttgaatggctcgggtggatgaaaccggtcacgggcgcggtcaattacgcgcgccagttccagggcagggtctcgttctatcgcacgcgcgagctcgggatcgcgtacatggacttgcgcgatctcaagttcgatgacacggccgtgtacttttgcgcgcgaaagacaaagggcgatgtctcgggcgatgacaggggctttttctttgacttgtgggggcgcgggaccagggtcatagtatcgagcgcgagcacgaaagggccctcggtctttccccatgacttgcgc

SEQ ID NO: 57271 - RNA, 423 nt, synthetic construct
  misc_feature 1..423: note = derived and/or modified sequence opt11 from anti-HIV-1_HeavyChain
  source 1..423: mol_type = other RNA
caagcccacctcgaacaatccggctcaggcgtcaaaaaacccggcgcctccgtccgcgtctcctgctggacctccgaagacatcttcgaacgcaccgaactcatccactgggtccgccaagcccccggccaaggcctcgaatggatcggctgggtcaaaaccgtcaccggcgcagtcaacttcggctccctcgacttccgccaccgcatctccctcacccgcgaccgcgacctcttcaccgcccacatggacatccgaggcctcacccaaggcgacaccgccacctacttctgcgcccgccaaaaattcgcctcccgctactccggcgaccaaggctcatacttcgacctatggggccgcggcaccctcatcgtcgtctcctccgcctccaccaaaggcccctcagtcttcccccacgaccta

SEQ ID NO: 57272 - RNA, 423 nt, synthetic construct
  misc_feature 1..423: note = derived and/or modified sequence opt11 from anti-HIV-1_HeavyChain
  source 1..423: mol_type = other RNA
caagtgttcatggaacaggccggggccggaatgaagaaaccgggcgcgagcatgaccgtgagctgtaaaacggccgatgaagatgtctttgacgcggcctatatgcattgggtgcgccaggccccgggcccggacttggaatggctcgggtggatgaaaccggtcacgggcgcggtcaattacgcgcgcaagttccagggcagggtctcgttctatcgcacgcgcgagctcgggatcgcgtacatggacttgcgcgatctcagattcgatgacacggccgtgtacttttgcgcgcgcaagaccgcgggcgatgtctcgggcgataaaaggggctttttctttgacttgtgggggcgcgggagcagagtcatagtctcgagcgcgagcacgaaagcgcacaggagctcgcccacgatctgtgtc

SEQ ID NO: 57273 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctccgtccgcgtctcctgctggacctccgaagacatcttcgaacgcaccgaactaatccactgggtccgccaagcccccggccaaggcctcgaatggatcggctgggtcaaaacagtcaccggcgccgtcaacttcggctcccccaacttccgccaccgcatctccctaacccgcgaccgcgacctcttcaccgcccacatggacatccgaggcctcacccaaggcgacaccgccacctacttctgcgcccgccaaaaattcgaatcccgctacaccggcggccaaggctggtacttcgacctctggggccgcggcacccacatcgtcgtctcctccgcatcaaccaaaggcccctcagtcttcccccacgacctacgc

SEQ ID NO: 57274 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgggggcgtgaaaaagcccggggcctcggtcacgctctcgtgcaagaccgcggacgaggacgtgttcgacgccgcgtacatgcactgggtcaggcaagcgccagggcaaacgttcgagtggctgggctggatgaagccagtgaccggggccgtgagctatgccaggaaatttcaagggcgagtgagcttttacatgaccagggaattgggcatggcctatatggatctcaggaacttgcgctttaacgataccgcggtctatttctgtgcaaggaaaacggccggggacgtgagcggggacaatcgcgggtactttttcgatctatggggcaggggctcgcgagtgatcgtgagctcggcctcgaccaagggcccgagcgtgttcccgcacgatctcagg

SEQ ID NO: 57275 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccgggggcggggtcaagaaaccgggcgcgagcgtgaccttgagctgtaaaacggcagatgaagatgtatttgacgcggcctatatgcattgggtgagacaggcaccgggacagacctttgaatggctagggtggatgaaaccggtcacgggagcggtaaattacgcgagaaagttccagggcagggtatcgttctatcgaacgagagagctagggatagcgtacatggacttgcgcaatctgaggttcgatgacacggcagtgtacttttgcgcgagaaagacagcgggagatgtctcgggagataacaggggatatttctttgacctgtgggggagagggagcagggtaatagtatcaagcgcgagcacgaaagggccatcgggattgccacatgacttgagg

SEQ ID NO: 57276 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccgggggcggggtcaagaaaccgggcgcgagcgtaaccttgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacttgcgcaatctcaggttcgatggcacggccgtgtacttttgcgcgcgaaagaccgcgggcgatgtctcgggcgataaaaggggctttttctttgacttgtgggggcgcgggagcagggtcatagtctcgagcgcgagcacgaaagggccctcggtctttccccatgacttgcgc

SEQ ID NO: 57277 - RNA, 423 nt, synthetic construct
  misc_feature 1..423: note = derived and/or modified sequence opt11 from anti-HIV-1_HeavyChain
  source 1..423: mol_type = other RNA
caggtgtatatggagcaggcgggggggggggtgaagaagccgggggcgagcgtgacgttgagctgtaagacggcggatgaggatgtgtttgatgcggcgtatatgcattgggtgagacaggcgccggggcagacatttgagtggttggggtggatgaagccggtgacgggggcagtgaattatgcgagaaagtttcaggggagggtaagtttttataggacgagagagttggggatagcgtatatggatttgaggaatttgaggttcgatgatacggcggtgtatttttgtgcgaggaagacggcgggggatgtgagtggggataagagggggtttttttttgatctgtgggggagggggagcagggtgatagtgagtagtgcgagcacgaaggggccgagtgtgtttccgcatgatttgagg

SEQ ID NO: 57278 - RNA, 423 nt, synthetic construct
  misc_feature 1..423: note = derived and/or modified sequence opt11 from anti-HIV-1_HeavyChain
  source 1..423: mol_type = other RNA
caagtccaactcgtccaatccggcgccgaggtcaaaaaacctggcgcctccctcaaagtctcctgcaaagcctccggctacaccttcaccgactactacatccactgggtccgccaagcccccggacaaggcctcgaatggatcggctgggtcaaaatcgtctccggcaccgtcaacttcgcctccctcgacttccgcaaccgcatctccctctcccgcgaccgcgacctctccaccgcctacatggacatccgcggcctcacccaagacgacaccgccacatacttctgcgcccgccaaaaattcgcctcccgctactccggcgaccaaggctcctacttcgacctctggggccgcggcaccctcatcgtcgtctcctccgcctccaccaaaggcccctcagtcttcccccacgacctacga

SEQ ID NO: 57279 - RNA, 423 nt, synthetic construct
  misc_feature 1..423: note = derived and/or modified sequence opt11 from anti-HIV-1_HeavyChain
  source 1..423: mol_type = other RNA
caggcacatctcgagcaatcgggctcgggcgtgaaaaagcccggggcctcggtcagagtatcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggaccttgatcgtggtctcgagcgcgagcacgcgcgcgcacaggagcccgcacgatctcagg

SEQ ID NO: 57280 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtaaagaaaccgggcgcaagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccagcgcgtgagcttgaccagggacagggacttgttcacggcccatatggatatcaggggcttgacccagggcgataccgcgacctatttctgtgccaggcaaaagttcgagagcagatacacgggcgggcaagggtggtatttcgatctctggggaaggggcacgcacatagtcgtgagctcggcctcgaccaagggcccgagcgtgttcccgcacgatctcagg

SEQ ID NO: 57281 - RNA, 426 nt, synthetic construct
  misc_feature 1..426: note = derived and/or modified sequence opt11 from anti-HIV-1_HeavyChain
  source 1..426: mol_type = other RNA
caagtgcaattggtccagagcggggccgaggtcaagaaaccgggcgcaagtgtgcgcgtgagctgttggacgagcgaggacatattcgataccacggaactgatctattgggtgcgccaggccccgggccagggactggaatggatcgggtgggtgaaaatagtctcaggcacggtcaatttcgcgagcttggacttccgcaatcgcataagcctgagcagggacagggacttgagcacggcctatatggatatcaggggcttgacccaggacgataccgcgacctatttctgcgccaggcaaaaattcgcgagcaggtactcgggcgatcaagggagctatttcgatctctggggcaggggcacgctcatagtcgtgagctcggcctcaaccaagggcccgagcgtgttcccgcaaatatgcgtg

SEQ ID NO: 57282 - RNA, 426 nt, synthetic construct
  misc_feature 1..426: note = derived and/or modified sequence opt11 from anti-HIV-1_HeavyChain
  source 1..426: mol_type = other RNA
cagagccatctcgagcaatcgggctcggccatgaaaaagcccggggcctcagtcagggtctcgtgctggacctcggaagatatctttgaaaggaccgagctcatatactgggtcaggcaagcgcccgggcgcgggctcgagtggataggctggatgaagaccgtgagcgggaccgtgaactttggctcgagcgatttcagaaacaggatctcgctcacgagagatcgcgacctctcgaccgcgcacatggacatacgcgggctaacgcaagatgacacggccacgtacttttgcgcgcgccagaaattcgaatcgctctatagcgatgaccagggctcgtactttgacttgtgggggcgcgggaccttgatcatagtctcgagcgcgagcacgaaagcgcacaggagctcgcccacgaccttgcgc

SEQ ID NO: 57283 - RNA, 423 nt, synthetic construct
  misc_feature 1..423: note = derived and/or modified sequence opt11 from anti-HIV-1_HeavyChain
  source 1..423: mol_type = other RNA
caatcccacctagaacaatccggctccgccatgaaaaaacccggcgcatccgtccgcgtctcatgctggacctccgaagacatcttcgacaccaccgaactcatctactgggtccgccaagcccccggccaaggcctcgaatggatcggctgggtcaaaatcgtatcaggcaccgtcaacttcgcctcactcgacttccgaaaccgcatctccctctcccgcgaccgcgacctctccaccgcccacatggacatccgcggcctcacccaagacgacaccgccacctacttctgcgcccgccaaaaattcgcctcccgctactccggcgaccaaggctcctacttcgacctctggggccgcggcaccctcatcatcgtctcatccgcctccaccaaaggcccctccgtcttcccccgctccgcc

SEQ ID NO: 57284 - RNA, 423 nt, synthetic construct
  misc_feature 1..423: note = derived and/or modified sequence opt11 from anti-HIV-1_HeavyChain
  source 1..423: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggccagggcttggaatggatcgggtgggtgaaaacggtcacgggcgcggtcaatttcgggcaccagatctcggacagggtctcgctatcgcgcgatcgcgatctctcgaccgcgtacatggacatacgcgggctcacgcaagatgacacggccacgtacttttgcgcgcgccagaaattcgcctcgcgctatagcggggaccagggctcgtactttgacctgtgggggcgcgggaccttgatcgtggtctcgagcgcgagcacgaaagggccctcggtctttccccatgacttgcga

SEQ ID NO: 57285 - RNA, 423 nt, synthetic construct
  misc_feature 1..423: note = derived and/or modified sequence opt11 from anti-HIV-1_HeavyChain
  source 1..423: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggctgggtcaagatcgtgagcgggaccgtgaacttcgcctcgctcgatttcagaaacagaatctcgctctcacgcgaccgcgatctctcgaccgcgcacatggacatacgcgggctcacgcaagatgacacggccacgtacttttgcgcgcgccagaaatttgcctcgcgctatagcggggaccagggctcgtactttgacttgtgggggcgcgggaccctgatcatagtatcgagcgcgagcacgcgcgcgcacaggagctcacccaggagcgcg

SEQ ID NO: 57286 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggagcgagcgtgcgcgtgagctgttggacgagcgaggacatattcgagaaatcggaattgatccattgggtgcgccaggccccgggccagggcttggaatggatcgggtgggtgaaaacggtcacgggcgcggtcaatttcgggagctcggactttcgccatcgcatcagcttgacaagggacagagacttgttcacggcccatatggatataaggggcttgacccagggcgataccgcgacctatttctgtgccaggcaaaagttcgagagcaggtacacgggcgggcaagggtggtatttcgatctctggggcaggggcacgcacatagtcgtgagctcggcctcgaccaagggcccgagcgtgttcccgcacgatctcagg

SEQ ID NO: 57287 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcggctcctccgacttccgcaaccgcatctccctcacccgagaccgcgacctctcaaccgcccacatggacatccgcggcctcacccaagacgacaccgccacctacttctgcgcccgccaaaaattcgaatccctctactccgacgaccaaggctcctacttcgacctctggggccgcggcaccctcatcatcgtctcctcagcctccaccaaaggcccctccgtcttccccaccatctacgtc

SEQ ID NO: 57288 - RNA, 426 nt, synthetic construct
  misc_feature 1..426: note = derived and/or modified sequence opt11 from anti-HIV-1_HeavyChain
  source 1..426: mol_type = other RNA
cagagccatctcgagcaatcgggctcggccatgaaaaagcccggggcctcggtccgggtctcatgctggacctcggaagatatctttgacacgaccgagctcatatactgggtcaggcaagcgcccgggcaagggctcgagtggataggctgggtcaagatcgtaagcgggaccgtgaactttgcctcgctcgacttcaggaacaggatctcactctcgcgcgatcgcgatctctcaacagcgtacatggacatacgcgggctcacgcaagatgacacggccacgtacttttgcgcgcgccagaaatttgcctcacgctatagcggagaccagggctcgtactttgacctgtgggggcgcgggaccttgatcgtggtctcgagcgcgagcacgaaagggccctcggtctttccccatgacttgcgc

SEQ ID NO: 57289 - RNA, 423 nt, synthetic construct
  misc_feature 1..423: note = derived and/or modified sequence opt11 from anti-HIV-1_HeavyChain
  source 1..423: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggaaccgtaaacttcgcctccctcgacttccgcaaccgcatctccctctcccgagaccgcgacctctccaccgcccacatggacatccgcggcctcacccaagacgacaccgccacctacttctgcgcccgccaaaaattcgcctcccgctactccggcgaccaaggctcatacttcgacctctggggccgcggcaccctcatcatcgtctcctccgcctccaccaaaggcccctcagtcttccccaccatctgc

SEQ ID NO: 57290 - RNA, 417 nt, synthetic construct
  misc_feature 1..417: note = derived and/or modified sequence opt11 from anti-HIV-1_HeavyChain
  source 1..417: mol_type = other RNA
caagcacacctagaacaaagcggaagcggagtcaaaaaaccaggcgcaagcgtacgagtcagctgctggacatccgaagacatattcgaacgcacagaactaatccactgggtccgccaagcccccggccaaggcctagaatggatcggctgggtaaaaacagtcacaggcgcagtcaacttcggcagcccaaacttccgccaccgcgtaagcctaaccagagacagagacctaagcacagcccacatggacatccgaggcctaacccaagacgacaccgcaacctacttctgcgccagacaaaaattcgcacgcggagaccaaggctggttcttcgacctatggggccgcggaaccctaatagtagtctcaagcgcactccaccaaggacccatcggcctacccccacgctcaacc

SEQ ID NO: 57291 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccgggggcggggtcaagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcggtcaattacgcgcgcaagttccagggcagggtctcgttctatcgcacgcgcgagctcgggatcgcgtacatggacctgcgcaacctcagattcgatgacacggccgtgtacttttgcgcgcgcaagaccgcgggcgatgtctcaggcgataaaaggggctttttctttgacttgtgggggcgcgggagcagggtcatagtctcgagcgcgagcacgaaagggccctcggtcttgcccccgcgctcggcc

SEQ ID NO: 57292 - RNA, 423 nt, synthetic construct
  misc_feature 1..423: note = derived and/or modified sequence opt11 from anti-HIV-1_HeavyChain
  source 1..423: mol_type = other RNA
caagtccaactagtccaatccggcgccgaagtcaaaaaacccggcgcctccgtcaaaatctcctgcaaagcctccggctacaccttcatccgccacggcatccactggctccgccaagtccccggccaacgccccgaatggatgggctggatccgccccaaaaccggcgcccgcaaccaagcccgccaattccaaccccgcatctccctcgcccgcgaccgcgccctctccaccgcctacctagacctcaactccctcacctcagccgactccggcacctacttctgcgcccgccaaaccttcaaacccgacttctacttcgccgaccaaggctggtccttcaacctctggggccgcggcgcccacttcatcgtctcctccgccctccaccaaggccccatcggcctccccccccgctccacc

SEQ ID NO: 57293 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatcaggctccgccatgaaaaaaccaggcgcctccgtccgcgtatcctgctggacctccgaagacatcttcgaacgcaccgaactcatctactgggtccgccaagcccccggccaaggcctcgaatggatcggctgggtcaaaatcgtctcaggcaccgtcaacttcgcctccctcgacttccgcaaccgcatctcactctcccgcgaccgcgacctctccaccgcctacatggacatccgcggcctcacccaagacgacaccgccacctacttctgcgcccgccaaaaattcgcctcacgctactcaggcgaccaaggctcctacttcgacctctggggccgcggcaccctcatcgtcgtctcctccgcctccaccaaaggcccctccgtcttcccccacgacctccgc

SEQ ID NO: 57294 - RNA, 426 nt, synthetic construct
  misc_feature 1..426: note = derived and/or modified sequence opt11 from anti-HIV-1_HeavyChain
  source 1..426: mol_type = other RNA
caagcgcacctggaacagagcgggagcggggtcaagaaaccaggcgcgagcgtgcgcgtgagctgttggacgagcgaggacatattcgagcgcacggaactgatccattgggtgcgccaggccccgggccagggcctggaatggatcggatgggtgaaaacggtcacgggcgcggtcaatttcgggagcttggactttcgccatcgaatcagcttgaccagggacagggacttgttcacggcccatatggatataaggggattgacccagggcgatacagcgacctatctctgtgccaggcaaaagttcgagagcaggtacacgggagggcaagggtggtatttcgatctctggggcaggggcacgcacatagtcgtgagctcggcctcgaccaagggcccgagcgtgttcccgaccatatgcgtg

SEQ ID NO: 57295 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcggaagcggggtcaagaaaccgggcgcgagcgtgcgcgtgagctgttggacgagcgaggacatattcgataccacggaactgatctattgggtgcgccaggccccgggccagggcttggaatggatcgggtgggtgaaaatagtctcgggcacggtcaatttcgcgagcttggactttcgcaatcgcataagcctgagcagggacagggacttgagcacggcctatatggatatcaggggcctgacccaggacgataccgcgacctatttctgcgccaggcaaaagttcgcgagcaggtactcaggcgatcaagggagctatttcgatctctggggcaggggcacgctcatagtcgtgagctcggcctcgaccaagggcccgagcgtgttcccgcaaatatgcgtg

SEQ ID NO: 57296 - RNA, 426 nt, synthetic construct
  misc_feature 1..426: note = derived and/or modified sequence opt11 from anti-HIV-1_HeavyChain
  source 1..426: mol_type = other RNA
caagcacacctagaacaaagcggaagcggggtcaagaaaccaggcgcgagcgtacgcgtgagctgctggacaagcgaagacatattcgagcgcacggaactaatccactgggtgcgccaagccccaggccagggcctagaatggatcgggtgggtgaaaacagtcacaggcgcagtcaacttcggaagcctcgacttccgccaccgcataagcctaaccagggacagggacctattcacagcccacatggacatcagaggcctaacccagggcgacaccgccacctacttctgcgccagacaaaagttcgaaagcagatacacaggcgggcaagggtggtacttcgacctatggggcaggggcacacacatagtcgtaagctcggcctcgaccaagggcccaagcgtattcccaaccatatgcgtg

SEQ ID NO: 57297 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtaaaaaaacccggcgcctccgtacgcgtctcctgctggacctccgaagacatcttcgaaaaatccgaactcatccactgggtccgccaagcccccggccaaggcctcgaatggatcggctgggtcaaaacagtcaccggcgccgtcaacttcggctccagcgacttccgccaacgcgtctccctcacccgcgaccgcgacctcttcaccgcccacatggacatacgcggcctcacccaaggagacaccgccacctacttctgcgcccgacaaaaattcgaatcactctactccgacgaccaaggctcctacttcgacctctggggccgcggcaccctcatcatagtctcctccgcctcaaccaaaggcccctccgtcttccccaccatctgcgtc

SEQ ID NO: 57298 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagtgggagcggggtcaagaaaccgggagcgagcgtacgagtgagctgctggacaagcgaggacatattcgagcgcacggaactgatccattgggtgcgccaggccccaggccagggcctggaatggatcggatgggtgaaaacggtctcgggcgcggtcaatttcgggagcccgaactttcgccatcgcgtgagcctaaccagggacagggacttgttcacggcccatatggatatcagaggcttgacccagggagataccgcgacctatttctgtgccaggcaaaagttcgagagcaggtacacgggcgggcaagggtggtatttcgatctctggggcaggggcacgcacatagtcgtgagctcggcctcgaccaagggcccgagcgtgttcccgcacgatctcagg

SEQ ID NO: 57299 - RNA, 426 nt, synthetic construct
  misc_feature 1..426: note = derived and/or modified sequence opt11 from anti-HIV-1_HeavyChain
  source 1..426: mol_type = other RNA
caatcccacctagaacaatccggctccgccatgaaaaaacccggcgcctccgtccgtgtctcatgctggacatccgaagacatcttcgacaccaccgaactaatctactgggtccgacaagcccccggccaaggcctcgaatggatcggctgggtcaaaatcgtctccggcaccgtcaacttcgcctcactcgacttccgcaaccgcatctccctctcccgcgaccgagacctctccaccgcccacatggacatccgcggcctcacccaagacgacaccgccacctacttctgcgcccgacaaaaattcgcctcccgatactccggcgaccaaggctcctacttcgacctctggggccgcggcaccctcatcatcgtctcctccgcctccaccaaaggcccctccgtcttccccaccatctgcgtc

SEQ ID NO: 57300 - RNA, 426 nt, synthetic construct
  misc_feature 1..426: note = derived and/or modified sequence opt11 from anti-HIV-1_HeavyChain
  source 1..426: mol_type = other RNA
caagcacacctcgaacaatccggctccggagtcaaaaaacccggagcctcagtccgcgtctcctgctggacctccgaagacatcttcgaacgcaccgaactcatccactgggtccgccaagcccccggccaaggcctcgaatggatcggctgggtcaaaaccgtcaccggcaccgtcaacttcggctccctcaacttccgccaacgcgtctccctcacccgagaccgcgacctcttcacagcccacatggacatccgcggcctcacacaagacgacaccgccacctacttctgcgcccgacaaaaattcgcctcccgctactccggcgaccaaggctcctacttcgacctctggggccgcggcaccctcatcgtcgtctcctccgcctccaccaaaggcccctccgtcttccccaccatctgcgtc

SEQ ID NO: 57301 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctcagtccgcgtctcatgctggacctccgaagacatcttcgacaccaccgaactcatctactgggtccgccaagcccccggacaaggcctcgaatggatcggctgggtcaaaatcgtctccggcaccgtcaacttcgcctccctcgacttccgcaaccgcatctccctctcacgcgaccgcgacctctccaccgcccacatggacatccgcggcctcacccaagacgacaccgcaacctacttctgcgcccgccaaaaattcgcctcccgctactccggcgaccaaggctcatacttcgacctctggggccgcggcaccctcatcatcgtctcctccgcctccaccaaaggccaccgctcctcccccaccatctgcgtc

SEQ ID NO: 57302 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccggggccgggatgaagaaaccgggcgcgagcatgaccgtgagctgtaaaacggccgatgaagatgtctttgacgcggcctacatgcattgggtgcgacaggcaccaggccagacctttgaatggctcgggtggatgaaaccggtcacgggcgcggtcaattacgcgcgcaagttccagggcagggtctcgttctatcgaacgcgcgagctcgggatcgcgtacatggacttgcgcaatctcaggttcgatgacacggccgtgtacttttgcgcgcgcaagaccgcgggcgatgtctcgggcgataaaaggggctttttctttgacttgtgggggcgcgggagcagagtcatagtctcgagcgcgagcacgaaagggccatcggtctttccaacgatctatgta

SEQ ID NO: 57303 - RNA, 423 nt, synthetic construct
  misc_feature 1..423: note = derived and/or modified sequence opt11 from anti-HIV-1_HeavyChain
  source 1..423: mol_type = other RNA
caatcgcacttggaacagagcgggagcgcgatgaagaaaccgggcgcgagcgtgcgcgtgagctgttggacgagcgaggacatattcgataccacggaactgtactgggtcaggcaagcgcccgggcaaggactcgagtggataggctgggtcaagatcgtgagcgggaccgtgaactttgcctcgctcgatttcaggaacaggatctcgctctcgcgcgatcgcgatctctcgaccgcgtacatggacatacgcgggctcacgcaagatgacacggccacgtacttttgcgcgcgccagaaatttgcctcgcgctatagtggggaccagggctcgtactttgacttgtgggggcgcgggaccttgatcgtggtctcgagcgcgagcacgaaagggccctcggtctttccccatgacttgcgc

SEQ ID NO: 57304 - RNA, 423 nt, synthetic construct
  misc_feature 1..423: note = derived and/or modified sequence opt11 from anti-HIV-1_HeavyChain
  source 1..423: mol_type = other RNA
caatcgcacctggaacagagcgggagcgcgatgaagaaaccaggcgcgagcgtgcgcgtgagctgttggacgagcgaggacatattcgataccacggaattgatctattgggtgcgccaggccccgggccagggcttggaatggatcgggtgggtgaaaatagtctcgggcacagtcaatttcgcgcgccagttccagggcagggtctcgttctatcgcacgcgcgagctcgggatcgcgtacatggacttgcgcgatctcaagttcgatgacacggccgtgtacttttgcgcgcgcaagaccaagggagatgtctcgggcgatgacaggggctttttcttcgacttgtgggggcgcgggaccagggtcatagtctcgagcgcgagcacgaaagggccctcggtctttccccatgacccggcc

SEQ ID NO: 57305 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggcgcgagcgtgcgcgtgagttgttggacgagcgaggacatattcgagaaatcggaattgatccattgggtgcgacaggccccgggccagggcctggaatggatcgggtgggtgaaaacggtcacgggagcggtcaatttcgggagctcggactttcgccagcgcgtgagcttgaccagggacagggacttgttcacggcacatatggatatcaggggattgacacagggggatacagcgacctatttctgtgccaggcaaaagttcgagagcaggtacacgggagggcaagggtggtatttcgatctatggggcaggggcacgcacatagtcgtgagctcggcctcgaccaagggaccgagcgtgttcccgacaatatgcgtg

SEQ ID NO: 57306 - RNA, 426 nt, synthetic construct
  misc_feature 1..426: note = derived and/or modified sequence opt11 from anti-HIV-1_HeavyChain
  source 1..426: mol_type = other RNA
caagcgcacctggaacagagcggaagcggagtaaagaaaccgggcgcgagcgtgcgcgtaagctgctggacgagcgaagacatattcgagcgctcagaactgatccactgggtgcgacaggccccgggccagggcctagaatggatcggatgggtgaaaacggtcacaggcgcggtcaacttcggaagcccgaacttccgccagcgcgtaagcctgaccagagacagagacctaagcacagcccacatggacatcagaggcctaacccaagacgacaccgcgacatacttctgcgcccggcaaaaattcgaaagcctatactcagacgaccaaggaagctacttcgacctctggggcagaggcacgctcataatcgtaagctcagcctcaacaaagggcccaagcgtgttcccgaccatatgcgtg

SEQ ID NO: 57307 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgcgagcggggtcaagcgcccgggagcgagcgtgcgagtgagctgttggacgagcgaggacatattcgagcgcacggaattgatctattgggtgcgccaggccccgggccagggcttggaatggatcgggtgggtgaaaacggtatcgggcgcggtcaatttcgggagccaggactttcgcgatcgctttagcctgaccagggacagggacttgttcacggcccatatggatatcaggggcctgacccagggcgataccgcgacatatttctgtgccaggcaaaagttcgcgagcaggtactcgggcgatcaagggagctatttcgatctctggggcaggggcacgctcatagtcgtgagctcggcctcgaccaagggcccgagcgtgttcccgaccatatgcgtg

SEQ ID NO: 57308 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaactcggcgcctccgtccgcgtctcctgctggacctccgaagacatcttcgaacgcaccgaactcatccactgggtccgccaagcccccggccaaggcctcgaatggatcggctgggtcaaagccgtctccggcgccgtaaactacggctccctcgacttccgccacagagtctccctcacccgcgaccgcgacctcttcaccgcccacatggacatccgaggcctcacccaagacgacaccgccacctacttctgcgcccgccaaaaattcgaatcacgctacaccggcggccaaggctggtacttcgacctctggggccgcggcacccacatcgtcgtctcctccgcctccaccaaaggcccctccgtcttccccaccatctgcgtc

SEQ ID NO: 57309 - RNA, 423 nt, synthetic construct
  misc_feature 1..423: note = derived and/or modified sequence opt11 from anti-HIV-1_HeavyChain
  source 1..423: mol_type = other RNA
caggtccatatggagcaagcgggcgggggcatgaaaaagcccggggcctcgatgacggtctcgtgcaagacagcggacgaggacatattcgatgccgcgtacatgcactgggtcaggcaagcgcccgggcaaacgttcgagtggttgggctggatgaagccagtgaccggggccgtgaactatgccaggcaatttcaagggcgcgtgagcttcctccaggaccagggcatacgcatagcctatatggatctcagggacttgaaatttgacgataccgcggtctatttctgtgccaggaaaacgaaaggggacgtgagcggggacgatcgcgggttctttttcgatctatggggcaggggcacgcgcgtgatcgtgagctcgagcttgcaccagggcccgatcgggctcccgcccaggagcgcg

SEQ ID NO: 57310 - RNA, 426 nt, synthetic construct
  misc_feature 1..426: note = derived and/or modified sequence opt11 from anti-HIV-1_HeavyChain
  source 1..426: mol_type = other RNA
caggcccatctcgagcaatcgggctcgggcgtgaaaaagcccggggcctcagtcagggtctcgtgctggacctcggaagacatctttgaaaagagcgagctcatacactgggtccggcaagcgcccgggcaaggactagagtggataggctgggtcaagaccgtgaccggggccgtgaactttggctcgagcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagcgcgagcacgaaagggccctcggtctttcccacgatctatgtc

SEQ ID NO: 57311 - RNA, 426 nt, synthetic construct
  misc_feature 1..426: note = derived and/or modified sequence opt11 from anti-HIV-1_HeavyChain
  source 1..426: mol_type = other RNA
caggtctatatggagcaagcgggcgggggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgaccggggccgtgaactatgccaggaactttcaagggcgcgtgagcttttacaggaccagggaattgggaatagcctatatggatctcaggaacctgcgctttgacgacaccgcggtctatttctgtgccaggaaaacgaaaggggacgtgagcggggacgatcgcgggttctttttcgatctctggggcaggggcacgcgcgtgatcgtgagctcgggcctgcaccagcgcgcacacaggagctcgcccacgatctgtgtc

SEQ ID NO: 57312 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggatcagccatgaaaaaacccggcgcctccgtccgcgtctcatgctggacctccgaagacatcttcgacaccaccgaactaatatactgggtccgccaagcccccggccaaggcctcgaatggatcggctgggtaaaaatagtctccggcaccgtcaacttcgcctccctcgacttccgcaaccgcatctccctctcccgcgaccgcgacctctccaccgcctacatggacatccgcggactcacccaagacgacaccgccacctacttctgcgcccgccaaaaattcgcctcccgctactccggcgaccaaggctcatacttcgacctctggggccgcggcaccctcatcgtcgtctcctccgcctccacaaaaggcccctccgtcttccccaccatctgcgtc

SEQ ID NO: 57313 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgtgggcgtgaaaaagcccggggcatcggtcacgctatcgtgcaagaccgcggacgaggacgtgttcgatgccgcgtacatgcactgggtaaggcaagcgcccgggcccgatctcgagtggttgggctggatgaagcccgtgaccggggccgtgaactatgcaaggaaatttcaagggcgcgtgagcttttacagaaccagggaattgggcatagcctatatggatctcaggaacttgcgatttgacgataccgcggtctatttctgtgccaggaaaacggccggggacgtgagcggggacaagcgcgggttctttttcgatctctggggcaggggctcgcgagtgatcgtgagctcggcctcgaccaagggcccgagcgtgttcccgaccatatgcgtg

SEQ ID NO: 57314 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctccctcgacttccgcaaccgaatctccctctcccgcgaccgcgacctctccaccgcccacatggacatccgcggcctcacccaagacgacacagccacctacttctgcgcccgccaaaaattcgcctcccgctactccggcgaccaaggctcctacttcgacctctggggccgcggcaccctaataatcgtctcctccgcctccaccaaaggcccctccgtcttcccccacgacctccgc

SEQ ID NO: 57315 - RNA, 426 nt, synthetic construct
  misc_feature 1..426: note = derived and/or modified sequence opt11 from anti-HIV-1_HeavyChain
  source 1..426: mol_type = other RNA
caagcgcacctggaacagagcgggagcggggtcaagaaattgggcgcgagcgtgcgcgtgagctgttggacgagcgaggacatattcgagcgcacggaattgatccattgggtgcgccaggccccgggccagggcttggaatggatagggtgggtgaaagcagtcacgggcgcggtcaatttcggcagcttggactttcgccatcgcataagcctgaccagggacagggacttgttcacggcccatatggatatcaggggactgacccagggcgataccgcgacctatttctgtgccaggcaaaagttcgagagcaggtacacgggcgggcaagggtggtatttcgatctctggggcaggggcacgcacatagtcgtgagctcggcctcgaccaagggaccgagcgtattcccgcacgatctcagg

SEQ ID NO: 57316 - RNA, 426 nt, synthetic construct
  misc_feature 1..426: note = derived and/or modified sequence opt11 from anti-HIV-1_HeavyChain
  source 1..426: mol_type = other RNA
caagcccacctagaacaatccggctccggcgtcaaaaaacccggcgcctccgtccgcgtctcctgctggacatcagaagacatcttcgaacgcaccgaactcatccactgggtccgccaagcccccggccaaggcctcgaacgcatcggctgggtcaaaaccgtcaccggcgccgtcaacttcggatccctcgacttccgccaccgcatctccctcacacgcgaccgcgacctcttcaccgcccacatggacatccgcggcctcacccaaggcgacaccgccacctacttctgcgcccgccaaaaattcgaatcccgctacaccggcggccaaggctggtacttcgacctctggggccgcggcacccacatcgtcgtctcctccgcctccaccaaaggcccctccgtcttccccaccatctgcgtc

SEQ ID NO: 57317 - RNA, 423 nt, synthetic construct
  misc_feature 1..423: note = derived and/or modified sequence opt11 from anti-HIV-1_HeavyChain
  source 1..423: mol_type = other RNA
gaggtgtatatggagagggggaggggaggggtgaagaagccgggggcgagtgcgacgctgagttgcaagacggcggacgaggatgtgtttgatgcggcgtacatgcattgggtgaggcaggcgccggggcagacgtttgagtggctggggtggatgaagccggtgacgggggcggtgagctatgcgaggaagttccaggggagggtgagcttttatatgacgagggagctgggaatggcgtacatggatctgaggaatttgaggtttgatgatacggcggtgtacttctgtgcgaggaagacggcgggggatgtgagtggggataataggggatatttctttgatctgtggggaagggggagcagggtgatagtgagtagtgcgagtacgaagggaccgagcgtgtttccgcatgatttgagg

SEQ ID NO: 57318 - RNA, 426 nt, synthetic construct
  misc_feature 1..426: note = derived and/or modified sequence opt11 from anti-HIV-1_HeavyChain
  source 1..426: mol_type = other RNA
caggcccatctcgagcaatcgggctcgggcgtgaaaaagcccggggcctcggccagggtctcgtgctggagctcggaagatatctttgaaaggatcgagctcatacactgggtcaggcaagcgcccgggcaagggctcgagtggataggctgggtcaagaccgtggccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtagtctcgagcgcgagcacgaaagggccctcggtctttccccatgacctgcgc

SEQ ID NO: 57319 - RNA, 426 nt, synthetic construct
  misc_feature 1..426: note = derived and/or modified sequence opt11 from anti-HIV-1_HeavyChain
  source 1..426: mol_type = other RNA
caatcccacctagaacaatccggctccgccatgaaaaaacccggcgcctccgtccgagtctcctgctggacatccgaagacatcttcgacaccaccgaactcatctactgggtccgccaagcccccggccaaggcctcgaatggatcggctgggtcaaaatcgtctcaggcaccgtaaacttcgcctccctcgacttccgcaaccgcatctccctatcccgcgaccgcgacctctccaccgcccacatggacatccgaggcctacgccaagacgacaccgccacctacttctgcgcccgccaaaaattcgaatcccgctactccggcgaccaaggctcctacttcgacctctggggccgcggcaccctcatcatcgtctcctccgcctccaccaaaggcccctccgtattccccaccatctacgtc

SEQ ID NO: 57320 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtatccggcaccgtcaacttcgcctccctcgacttccgcaacggcatctcactctcccgcgaccgcgacctctcaaccgcctacatggacatccgcggcctcacccaagacgacaccgccacctacttctgcgcccgccaaaaattcgcctcccgctactccggcgaccaaggctcctacttcgacctctggggccgcggcaccctcatcgtcgtctcatccgcctccaccaaaggcccctccgtcttcccccacgacctccgc

SEQ ID NO: 57321 - RNA, 426 nt, synthetic construct
  misc_feature 1..426: note = derived and/or modified sequence opt11 from anti-HIV-1_HeavyChain
  source 1..426: mol_type = other RNA
cagagccatctcgagcaatcgggctcagccatgaaaaagcccggggcctcggtcagggtctcatgctggacctcggaagatatctttgacacgaccgagctcatatactgggtcaggcaagcgcccgggcaaggactcgagtggataggctgggtcaagatcgtgagcgggaccgtgaactttgcctcactcgatttcaggaacaggatctcgctctcgcgcgatcgcgatctctcgaccgcgcacatggacatacgcgggctcacgcaagatgacacggccacgtacttttgcgcgcgccagaaatttgcctcgcgctacagcggggaccagggctcgtacttcgacctgtgggggcgcgggaccctgatcgtggtctcaagcgcgagcacgaaagggccctcggtcttcccccacgacttgcgc

SEQ ID NO: 57322 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggcgcgagcgtgcgagtgagctgttggacgagcggggacatactcaggaaatcggaattgatccattgggtgagacaggccccgggccagggcctggaatggatcgggtgggtgaaaacggtcacgggcgcggtcaatttcgggagcttggactttcgccatcgaatcagcttgaccagggacagggacttgttcacggcccatatggatataaggggcttgacccagggagataccgcgacatatttctgtgccaggcaaaagttcgagagcagatacacgggcgggcaagggtggtatttcgatctctggggcagaggcacgcacatagtcgtgagctcggcctcgaccaagggcccgagcgtgttcccgcacgatctcagg

SEQ ID NO: 57323 - RNA, 426 nt, synthetic construct
  misc_feature 1..426: note = derived and/or modified sequence opt11 from anti-HIV-1_HeavyChain
  source 1..426: mol_type = other RNA
caagtccacctagaacaaagcggcagcggcgtcaaaaaacccggagcctccgtccgcgtctcctgctggtcatcagaagacatcttcgaacgcaccgaactaatccactgggtccgccaagcccccggccaaggcctcgaatggatcggctgggtcaaaaccgtcaccggcgccgtcaacttcggctccctcgacttccgccaccgcatctccctcacccgagaccgagacctattcacagcccacatggacatccgaggcctaacccaaggcgacaccgccacctacttctgcgccagacaaaaattcgaaagccgctacaccggcggacaaggctggtacttcgacctctggggccgcggcacccacatcgtcgtctcctcagcctgcaccaaaggcccctccgtcttcccacacgacctacgc

SEQ ID NO: 57324 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatcctggtccggcgtcaaaaaaccaggcgcctccgtccgagtctcctgctggtcctccgaagacatcttcgaacgcaccgaactaatccactgggtccgccaagcccccggccaaggcctcgaatggatcggctgggtcaaaaccgtcaccggagccgtcaacttcggctccctcgacttccgccaccgcatctccctcacccgcgaccgcgacctcttcaccgcccacatggacatacgcggcctcacccaaggcgacaccgccacctacttctgcgcccgacaaaaattcgaatcccgctacaccggcggccaaggctggtacttcgacctatggggccgcggcacccacatcgtcgtctcatccgcctccaccaaaggaccctcagtcttcccccacgacctccgc

SEQ ID NO: 57325 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctccgtccgcgtctcctgctggacctcagaagacatcttcgaacgcaccgaactcatctactgggtccgacaagcccccggccgcggccccgaatggatcggctgggtaaaaaccgtatccggcaccgtcaacttcggctcctccgacttccgaaaccgcatctccctcacccgcgaccgcgacctctccaccgcccacatggacatccgcggcctcacccaagacgacaccgccacctacttctgcgcccgccaaaaattcgaatccctctactccgacgaccaaggctcctacttcgacctctggggccgcggcaccctcatcatcgtctcctcagcctcaaccaaaggcccctccgtcttcccccacgacctccga

SEQ ID NO: 57326 - RNA, 426 nt, synthetic construct
  misc_feature 1..426: note = derived and/or modified sequence opt11 from anti-HIV-1_HeavyChain
  source 1..426: mol_type = other RNA
caggcccatctcgagcaatcgggctcgggagtgaaaaagcccggggcctcggtcagggtctcgtgctggagctcagaagatatctttgaaaggaccgagctcatacactgggtcaggcaagcgcccgggcaagggctcgagtggataggctgggtcaagaccgtgaccggggccgtgaactttggctcgctagatttcaggcacaggatctcgctcacgcgcgatcgcgatctctttaccgcgcacatggacatacgcgggctcacgcaaggggacacggccacgtacttttgcgcgcgccagaaatttgaatcgcgctataccgggggccagggctggtactttgacttgtgggggcgcgggacacatatcgtggtctcgagcgcgagcacgaaagggccctcggtctttcccacgatcttgcgc

SEQ ID NO: 57327 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggatccgccatgaaaaaacccggcgcctccgtccgcgtctcatgctggacctccgaagacatattcgaacgaaccgaactaatctactgggtccgccaagcccccggccgcggactcgaatggatcggctgggtcaaaaccgtctccggcaccgtcaacttcggctcctccgacttccgcaaccgcatctccctcacccgcgaccgcgacctctccaccgcccacatggacatccgcggcctcacccaagacgacacagccacctacttctgcgcccgccaaaaattcgaatccctctactccgacgaccaaggctcctacttcgacctctggggccgcggaaccctcatcgccgtctcctccgcctccaccaaaggcccctccgtcttcccccacgacctccgc

SEQ ID NO: 57328 - RNA, 426 nt, synthetic construct
  misc_feature 1..426: note = derived and/or modified sequence opt11 from anti-HIV-1_HeavyChain
  source 1..426: mol_type = other RNA
caatcccacctcaaacaatcaggctccgccatgaaaaaacccggcgcctccgtccgcgtctcctgctggacctccgaagacatcttcgaacgcaccgaactcatctactgggtccgccaagcccccggccgcggcctcgaatggatcggctgggtcaaaaccgtctccggcaccgtcaacttcggctcatccgacttccgcaaccgaatctccctcaccagagaccgcgacctctccaccgcccacatggacatccgcggcctcacccaagacgacacagccacctacttctgcgctcgccaaaaattcgaatccctctactccgacgaccaaggctcctacttcgacctctggggccgcggcaccctcatcatcgtctcatccgcctccaccaaaggcccctccgtcttcccccacgacctccgc

SEQ ID NO: 57329 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaattgggcgcgagcgtgcgcgtgagctgttggacgagcgaggacatattcgagcgcacggaactgatacattgggtacgccaggccccgggccagggcttggaatggatcgagtgggtgaaagcggtctcgggcgcggtaaattacgggagcttggactttcgccaccgcgtgagcttgaccagggacagggacttgttcacggcccatatggatatcaggggcttgacccaggacgataccgcgacctatttctgtgccaggcaaaagttcgagagcaggtacacgggcgggcaagggtggtatttcgatctctggggcaggggcacacacatagtcgtgagctcggcctcgaccaagggcccgagcgtgttcccgcacgatctaagg

SEQ ID NO: 57330 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctcagccatgaaaaaacccggcgcctccgtccgcgtctcctgctggacctccgaagacatcttcgacaccaccgaactcatctactgggtccgccaagcccccggccaaggcctagaatggatcggctgggtcaaaatcgtctccggcaccgtcaacttcgcctccctcgacttccgcaaccgcatctccctatcccgcgaccgcgacctctctaccgcccacatggacatccgcggcctaacccaagacgacaccgccacctacttctgcgcccgacaaaaattcgaatcccgctactccggcgaccaaggctcctacttcgacctatggggccgaggcaccctcataatcgtctcatccgcctccaccaaaggcccctccgtcttcccccacgacctccgc

SEQ ID NO: 57331 - RNA, 426 nt, synthetic construct
  misc_feature 1..426: note = derived and/or modified sequence opt11 from anti-HIV-1_HeavyChain
  source 1..426: mol_type = other RNA
caagcgcacctagaacagagcggaagcggggtcaagaaaccgggcgcaagcgtgcgcgtgagctgttggacgagcgaggacatattcgagaaatcggaactgatccattgggtgcgccaggccccgggccagggcttggaatggatcgggtgggtgaaaacagtcacgggcgcggtcaatttcgggagcttggacttccgcaatcgcatcagcttgagcagagacagggacttgagcacggcctatatggatataaggggcctgacccaggacgataccgcgacctatttctgtgccaggcaaaagttcgcgagcaggtactcgggcgatcaagggagctatttcgatctctggggcaggggcacgctcatagtagtgagctcggcctcgaccaagggcccgagcgtgttcccgcacgatctcagg

SEQ ID NO: 57332 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctccgtccgcgtctcctgctggacctccgaagacatattcgaacgctccgaactaatccactgggtccgccaagcccccggccaaggcctcgaatggatcggctgggtcaaaaccgtcaccggcgccgtcaacttcggctcacccaacttccgccaacgcgtctccctctcccgcgaccgcgacctctccaccgcccacatggacatccgcggcctcacccaagacgacaccgccacctacttctgcgcccgccaaaaattcgcctcacgctactccggcgaccaaggctcctacttcgacctctggggccgcggcaccctcatcatcgtctcctccgcctccaccaaaggcccctccgtcttcccccacgacctacga

SEQ ID NO: 57333 - RNA, 426 nt, synthetic construct
  misc_feature 1..426: note = derived and/or modified sequence opt11 from anti-HIV-1_HeavyChain
  source 1..426: mol_type = other RNA
caatcccacctagaacaatcaggctcagccatgaaaaaacccggcgcctccgtccgcgtctcctgctggacctccgaagacatcttcgaacgcaccgaactcatctactgggtccgacaagcccccggccgcggcctcgaatggatcggctgggtcaaaaccgtctccggcaccgtaaacttcggctcctccgacttcagaaaccgcatctccctcacccgcgaccgcgacctatccaccgcccacatggacatccgcggcctcacccaagacgacaccgccacctacttctgcgcccgccaaaaattcgaatccctctactccgacgaccaaggctcctacttcgacctctggggccgcggcaccctaatcatagtctcctcagcctccaccaaaggcccctccgtcttcccccacgacctccgc

SEQ ID NO: 57334 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctccgtccgcgtctcctgctggacatcagaagacatcttcgaacgcaccgaactcatccactgggtccgccaagcccccggccgcggcctcgaatggataggctgggtcaaaaccgtctcaggcaccgtcaacttcggctcctccgacttccgcaaccgcatctccctcacccgcgaccgcgacctctcaaccgcccacatggacatccgcggcctcacacaagacgacaccgccacctacttctgcgcccgccaaaaattcgaatccctctactccgacgaccaaggctcctacttcgacctctggggccgcggcaccctcatcatcgtctcctccgcctccaccaaaggcccctcagtcttcccccacgacctccgc

SEQ ID NO: 57335 - RNA, 426 nt, synthetic construct
  misc_feature 1..426: note = derived and/or modified sequence opt11 from anti-HIV-1_HeavyChain
  source 1..426: mol_type = other RNA
caagtgcacttggaacagagcgggagcggggtcaagaaaccaggcgcgagcgtgcgcgtgagctgttggtcgagcgaggacatattcgagcgcacggaactgatccattgggtgcgccaggccccgggccagggcttggaatggatcgggtgggtgaaaacggtcacgggcgcggtcaatttcgggagcttggactttcgccatcgcatcagcttgaccagggacagggacttgttcacggcccatatggatataaggggcttgacccagggcgacaccgcgacctatttctgtgccaggcaaaagttcgagagcaggtacacgggcgggcaagggtggtatttcgatctctggggaagaggaacgcacatagtcgtgagctcggcctcgaccaagggcccgagcgtgttcccgcacgatctaagg

SEQ ID NO: 57336 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggatccgccatgaaaaaacccggcgcctccgtccgcgtctcctgctggacatcagaagacatcttcgacaccaccgaactaatctactgggtccgccaagcccccggccaaggcctcgaatggatcggctgggtcaaaatcgtctccggcacagtcaacttcgcctccctcgacttccgcaaccgcatctccctctcccgcgaccgcgacctctcaaccgcccacatggacatccgcggcctccgccaagacgacaccgccacctacttctgcgcccgccaaaaattcgaatcccgctactccggcgaccaaggctcctacttcgacctctggggccgaggcaccctcatcatcgtctccagcgcctccacaaaaggcccctccgtcttcccccacgacctccgc

SEQ ID NO: 57337 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccggggccggggtcaagaaaccgggcgcgagcgtgaccttgagctgtaaaacagccgatgaagatgtctttgacgcggcctacatgcattgggtgcgacaggccccgggccagacctttgaatggctcggatggatgaaaccggtcacgggcgcggtctcgtacgcgcgcaagttccagggcagggtctcgttctatatgacgcgcgagctaggggtcgcgtacatggacttgcgcaatctcaggttcgatgacacggccgtgtacttttgcgcacgcaagaccgcgggagatgtctcaggcgataacaggggctacttctttgacctgtgggggcgcgggagcagggtcatagtctcgagcgcaagcacgaaagggccctcggtctttccccacgacctgcga

SEQ ID NO: 57338 - RNA, 426 nt, synthetic construct
  misc_feature 1..426: note = derived and/or modified sequence opt11 from anti-HIV-1_HeavyChain
  source 1..426: mol_type = other RNA
caatcacacttggaacagagcgggagcgcaatgaagaaaccgggcgcgagcgtgcgagtgagctgctggacgagcgaggacatattcgacaccacggaactgatctattgggtgcgccaggccccgggccagggcttggaatggatcgggtgggtgaaaatagtctcgggcacggtcaatttcgcgagcctggactttcgcaatcgaataagcctgagcagggacaggaacctgagcacggcccatatggatatcaggggcttgcgccaggacgataccgcgacctatttctgcgccaggcaaaagttcgagagcaggtactcgggcgatcaagggagctatttcgatctctggggcaggggcacgctcataatcgtgagctcggcctcaaccaagggcccgagcgtgttcccgcacgatctcaga

SEQ ID NO: 57339 - RNA, 423 nt, synthetic construct
  misc_feature 1..423: note = derived and/or modified sequence opt11 from anti-HIV-1_HeavyChain
  source 1..423: mol_type = other RNA
caagtgcaattggtccagagcggggccgaggtcaagaaaccgggcgcgagcgtgaccttgagctgtaaaacggccgatgaagatgtctttgacgcggcctatatgcattgggtgcgccaggccccgggccagacctttgaatggctcgggtggatgaaaccggtcacgggcgcagtctcgtacgcgcgcaagttccagggaagggtctcgttctatatgacgcgcgagctagggatggcgtacatggacttgcgcaatctcaggttcgatgacacggccgtgtacttttgcgcgcgaaagaccgcgggcgatgtctcgggcgataacaggggctatttctttgacctgtgggggcgcgggagcagggtcatagtctcgagcgcgagcacgaaagggccctcggtctttcccacgatctatgtc

SEQ ID NO: 57340 - RNA, 426 nt, synthetic construct
  misc_feature 1..426: note = derived and/or modified sequence opt11 from anti-HIV-1_HeavyChain
  source 1..426: mol_type = other RNA
caagcccacctagaacaatccggctccggcgtcaaaaaaccaggcgcctccgtccgagtctcctgctggacctccgaagacatcttcgaacgcaccgaactcgtccactgggtccgccaagcccccggccaaggcctcgaatggatcggctgggtcaaaaccgtcaccggcgccgtcaacttcggctcacccaacttccgccaacgcgtctccctcacccgcgaccgcgacctcttcaccgcccacatggacatccgcggcctcacccaagacgacaccgccacctacttctgcgcccgccaaaaattcgcctcacgctactccggcgaccaaggctcctacttcgacctctggggcagaggcaccctcatcgttgtctcctccgcctccaccaaaggcccctccgtcttcccccacgacctccgc

SEQ ID NO: 57341 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaaccaggcgcctccgtccgcgtctcctgctggacctccgaagacatcttcgacaccactgaactcatatactgggtccgacaagcccccggccaaggcctcgaatggatcggctgggtcaaaatcgtctccggcaccgtcaacttcgcctcactcgacttccgcaaccgcatctccctctcccgagaccgcgacctctccaccgcctacatggacatccgcggcctcacccaagacgacacagccacctacttctgcgcccgccaaaaattcgcatcccgctactccggcgaccaaggctcctacttcgacctatggggccgcggcaccctcatcatcgtctcctccgcctccaccaaaggccccctcggcctcccccacgacctccga

SEQ ID NO: 57342 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaactcggcgcctccgtccgcgtctcctgctggacctccgaagacatcttcgaacgcaccgaactaatccactgggtccgccaagcccccggccaaggcctcgaatggatcggctgggtcaaagccgtctccggcgcagtcaactacggctccctcgacttccgccaccgagtcagcctcacccgagaccgagacctctccaccgcccacatggacatccgcggcctcacccaagacgacaccgcaacctacttctgcgcccgacaaaaattcgcctcccgatactcaggcgaccaaggctcctacttcgacctatggggccgcggcaccctcatcgtcgtctcctccgcctccaccaaaggcccatcagtcttcccccacgacctccgc

SEQ ID NO: 57343 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctccgtccgcgtctcctgctggacctccgaagacatcttcgaacgcaccgaactcatctactgggtccgccaagcccccggccaaggcctagaatggatcggctgggtcaaaatcgtctcaggcacagtcaacttcgcctccctagacttccgcaaccgcatatccctatcccgcgaccgagacctctcaaccgcccacatggacatccgcggcctcacccaagacgacaccgcaacctacttctgcgcccgccaaaaattcgcctcacgctactccggcgaccaaggctcctacttcgacctctggggccgcggcaccctcatcatcgtctcctccgcctccaccaaaggcccctccgtcttcccacacgacctccgc

SEQ ID NO: 57344 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctcaggcgtcaaaaaacccggcgcctccgtccgagtctcctgctggacctcagaagacatcttcgaacgcaccgaactcatccactgggtccgccaagcccccggccaaggcctcgaatggatcggctgggtcaaaaccgtcaccggcgccgtcaacttcggctcacccaacttccgcaaccgcatctccctcacccgcgaccgagacctctccaccgcccacatggacatccgcggcctcacccaagacgacaccgccacctacttctgcgcccgccaaaaattcgaatccctctactcagacgaccaaggctcctacttcgacctctggggacgcggcaccctcatcatcgtctcctccgcctccacaaaaggcccctccgtcttcccccacgacctccgc

SEQ ID NO: 57345 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggagtcaagaaaccgggcgcgagcgtgcgcgtgagctgttggacgagcgaggacatattcgagaaatcggaattgatccattgggtgcgccaggccccgggccagggcttggaatggatcgggtgggtgaaaacggtcacgggcgcagtcaatttcggaagctctgacttccgacagcgcgtgagcctgaccagggacagggacctgttcacggcccatatggatatcaggggcctgacccagggcgataccgcgacctacttctgtgccaggcaaaagttcgagagcttgtactcggacgatcaagggagctatttcgatctctggggcagaggcacgctcataatcgtgagctcggcctcgaccaagggcccgagcgtattcccgcacgatctcagg

SEQ ID NO: 57346 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggcgcaagcgtgcgcgtgagctgctggacgagcgaggacatattcgagcgcacggaattgatccattgggtgcgccaggccccgggccagggcttggaatggatcgggtgggtgaaaacggtaacgggcgcggtcaatttcgggagctcggactttcgcaatcgcataagcctgaccagagacagggacttgagcacggcccatatggatatcaggggcttgacccaggacgataccgcgacctatttctgcgccagacaaaagttcgagagcctgtactcggacgatcaagggagctatttcgatctctggggcaggggcacactcataatcgtgagctcggcctcgaccaagggcccgagcgtgttcccgcacgacctcagg

SEQ ID NO: 57347 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctctgcccgcgtctcctgctggacctccgaagacatcttcgacaccacagaactcatctactgggtccgccaagcccccggccaaggcctcgaatggatcggctgggtcaaaatcgtctctggcaccgtcaacttcgcctccctcgacttccgaaaccgcatctccctctcccgcgaccgcgacctatccaccgcccacatggacatacgcggcctcacccaagacgacaccgccacctacttctgcgcccgccaaaaattcgcctcccgctactccggcgaccaaggctcctacttcgacctctggggccgcggcacccacatagtcgtctcctccgcctcaaccaaaggcccctccgtcttcccccacgacctccga

SEQ ID NO: 57348 - RNA, 426 nt, synthetic construct
  misc_feature 1..426: note = derived and/or modified sequence opt11 from anti-HIV-1_HeavyChain
  source 1..426: mol_type = other RNA
caagcccacctagaacaatccggctcaggcgtcaaaaaactcggcgcctccgtccgcgtctcctgctggacctccgaagacatcttcgaacgaaccgaactcatccactgggtccgccaagcccccggccaaggcctcgaatggatcggctgggtcaaagccgtctccggcgccgtcaactacggctccctcgacttccgccaccgagtctccctcacccgcgaccgcgacctcttcaccgcccacatggacatccgcggcctcacccaagacgacaccgccacctacttctgcgccagacaaaaattcgaatcccgctacaccggcggccaaggctggtacttcgacctctggggccgcggcacccacatcgtcgtctcctccgcctcaaccaaaggcccctccgtcttcccccacgacctgcgc

SEQ ID NO: 57349 - RNA, 426 nt, synthetic construct
  misc_feature 1..426: note = derived and/or modified sequence opt11 from anti-HIV-1_HeavyChain
  source 1..426: mol_type = other RNA
caggcccatctcgagcaatcgggctcgggcgtgaaaaagctcggggcctcagtcagggtctcgtgctggacctcagaagatatctttgaaaggaccgagctcatacactgggtcaggcaagcgcccgggcaagggctagagtggataggctgggtcaaggccgtgagcggggccgtgaactatggctcgctcgacttcaggcacagggtctcgctcacgcgcgaccgcgatctctcgaccgcgcacatggacatacgcgggctcacgcaagatgacacggccacgtacttttgcgcgcgacagaaatttgaatcgcgctataccgggggccagggctggtactttgacttgtgggggcgcgggacccacatcgtggtctcgagcgcgagcacgaaagggccatcggtctttccccatgacctgcgc

SEQ ID NO: 57350 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctcagtccgcgtctcctgctggacctccgaagacatcttcgaacgcaccgaactaatctactgggtccgccaagcccccggccgcggcctcgaatggatcggctgggtcaaaaccgtctccggcaccgtaaacttcggctcatccgacttccgcaaccgcatctccctcacccgcgaccgcgacctctccaccgcccacatggacatcagaggcctcacccaagacgacaccgccacctacttctgcgcccgacaaaaattcgcctcccgctactccggcgaccaaggctcatacttcgacctctggggccgcggcaccctcatcatcgtctcctccgcctccaccaaaggcccctccgtcttcccacacgacctccgc

SEQ ID NO: 57351 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctcagtccgcgtctcctgctggacctccgaagacatcttcgaacgcaccgaactcatctactgggtccgccaagcccccggccgcggcctcgaatggatcggctgggtcaaaaccgtctccggcaccgtcaacttcggctcctctgacttccgcaaccgcatatccctcacccgcgaccgcgacctctccaccgcccgcatggacatccgcggcctcacacaagacgacaccgccacctacttctgcgcacgccaaaaattcgaatccctctactccgacgaccaaggctcctacttcgacctctggggccgcggcaccctcatcatagtctcctccgcctccaccaaaggaccctccgtcttccccaccgacctccga

SEQ ID NO: 57352 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctcagtccgcgtctcctgctggacctccgaagacatcttcgaaaaatccgaactcatccactgggtccgccaagcccccggccaaggcctcgaatggatcggctgggtcaaaaccgtcaccggcgccgtcaacttcggctcctccgacttcagacaacgcgtctccctcacccgcgaccgagacctcttcaccgcccacatggacatccgcggcctcacccaagacgacaccgccacctacttctgcgcccgccaaaaattcgcctcacgctactccggcgaccaaggctcatacttcgacctatggggccgaggcaccctcatcgtcgtctcctcagcctccaccaaaggcccctccgtcttcccccacgacctccgc

SEQ ID NO: 57353 - RNA, 426 nt, synthetic construct
  misc_feature 1..426: note = derived and/or modified sequence opt11 from anti-HIV-1_HeavyChain
  source 1..426: mol_type = other RNA
caatcacacctcgaacaatccggctccgccatgaaaaaacccggcgcctcagtccgcgtctcctgctggacctccgaagacatcttcgaacgcaccgaactcatctactgggtccgccaagccccaggccgcggcctcgaatggatcggctgggtcaaaaccgtctccggcaccgtcaacttcggctcctccgacttccgaaaccgaatctcactcacccgcgaccgcgacctctccaccgcccacatggacatccgcggcctcacccaagacgacaccgccacctacttctgcgcccgccaaaaattcgaatccctctactccgacgaccaaggctcctacttcgacctctggggccgcggcaccctaatcatcgtctcctccgcctccaccaacggccccatcggcctaccccacgacctccgc

SEQ ID NO: 57354 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgacaggccccgggccagggcttggaatggatcgggtgggtgaaaacggtcacgggcgcagtaaatttcgggagctcggactttcgacagcgcgtgagcttgaccagggacagggacttgttcacggcccatatggatatcaggggcttgacccagggcgataccgcgacctatttctgtgccaggcaaaagttcgagagcaggtacacgggcgggcaagggtggtatttcgatctctggggcaggggcacgcacatagtcgtgagctcggcctcgaccaagggaccgagcgtgttcccgcacgatctcagg

SEQ ID NO: 57355 - RNA, 426 nt, synthetic construct
  misc_feature 1..426: note = derived and/or modified sequence opt11 from anti-HIV-1_HeavyChain
  source 1..426: mol_type = other RNA
caagcgcacctggaacagagcggaagcggagtcaagaaaccaggcgcgagcgtacgcgtaagctgctggacgagcgaggacatattcgagcgcacagaactaatccactgggtgcgccaggccccgggccagggcctggaatggatcggatgggtgaaaacggtcacgggcgcggtcaacttcgggagcccgaacttccgccaccgcgtaagcctgaccagagacagagacctattcacagcccacatggacatcagaggcctgacccaggacgacaccgcgacctacttctgcgccaggcaaaagttcgcaagcagatactcgggcgaccaaggaagctacttcgacctctggggcaggggcacgctcatagtcgtaagctcagcctcgaccaaaggcccgagcgtattcccacacgacctcaga

SEQ ID NO: 57356 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctccgtccgcgtctcctgctggacctccgaagacatcttcgaacgcaccggcctcatctactgggtccgccaagcccccggccgcggcctcgaatggatcggctgggtcaaaaccgtatcaggcaccgtcaacttcggctcctccgacttccgcaaccgcatctccctcacccgcgaccgcgacctctcaaccgcccacatggacatccgcggcctcacccaagacgacaccgccacctacttctgcgcccgccaaaaattcgaatcactctactccgacgaccaaggctcctacttcgacctctggggccgcggcaccctcatcatcgtctcctccgcctccaccaaaggcccctcagtcttcccccacgacctccgc

SEQ ID NO: 57357 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtcaaaaaacccggcgcctccgtccgcgtctcctgctggacctccgaagacatcttcgaacgcaccgaactcatccactgggtccgccaagcccccggccaaggcctcgaatggatcggctgggtcaaaaccgtcaccggcgccgtcaacttcggctcacaaatcttccgacaccgcatctccctaacacgagaccgcgacctcttcaccgcccacatggacatccgcggcctcacccaaggcgacaccgccacctacttctgcgcccgacaaaaattcgaatccagatacaccggcggccaaggctggtacttcgacctctggggccgcggcacccacatagtcgtatcctcagcctccaccaaaggcccctcagtcttcccccacgacctacgc

SEQ ID NO: 57358 - RNA, 426 nt, synthetic construct
  misc_feature 1..426: note = derived and/or modified sequence opt11 from anti-HIV-1_HeavyChain
  source 1..426: mol_type = other RNA
cagagccatctcgagcaatcgggctcggccatgaaaaagcccggggcctcagtcagggtctcgtgctggacctcggaagatatctttgacacgaccgagctcatacactgggtcagacaagcgcccgggcaagggctagagtggataggctgggtcaagaccgtgaccggggccgtgaactttggctcgctcgatttcaggcacaggatctcgctcacacgcgatcgcgatctctttaccgcgcacatggacatacgcgggctcacgcaaggggacacggccacgtacttttgcgcgcgacagaaattcgaatcgcgctataccgggggccagggctggtactttgacttgtgggggcgcgggacccatatcgtggtctcgagcgcgagcacgaaagggccctcagtctttccccatgacttgcgc

SEQ ID NO: 57359 - RNA, 426 nt, synthetic construct
  misc_feature 1..426: note = derived and/or modified sequence opt11 from anti-HIV-1_HeavyChain
  source 1..426: mol_type = other RNA
caatcccacctagaacaatcaggctccgaagtcaaaaaacccggcgcctccgtccgagtctcctgctggacctccgaagacatcttcgaacgaaccgaactcatctactgggtccgacaagcccccggccgcggcctcgaatggatcggctgggtcaaaaccgtctccggcaccgtcaacttcggctcctccgacttccgcaaccgaatctccctcacccgcgaccgcgacctctccaccgcccacatggacatccgcggcctcacccaagacgacaccgccacctacttctgcgcccgacaaaaattcgaatccctatactccgacgaccaaggctcctacttcgacctctggggccgcggcaccctcatcatcgtctcctccgcatccaccaaaggcccctcagtcttcccccacgacctccgc

SEQ ID NO: 57360 - RNA, 423 nt, synthetic construct
  misc_feature 1..423: note = derived and/or modified sequence opt11 from anti-HIV-1_HeavyChain
  source 1..423: mol_type = other RNA
caggtctatatggagcaagcgggcgggggcgtgaaaaagcccggggcctcagtcacgctctcatgcaagacagcggacgaggacatattcgatgccgcgtacatgcactgggtaaggcaagcgcccgggcaaacgttcgagtggctgggctggatgaagcccgtaaccggggccgtgaactatgccaggcaatttcaagggcgcgtgagcttttacaggaccagggaattgggcatagcctatatggatctcagggacttgaaatttgacgacaccgcggtctatttctgtgccaggaaaacgaaaggggacgtgagcggggacgatcgcgggttctttttcgatctctggggcaggggcacgcgcgtgatcgtgagctcggcctcgaccaagggcccgagcgtgttcccgcacgatctcagg

SEQ ID NO: 57361 - RNA, 426 nt, synthetic construct
  misc_feature 1..426: note = derived and/or modified sequence opt11 from anti-HIV-1_HeavyChain
  source 1..426: mol_type = other RNA
cagagccacctcgagcaatcgggctcagaagtgaaaaagccaggggcctcggtcagggtctcgtgctggacctcagaagacatcttcgacacgaccgagctaatatactgggtcaggcaagcgcccgggcaaggactcgagtggataggctgggtcaagatcgtgagcgggaccgtgaacttcgcctcgctcgacttcagaaacaggatctcgctctcgcgcgaccgcgacctctcgaccgcacacatggacatacgcgggctcacgcaagacgacacggccacgtacttctgcgcgcgccagaaattcgcctcgcgctacagcggggaccagggctcgtacttcgacctgtggggacgcgggaccctaatcatagtctcgagcgcaagcacgaaagggccctcggtcttcccccacgacctgcgc

SEQ ID NO: 57362 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtctcgggcgcggtcaatttcgggagcccgaactttcgacatcgagtgagcttgagcagggacagggacttgagcacggcctatatggatatcagaggactgacccaggacgataccgcgacctatttctgtgccaggcaaaagttcgcaagcaggtactcgggcgatcaagggagctatttcgatctctggggcaggggcacgctcatagtcgtgagctcggcctcgaccaagggcccgagcgtgttcccgcacgatctcaga

SEQ ID NO: 57363 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatcaggctcaggcgtcaaaaaacccggcgcctccgtccgcgtctcctgctggtcatccgaagacatcttcgaacgcaccgaactcatccactgggtccgccaagcccccggccaaggcctcgaatggatcggctgggtaaaaaccgtcaccggcgccgtcaacttcggctccctcgacttccgacaccgcatctccctcacccgcgaccgcgacctcttcaccgcccacatggacatccgaggcctcacccaaggcgacaccgcaacatacttctgcgcccgccaaaaattcgaatcacgctacaccggcggccaaggctggtacttcgacctctggggccgcggcacccacatcgtcgtctcaagcgcctccgccaaaggcccctccgtcttcccccacgacctccgc

SEQ ID NO: 57364 - RNA, 426 nt, synthetic construct
  misc_feature 1..426: note = derived and/or modified sequence opt11 from anti-HIV-1_HeavyChain
  source 1..426: mol_type = other RNA
cagagccatctcgagcaatcgggctcggccatgaaaaagcccggggcctcggtcagggtctcgtgctggacctcggaagatatctttgaaagaaccgagctcatatactgggtcagacaagcgcccgggcgcgggctcgagtggataggctgggtcaagacagtgagcgggaccgtgaactttggctcgagcgatttcaggaacaggatctcgctcacacgcgatcgcgacctctcgacagcgcacatggacatacgcgggctcacgcaagatgacacggccacgtacttttgcgcgcgccagaaatttgaatcgctctatagcgatgaccagggctcgtactttgacttgtgggggcgcgggaccctgatcgtggtctcgagcgcaagcacgaaagggccctcggtctttcccccgcgctcggcc

SEQ ID NO: 57365 - RNA, 426 nt, synthetic construct
  misc_feature 1..426: note = derived and/or modified sequence opt11 from anti-HIV-1_HeavyChain
  source 1..426: mol_type = other RNA
caggtgcacatggaacaggccgggggcggggtcaagaaaccgggagcgagcgtgaccttgagctgtaaaacggccgatgaagatgtctttgacgcggcctatatgcattgggtgcgacaggcaccgggccagacctttgaatggctcgggtggatgaaaccggtcacgggcgcggtcaattacgcgcgcaagttccagggcagggtctcgttctatcgcacgagagagcttgggatcgcgtacatggacttgagaaatctcaggttcgatgacacggccgtgtacttttgcgcgcgaaagaccaagggcgatgtctcgggcgatgacaggggatttttctttgacttgtgggggagagggaccagggtaatagtctcgagcgcgagcacgaaagggcccttgcgctcgttcccgagaaggagcgcg

SEQ ID NO: 57366 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggagtcaagaaaccgggcgcgagcgtgcgcgtgagctgttggtcgagcgaggacatattcgagcgcacggaattgatccattgggtgcgacaggcaccgggccagggcctggaatggatcgggtgggtgaaaacggtcacgggcgcggtcaatttcgggagcttggactttcgccatcgcataagcctgaccagggacagggacctgttcacggcccatatggatatcaggggcttgacccagggcgataccgcgacatatttctgtgccaggcaaaagttcgagagcaggtacacgggcgggcaagggtggtatttcgatctctggggcaggggcacgcacatagtagtgagctcggcctcaaccaagggcccgagcgtgttcccgacaatatacgtg

SEQ ID NO: 57367 - RNA, 426 nt, synthetic construct
  misc_feature 1..426: note = derived and/or modified sequence opt11 from anti-HIV-1_HeavyChain
  source 1..426: mol_type = other RNA
gaatcccacctcgaacaatccggatccgccatgaaaaaacccggcgcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcctcactcgacttccgcaaccgcatctcactctcacgcgaccgcgacctctccaccgcccacatggacatccgaggcctcacccaagacgacaccgccacctacttctgcgcccgccaaaaattcgcctcccgctactccggcgaccaaggctcatacttcgacctctggggccgcggcaccctcatcatcgtctcctccgcctccaccaaaggcccctccgtcttcccccacgacctccgc

SEQ ID NO: 57368 - RNA, 429 nt, synthetic construct
  misc_feature 1..429: note = derived and/or modified sequence opt11 from anti-HIV-1_HeavyChain
  source 1..429: mol_type = other RNA
caggcccacctagaacaatcaggctcaggcgtgaaaaagcccggggcctcggtcagggtctcgtgctggacctcggaagatatctttgaaaggaccgagctcatacactgggtcaggcaagcgccagggcaagggctcgagtggataggctgggtcaagatcgtgagcggggccgtgaactttggctcgcccaatttcaggcaaagggtctcgctcacgcgcgaccgcgacctctttaccgcgcacatggacatacgagggctaacgcaagacgacacggccacgtacttttgcgcgagacagaaattcgcctcgcgctatagcggggaccagggctcatactttgacctgtgggggcgcgggaccttgatcgtggtctcgagcgcgagcacgaaagggccctcgggcctgcccccgcgctcgtgcgtg

SEQ ID NO: 57369 - RNA, 423 nt, synthetic construct
  misc_feature 1..423: note = derived and/or modified sequence opt11 from anti-HIV-1_HeavyChain
  source 1..423: mol_type = other RNA
caagtccacctcgtccaatccggcgccgaagtcaaaaaacccggcgcctccgtcaaagtctcctgcaaagcctccggctacaccttcaccacctccggcatccactggctccgccaagtccccggccaacgccccgaatggatgggctggatccgcccaaaaaccggcgcccgcaaccaagcacgccaattccaaccccgcatctccctcacccgcgaccgcgccctctccaccgcctacctagacctcaactccctcacctccgccgactcaggcacctacttctgcgcccgccaaaccttcaaacccgacttctacttcgccgaccaaggctggtccttcaacctctggggccgcggcgcccacttcatcgtctcctccgcctcaaccaaaggcccctccgtcttcccacacgacctccgc

SEQ ID NO: 57370 - RNA, 429 nt, synthetic construct
  misc_feature 1..429: note = derived and/or modified sequence opt11 from anti-HIV-1_HeavyChain
  source 1..429: mol_type = other RNA
caggcccatctcgagcaatcgggctcgggcgtgaaaaagcccggggcctcggtcagggtctcgtgctggagctcggaagatatctttgaaaggaccgagctcatacactgggtcaggcaagcgccagggcaagggctcgagtggataggctgggtcaagaccgtaacaggggccgtgaactttggctcgctcgatttcagacacaggatctcgctcacgcgcgatcgcgatctctttaccgcgcacatggacatacgcgggctcacgcaaggggacacggccacgtacttttgcgcgcgacagaaatttgaatcgcgctataccgggggccagggctggtactttgacttgtgggggcgcgggacccatatcgtagtctcgagcgcgagcacgcaagggcccataggcctgccaccgcgcttgtgcgtg

SEQ ID NO: 57371 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgccatgaaaaaacccggcgcctccgtccgcgtctcctgctggacctccgaagacatcttcgacaccaccgaactcatctactgggtccgccaagcacccggccaaggcctcgaatggatcggctgggtcaaaatcgtatccggcaccgtcaacttcgcctccctagacttccgaaaccgcatctccctctcccgcgaccgcgacctatccaccgcccacatggacatccgcggcctcacccaagacgacaccgccacctacttctgcgcccgccaaaaattcgcctcccgctactccggcgaccaaggctcatacttcgacctctggggccgcggcaccctcatcatcgtctcctctgcatcaaccaaaggccccatcggcctccccccccgctcaacc

SEQ ID NO: 57372 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatccggctccggcgtaaaaaaacccggcgcctccgtccgagtatcctgctggacctccgaagacatcttcgaaaaatccgaactcatccactgggtccgccaagcccccggccaaggcctcgaatggatcggctgggtaaaaaccgtcacaggcgccgtcaacttcggctccctcgacttccgccaccgcatctccctcacccgcgaccgcgacctcttcaccgcccacatggacatacgaggcctcacccaaggcgacaccgccacctacttctgcgcccgccaaaaattcgaatcccgctacaccggcggccaaggatggtacttcgacctctggggccgcggcacccacatcgtcgtctcctccgcctccaccaaaggcccctccgtcttccccaccatctgcgtc

SEQ ID NO: 57373 - RNA, 426 nt, synthetic construct
  misc_feature 1..426: note = derived and/or modified sequence opt11 from anti-HIV-1_HeavyChain
  source 1..426: mol_type = other RNA
caagcgcacttggaacagagcgggagcggggtcaagaaattgggcgcgagcgtgcgagtgagctgttggacgagcgaggacatattcgagcgaacggaactgatccattgggtgcgccaggccccgggccagggcttggaatggatagggtgggtgaaagcggtctcgggcgcggtcaattacgggagcttggactttcgccatcgcgtgagcttgaccagggacagggacttgttcacggcccatatggatatcaggggcttgacccagggcgataccgcgacctatttctgtgccaggcaaaagttcgagagcaggtacacgggcgggcaagggtggtatttcgatctctggggcaggggcacgcacatagtagtgagctcggccttgcaccagggcccgatcgggctcccgcccaggagcacg

SEQ ID NO: 57374 - RNA, 429 nt, synthetic construct
  misc_feature 1..429: note = derived and/or modified sequence opt11 from anti-HIV-1_HeavyChain
  source 1..429: mol_type = other RNA
caatcccacctcgaacaatccggctccgccatgaaaaaacccggcgcctcagtccgcgtctcctgctggacctccgaagacatcttcgacaccaccgaactcatctactgggtccgccaagcacccggacaaggcctcgaatggatcggctgggtcaaaatcgtctcaggcaccgtcaacttcgcctccctagacttccgcaaccgagtctcactctcccgcgaccgcgacctctccaccgcctacatggacatccgcggcctcacccaagacgacaccgccacctacttctgcgcccgccaaaaattcgcctcccgctactccggcgaccaaggctcctacttcgacctctggggccgcggcaccctcatcgtcgtctcctccgccctccaccaaggccccatcggcccctcacccaccatcctcaga

SEQ ID NO: 57375 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctccgcaatgaaaaaacccggagcctccgtccgcgtctcctgctggacctccgaagacatcttcgacaccaccgaactcatctactgggtccgccaagcccccggccaaggcctcgaatggatcggctgggtcaaaatcgtctccggcaccgtcaacttcgcatccctcgacttccgcaaccgcatctccctctcccgcgaccgcgacctctccaccgcccacatggacatacgcggcctcacccaagacgacaccgccacctacttctgcgcccgccaaaaattcgcctcccgctactccggcgaccaaggctcctacttcgacctctggggacgcggcacactcatcatcgtctcctccgcctcaaccaaaggcccctccgtcttccccaccatctacgtc

SEQ ID NO: 57376 - RNA, 426 nt, synthetic construct
  misc_feature 1..426: note = derived and/or modified sequence opt11 from anti-HIV-1_HeavyChain
  source 1..426: mol_type = other RNA
caatcgcacttggaacagagcgggagcgcgatgaagaaaccgggcgcgagcgtgcgcgtgagctgttggacaagcgaggacatattcgataccacggaattgatctattgggtgcgccaggccccaggccagggattggaatggatcgggtgggtgaaaatagtctcgggaacggtcaatttcgcgagcttggactttcgcaatcgcatcagcttgagcagggacagggacttgagcacggcctatatggatataaggggcttgacccaggacgataccgcgacctatttctgtgccaggcaaaagttcgagagcaggtacacgggcgggcaagggtggtatttcgatctctggggcaggggcacgcacatagtcgtgagctcggcctcgaccaagggcccgagcgtgttcccgacaatatgcgtg

SEQ ID NO: 57377 - RNA, 426 nt, synthetic construct
  misc_feature 1..426: note = derived and/or modified sequence opt11 from anti-HIV-1_HeavyChain
  source 1..426: mol_type = other RNA
caagtccaactagtccaatccggcgccgaagtcaaaaaacccggcgcctcagtccgcgtctcctgctggacctccgaagacatcttcgacaccaccgaactcatatactgggtccgccaagcccccggccaaggcctcgaatggatcggctgggtcaaaatcgtctccggcaccgtcaacttcgcctcactcgacttccgcaaccgcatctccctctcccgcgaccgcgacctctccaccgcccacatggacatccgaggcctcacccaagacgacaccgccacctacttctgcgcccgccaaaaattcgaatcccgctacaccggcggccaaggctggtacttcgacctctggggccgcggcacccacatcgtcgtctcctcagcctccaccaaaggcccctccgtcttccccaccatctgcgtc

SEQ ID NO: 57378 - RNA, 426 nt, synthetic construct
  misc_feature 1..426: note = derived and/or modified sequence opt11 from anti-HIV-1_HeavyChain
  source 1..426: mol_type = other RNA
aggcgccatctcgagcaatcgggctcgggcgtgaaaaagcccggggcctcggtcagggtctcatgctggagctcggaagatatctttgaaaggaccgagctcatacactgggtaaggcaagcgcccgggcaagggctcgagtggataggctgggtaaagaccgtgaccggggccgtgaactttggctcgctcgatttcaggcacaggatctcgctcacgcgcgatcgcgatctctttaccgcgcacatggacatacgcgggctcacgcaaggagacacggccacgtacttttgcgcgcgccagaaatttgaatcgcgctataccgggggacagggctggtactttgacctgtgggggcgcgggactcatatcgtggtctcgagcgcgagcacgaaagggccctcggtctttccccatgacttgcgc

SEQ ID NO: 57379 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatccggctcagccatgaaaaaacccggcgcctccgtccgcgtctcctgctggacctccgaagacatcttcgacacaaccgaactcatctactgggtccgccaagcccccggccaaggcctcgaatggatcggctgggtcaaaatcgtctccggcaccgtaaacttcgcctccctagacttccgcaaccgcatctccctctcccgagaccgcgacctctccaccgcctacatggacatccgcggcctcacacaagacgacaccgccacctacttctgcgcccgccaaaaattcgaatcccgctactccggcgaccaaggctcctacttcgacctctggggccgcggcaccctcatcatcgtctccagcgcctccaccaaaggcccctccgtcttccccaccatctgcgtc

SEQ ID NO: 57380 - RNA, 429 nt, synthetic construct
  misc_feature 1..429: note = derived and/or modified sequence opt11 from anti-HIV-1_HeavyChain
  source 1..429: mol_type = other RNA
caagcccacctcgaacaatccggctccggcgtcaaaaaacccggcgcctcagtccgcgtctcctgctggacctccgaagacatcttcgaacgcaccgaactcatacactgggtccgccaagcccccggccaaggcctcgaatggatcggctgggtcaaaaccgtcaccggcgccgtcaacttcggctccctcgacttccgccaccgcatctccctcacccgcgaccgcgacctcttcaccgcacacatggacatccgcggcctcacccaaggcgacacagccacctacttctgcgcccgccaaaaattcgaatcccgctacaccggcggccaaggctggtacttcgacctctggggccgcggcacccacatcgtcgtctcctccgccagcaccaaaggcccccaccccgtcttcccccacgacctacca

SEQ ID NO: 57381 - RNA, 426 nt, synthetic construct
  misc_feature 1..426: note = derived and/or modified sequence opt11 from anti-HIV-1_HeavyChain
  source 1..426: mol_type = other RNA
caagcacacctcgaacaatccggctccggcgtcaaaaaactcggcgcctccgtccgcgtctcctgctggacctccgaagacatcttcgaacgcaccgaactcatctactgggtccgccaagcccccggccaaggcctcgaatggatcggctgggtcaaaatcgtctccggcaccgtcaacttcgcctccctcgacttccgcaaccgcatctccctctcccgcgaccgcgacctctccacagcctacatggacatccgcggcctcacccaagacgacaccgccacctacttctgcgcccgccaaaaattcgcctcacgctactcaggcgaccaaggctcctacttcgacctctggggccgcggcaccctaatcgtcgtctcctccgcctccaccaaaggcccctccgtcttccccaccatctacgtc

SEQ ID NO: 57382 - RNA, 429 nt, synthetic construct
  misc_feature 1..429: note = derived and/or modified sequence opt11 from anti-HIV-1_HeavyChain
  source 1..429: mol_type = other RNA
caagcccacctcgaacaatccggctccggcgtcaaaaaacccggcgcctccgtacgcgtctcctgctggacctccgaagacatcttcgaacgcaccgaactaatccactgggcccgccaagcacccggccaaggcctcgaatggatcggctgggtcaaaaccgtcaccggcgccgtcaacttcggctccctcgacttccgccaccgcatctcactaacccgcgaccgagacctcttcaccgcccacatggacatccgcggcctaacacaaggcgacaccgccacctacttctgcgcccgccaaaaattcgaatcccgatacaccggcggccaaggctggtacttcgacctctggggccgcggcacccacatcgtcgtctcctccgcctccaccaaaggacccctcggcctccccccccgcctctcacgc

SEQ ID NO: 57383 - RNA, 426 nt, synthetic construct
  misc_feature 1..426: note = derived and/or modified sequence opt11 from anti-HIV-1_HeavyChain
  source 1..426: mol_type = other RNA
cagagccatctcgagcaatcgggctcggccatgaaaaagcccggggcctcagtcagggtctcgtgctggacctcggaagatatctttgacacgacagaactcatatactgggtcaggcaagcacccgggcaagggctcgagtggataggctgggtcaagatcgtgagcgggaccgtgaactttgcctcgctcgatttcaggaacaggatctcgctctcgcgcgatcgcgatctctcgaccgcgcacatggacatacgagggctcacgcaagatgacacggccacgtacttttgcgcgcgccagaaatttgcctcgcgctacagcggggaccagggctcatactttgacctgtggggacgcgggaccttgatcatagtctcgagcgcgagcacgaaagggccctcgggcttgcccccgcgctcggcc

SEQ ID NO: 57384 - RNA, 426 nt, synthetic construct
  misc_feature 1..426: note = derived and/or modified sequence opt11 from anti-HIV-1_HeavyChain
  source 1..426: mol_type = other RNA
caggtccagctcgtgcaatcgggcgcggaagtgaaaaagcccggggcctcggtcagggtctcgtgctggacctcggaagatatatttgacacgaccgagctcatatactgggtcaggcaagcacccgggcaagggctcgagtggataggctgggtcaagatcgtgagcgggaccgtgaactttgcctcgctcgatttcaggaacaggatctcgctctcgcgcgatcgcgatctctcgaccgcgcacatggacatacgcgggctcaggcaagatgacacggccacgtacttttgcgcgcgccagaaatttgaatcgcgctatagtggggaccagggctcgtactttgacttatgggggcgagggaccttgatcatagtctcgagcgcgagcacgaaagggccctcggtctttccccatgacctgcgc

SEQ ID NO: 57385 - RNA, 426 nt, synthetic construct
  misc_feature 1..426: note = derived and/or modified sequence opt11 from anti-HIV-1_HeavyChain
  source 1..426: mol_type = other RNA
gaggcccatctcgagcaatcgggctcgggcgtgaaaaagcccggggcctcggtcagggtctcatgctggacctcggaagatatctttgaaagaaccgagctcatacactgggtcaggcaagcgccagggcaagggctcgagtggataggctgggtcaagatcgtgagcgggaccgtgaactttgcctcgctcgatttcaggaacaggatctcgctctcacgcgatcgcgatctctcaaccgcgtacatggacatacgcgggctcacgcaagacgacacggccacgtacttttgcgcgcgccagaaatttgcctcgcgatatagcggagaccagggctcgtactttgacttgtgggggcgcgggaccctgatcgtggtctcgagcgcgagcacgaaagggccctcggtctttccccatgacctgcgc

SEQ ID NO: 57386 - RNA, 423 nt, synthetic construct
  misc_feature 1..423: note = derived and/or modified sequence opt11 from anti-HIV-1_HeavyChain
  source 1..423: mol_type = other RNA
caagtccaactcgtccaatccggcgccgaagtcaaaaaacccggcgcctcagtcaaagtctcctgccgcgcctccggctacaccttcggcaaccacgccatctcctgggtccgccaagcccccggccaaggcctcgaatggatgggctggatccgccccaaaaccggcgcccgaaaccaagcccgccaattccaaccccgcatctcactcacccgcgaccgcgccctctcaaccgcctacctcgacctcaactccctcacctcagccgactccggcacctacttctgcgcccgccaaacattcaaacccgacttctacttcgccgaccaaggctggtcattcaacctctggggccgcggcgcccacttcatcgtctcctcagcctccaccaaaggcccctccgtcttcccccacgacctccgc

SEQ ID NO: 57387 - RNA, 429 nt, synthetic construct
  misc_feature 1..429: note = derived and/or modified sequence opt11 from anti-HIV-1_HeavyChain
  source 1..429: mol_type = other RNA
cagggacacaacctagagcagagcggaagcgaagtgaaaaagccgggggcaagcgtaagagtaagctgctggacaagcgaagacatattcgaaaggacagagctgatacactgggtaaggcaggcgccagggcaggggctagagtggataggatgggtaaagacagtgacaggggcagtgaacttcggaagtctagacttcagacacaggataagtctgacgagagacagagacctattcacggcgcacatggacataagagggctaacgcagggggacacggcgacgtacttctgcgcgaggcagaaattcgaaagcagatacacaggaggacagggatggtacttcgacctgtgggggagagggacacacatagtagtaagcagcgcgagcacgaaagggccaagcgtattcccacacgacctgaga

SEQ ID NO: 57388 - RNA, 426 nt, synthetic construct
  misc_feature 1..426: note = derived and/or modified sequence opt11 from anti-HIV-1_HeavyChain
  source 1..426: mol_type = other RNA
cccacgacctggaacaagagcgggagcgatgtaaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcctgaccagggacagggacctgagcacggcccatatggatatcaggggattgacccaggacgataccgcgacctatttctgtgccagacaaaagttcgagagcttgtactcggacgatcaagggagctatttcgatctctggggcaggggcacgctcataatcgtgagctcggcctcgaccaagggcccgagcgtgttcccacacgatctcagg

SEQ ID NO: 57389 - RNA, 432 nt, synthetic construct
  misc_feature 1..432: note = derived and/or modified sequence opt11 from anti-HIV-1_HeavyChain
  source 1..432: mol_type = other RNA
catgtcacgccctggaacgagtacgtgggcagggccatgaaaaagcccgggcgctcggtcagggtatcatgctggacctcggaagatatctttgacacgaccgagctcatatactgggtcaggcaagcacccgggcaagggctcgagtggataggctgggtcaagatcgtgagcgggaccgtgaactttgcctcgctcgatttcaggaacaggatctcgctatcgcgcgatcgcgatctctcgaccgcgtacatggacatacgcgggctcacgcaagatgacacggccacgtacttttgcgcgcgccagaaatttgcctcgcgctatagcggggaccagggctcgtactttgacctgtgggggcgcgggacactgatcgtagtctcgagcgcgagcacgaaaggaccctcggtctttccccatgacttgcgc

SEQ ID NO: 57390 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtaaggcgcccgggcgcgagcgtgaaagtaagctgtaaagcgagcgggttctcgttcttgggccattacatacactgggtcaggcaagcgcccgggcaagggctcgagtggataggctgggtcaaggccgtgagcggggccgtgaactatggctcgctcgatttcaggcacagggtctcgctcacgcgcgatcgcgatctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 57391 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgaaagtgagctgtaaagcgagcgggtacacgttcacgagctatggcataagctgggtcaggcaagcgcccgggcaagggctcgagtggataggctgggtcaagatcgtgagcggggccgtgaactttggctcgcccaatttcaggcaaagggtctcgctcacgcgcgatcgcgatctctttaccgcgcacatggacatacgagggctcacgcaaggggacacggccacgtacttttgcgcgcgacagaaatttgaaagaggcgggcaagggtggatattcgatctctggggcaggggcacgctcatagccgtgagctcg

SEQ ID NO: 57392 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcgaggccgaggtcaagaaaccgggcgcgagcgtgaaaataagctgtgccacgagcgggtacgcgttcacgctctattacttgcactgggtaaggcaagcgcccgggcaagggctcgagtggataggctgggtcaagaccgtgaccggggccgtgaactttggctcggcctatttcaggcacagggtctcgctcacgcgcgatcgcgatctctttaccgcgcacatggacatacgcgggctcacgcaaggggacacggccacgtacttttgcgcgcgccagaaattttacaagggcgggcaagggtggtatttcgatctctggggcaggggcacgctaatagtagtgagctcg

SEQ ID NO: 57393 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgagtgagctgttggacgagcgaggacatattcaagaccgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatttgaaaggggcgggcaagggtggtatttcgatctatggggcaggggcacgctcatagtcgtgagctcg

SEQ ID NO: 57394 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacgagcgaggacatattcgagcgcacggaattgatccattgggtgcgccaggccccgggcaggggcttggaatggatcgggtgggtgaaagcggtctcgggcgcggtcaattacgggagcttggactttcgccatcgcgtgcccttgacaagggacagggacttgttcacggcccatatggatatcaggggcttgacccaggacgataccgcgacctatttctgtgccaggcaaaagttcgcgcgcggggaccagggctggttctttgacttgtgggggcgcgggaccttgatagtggtctcgagc

SEQ ID NO: 57395 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgccggaggacatattcgagaggacggagttgatacattgggtgaggcaggcgccggggcaggggttggagtggatagggtgggtgaagatagtgagtggggcggtgaatttcgggagcccgaactttaggcagagggtgagcttgacgagggacagggacttattcacggcgcatatggatataagggggttgacgcagggggatacggcgacgtatttctgtgcgaggcagaagttcgagaggggggggcaggggtggatatttgacttgtgggggagggggacgctgatagcggtgagtagc

SEQ ID NO: 57396 - RNA, 375 nt, synthetic construct
  misc_feature 1..375: note = derived and/or modified sequence opt11 from anti-HIV-1_HeavyChain
  source 1..375: mol_type = other RNA
caggcgcacctggagcagagcgcgagcggggtaaagaggccgggggcgagcgtgagggtgagctgttggacgagcgaggacatattcgaggggagtgagttgatacattgggtgaggcaggcgccggggcaggggttggagtggatagggtgggtgaagacggtgacgggggcggtgaatttcgggagcgcgtactttaggcatagagtgagcttgacgagggacagggacctgttcacggcgcatatggatataagggggttgacgcagggggatacggcgacgtatttctgtgcgaggcagaagttctataagggggggcaggggtggtactttgacttgtgggggagggggacgttgatagtggtgagtagc

SEQ ID NO: 57397 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaggaccgagctcatacactgggtccggcaagcgcccgggcaagggctagagtggataggatgggtcaagaccgtaagcggggccgtgaactttggctcgcccaatttcaggcacagagtctcgctcacgcgcgatcgcgatctatttaccgcgcacatggacatacgcgggctcacgcaaggggacacggccacgtacttttgcgcgcgccagaaattttacgcgggcgggcaagggtggtatttcgatctctggggccggggaacgctcatagtcgtgagctcg

SEQ ID NO: 57398 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggagtagcgaggacatattcgagagggcggagttgatacattgggtgaggcaggcgccggggcaggggttggagtggatagggtgggtgaagacggtgacgggggcggtgaatttcgggagcccgaactttaggcagagggtgagcttgacgagggacagggacttgttcacggcgcatatggatataagggggctgacgcagggggatacggcgacgtatttctgtgcgaggcagaagttcgagaggggggggcaggggtggatatttgacttgtgggggagggggacgttgatagcggtgagtagc

SEQ ID NO: 57399 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaactgatccattgggtgcgccaggccccgggccagggcttggaatggatcgggtgggtgaaaacggtcacgggcgcggtcaatttcgggagcttggactttcgccatcgcatcagcttgaccagggacagggacttgttcacggcccatatggatataagaggcttgacccagggcgataccgcgacctatttctgtgccaggcaaaagttcgagcgcgggggccagggctggtactttgacttgtgggggcgcgggaccctgatcgtggtctcaagc

SEQ ID NO: 57400 - RNA, 375 nt, synthetic construct
  misc_feature 1..375: note = derived and/or modified sequence opt11 from anti-HIV-1_HeavyChain
  source 1..375: mol_type = other RNA
caagtgcacctggaacagagcggaagcggagtcaaaaaactgggcgcgagcgtacgcgtgagctgctggacaagcgaggacatattcgagcgcacggaactgatccactgggtacgccaggccccaggccagggcctagaatggatcgggtgggtgaaagcagtctcgggcgcggtcaattacggaagcctggacttccgccaccgcgtgagcctgaccagggacagggacctgagcacggcccacatggacatcagaggcctgacccaggacgacaccgcgacctacttctgcgccagacaaaaattcgcacgcggggaccagggctggttcttcgacctatggggacgcgggaccctgatcgtagtctcgagc

SEQ ID NO: 57401 - RNA, 375 nt, synthetic construct
  misc_feature 1..375: note = derived and/or modified sequence opt11 from anti-HIV-1_HeavyChain
  source 1..375: mol_type = other RNA
caggcctatctagagcaatcgggctcgatcatgaaaaagcccggggcctcggtcagggtctcgtgctggacctcggaagatatctttgacaggaccgagctcatatactgggtcaggcaagcgcccgggcaagggctcgagtggataggctgggtcaagatcgtgagcggggcagtgaactttggctcgctcgatttcaggaacagggtctcgctcacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 57402 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgataaattgggtgcgccaggccccgggccagggcttggaatggatcgggtgggtgaaagcggtctcgggcgcggtcaattacgggagcttggactttcgccatcgcgtgagcttgaccagggacagggacttgagcacggcccatatggatatcaggggcttgacccaggacgataccgcgacctatttctgtgccaggcaaaagttcgcgcgcggggaccagggctggttctttgacttgtgggggcgcgggaccttgatcgtggtctcgagc

SEQ ID NO: 57403 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggagcagcgaggacatattcgagaggacggagttgatacattgggtgaggcaggcgccggggcaggggttggagtggatagggtgggtgaagacggtgacgggggcggtgaatttcgggagcttggactttaggcataggataagcctgacgagggatagggacttgttcacggcgcatatggatataagggggttgacgcagggggatacggcgacgtatttctgtgcgaggcagaagttcgagaggggggggcaggggtggtactttgacttgtgggggagggggacgttgatagtggtgagtagc

SEQ ID NO: 57404 - RNA, 375 nt, synthetic construct
  misc_feature 1..375: note = derived and/or modified sequence opt11 from anti-HIV-1_HeavyChain
  source 1..375: mol_type = other RNA
caggcacatctcgagcaatcgggctcgggcgtgaaaaagcccgggacctcggtcagggtctcgtgctggacctcggaagatatctttgaaaggaccgagctaatacactgggtcaggcaagcgcccgggcaagggctcgagtggataggctgggtcaagatcgtgagcggggccgtgaactttggctcgccaaatttcaggcaaagggtctcgctcacgcgcgatcgcgatctctttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 57405 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaactgggcgcgagcgtgagagtgagctgttggacgagcggggacatattcgagcgcacggaattgatccattgggtgcgccaggccccgggccagggcttggaatggatcgggtgggtgaaagcggtctcgggcgcggtcaattacggcagcttggactttcgccatcgcgtgagcttgaccagggacagggacttgttcacggcccatatggatatcaggggattgacccaggacgataccgcgacctatttctgtgccaggcaaaagttcgcgcgcggggaccagggctggttctttgacttgtgggggcgcgggaccttaatcgtggtctcgagc

SEQ ID NO: 57406 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgagagtgagctgttggacgagcgaggacatattcgagcgcacggaattgatccattgggtgcgacaggccccgggccagggcttggaatggatcgggtgggtgaaaatagtctcgggcgcggtcaatttcgggagcccgaactttcgccagcgcgtgagcttgaccagggacagggacttgttcacggcccataccgatatcaggggcttgacccagggcgataccgcgacctatttctgtgccaggcaaaagttcgagcgagggggccagggctggtactttgacttgtgggggcgcgggaccttgatcgtggtatcgagc

SEQ ID NO: 57407 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgtctcgcgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacttgttcacggcccatatggatatcaggggcttgacccagggcgataccgcgacctatttctgtgccaggcaaaagttcgagcgcgggggccagggctggtactttgacttgtgggggcgcgggaccttgatcgtggtctcgagc

SEQ ID NO: 57408 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggcgcgggcgtgaaaaggcccggggcctcggtcagggtctcgtgctggacctcggaagatatctttgaaacgaccgagctcatacactgggtcaggcaagcgcccgggcaagggctcgagtggataggctgggtcaagaccgtgagcggggccgtgaactttggctcgctcaatttcaggcacagggtctcgctcacgcgcgatcgagatctctttaccgcgcacatggacatacgcgggctaacgcaaggggacacggccacgtacttttgcgcgcgccagaaatttgccaggggcgatcaagggtggtttttcgatctctggggcaggggcacgctaatagtcgtgagctcg

SEQ ID NO: 57409 - RNA, 375 nt, synthetic construct
  misc_feature 1..375: note = derived and/or modified sequence opt11 from anti-HIV-1_HeavyChain
  source 1..375: mol_type = other RNA
aggcacacgtggaataaatcgggctcgggagtgaaaaagcccggggcctcggtaagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgagatcgcgatctctttaccgcgcacatggacataagagggctcacgcaaggggacacggccacgtacttttgcgcgcgccagaaattttacgcgggcgggcaagggtggtatttcgatctctggggcaggggcacgctcatagtcgtgagctcg

SEQ ID NO: 57410 - RNA, 375 nt, synthetic construct
  misc_feature 1..375: note = derived and/or modified sequence opt11 from anti-HIV-1_HeavyChain
  source 1..375: mol_type = other RNA
gggacgccggggagcgagagtgggagcggggtgaagaagccgggggcgagcgtgagggtgagctgttggacgagcgaggacatattcgagaggacggagttgatacattgggtgaggcaggcgccggggcaggggttggagtggatagggtgggtgaagatagtgagtggggcggtgaatttcgggagcccgaactttaggcagagggtgagcttgacgagggacagggacttgttcacggcgcatatggatataagggggctgacacagggggatacggcgacgtatttctgtgcgaggcagaagttcgagaggggggggcaggggtggatatttgacttgtgggggagggggacgttgatagcggtgagtagc

SEQ ID NO: 57411 - RNA, 378 nt, synthetic construct
  misc_feature 1..378: note = derived and/or modified sequence opt11 from anti-HIV-1_HeavyChain
  source 1..378: mol_type = other RNA
caagtgcaattggtccagagcgggaccgaggtccagaaaccgggcgcgagcgtgaaagtgagctgtaaagcattcgggtactcattcacggactattacgtgtactgggtcaggcaagcgcccgggcaagggctcgagtacgtggcctggatcaatccctcgaacgggtacacgaaatatgcccagaaatttcaagattgggtgaccttgaccagggactcgagcataaacacggcctatctccagctcgcgcgcgtgacctcggacgataccgcgatctattactgtgccaggcaaaagttcgcgagcaggtactcgggcgatcaagggagctatttcgatctctggggcaggggcacgctcatagtcgtgagctcg

SEQ ID NO: 57412 - RNA, 378 nt, synthetic construct
  misc_feature 1..378: note = derived and/or modified sequence opt11 from anti-HIV-1_HeavyChain
  source 1..378: mol_type = other RNA
caggtccagctcgtgcaatcgggcgcggccgtgaaaaagcccgggagctcggtcaaggtctcgtgcaaggcctcgggctatatctttaccgggtactatatccattggatacgccaggccccgggccagggcttggaatggatggggtggataaacccgagcacgggcgataccaagttcgcgcgccagttccagggcagggtatcgttctatcgcacgcgcgagctcgggatcgcgtacatggacttgcgcgatctaaagttcgatgacacggccgtgtacttttgcgcgcgcaagaccaagggcgatgtctcgggcgatgacaggggctttttctttgacttgtgggggcgcgggaccagggtcatagtctcgagc

SEQ ID NO: 57413 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgcgggcatgaaaaagcccggggcctcgatgacggtctcgtgcaagacagcggacgaggacatattcgatgccgcgtacatgcactgggtcaggcaagcgccagggcaaacgttcgagtggctgggatggatgaagcccgtgaccggggcagtgaactatgccaggcaatttcaagggcgcgtgagcttttacaggaccagggaattgggcatagcctatatggatctaagggacttgaaatttgacgataccgcggtctatttctgtgccaggaaaacgaaaggggacgtgagcggggacgatcgagggttctttttcgatctatggggcaggggcacgcgagtgatcgtgagctcg

SEQ ID NO: 57414 - RNA, 381 nt, synthetic construct
  misc_feature 1..381: note = derived and/or modified sequence opt11 from anti-HIV-1_HeavyChain
  source 1..381: mol_type = other RNA
caggtgtttatggagcaggcggggggggggatgaagaagccgggggcgagtatgacggtgagttgcaagacggcggatgaggatgtgtttgatgcggcgtatatgcattgggtgaggcaggcgccggggcagacgtttgagtggttggggtggatgaagccggtgacgggggcggtgaattatgcgaggaagtttcaggggagggtgagtttttataggacgagggagttggggatagcatatatggatttgagggatttgaagtttgatgatacggcggtgtatttttgtgcgaggaagacgaagggggatgtgagtggggatgatagggggtttttttttgatttgtgggggagggggacgagggtgatagtgagtagt

SEQ ID NO: 57415 - RNA, 381 nt, synthetic construct
  misc_feature 1..381: note = derived and/or modified sequence opt11 from anti-HIV-1_HeavyChain
  source 1..381: mol_type = other RNA
caggtgtttatggagcaggcggggggggggatgaagaagccgggggcgagcatgacggtgagctgtaagacggcggatgaggatgtgtttgatgcggcgtatatgcattgggtgaggcaggcgccgggacagacgtttgagtggttggggtggatgaagccggtgacgggggcggtgaattatgcgaggcagtttcaggggagggtgagtttttataggacgagggagttggggatagcgtatatggatttgagggatttgaagtttgatgatacggcggtgtatttttgtgcgaggaagacgaagggggatgtgagtggggatgatagggggtttttttttgatttgtgggggagggggacgagggtgatagtgagtagt

SEQ ID NO: 57416 - RNA, 381 nt, synthetic construct
  misc_feature 1..381: note = derived and/or modified sequence opt11 from anti-HIV-1_HeavyChain
  source 1..381: mol_type = other RNA
caggtccatatggagcaagcgggagggggcgtgaaaaagcccggggcctcggtcacgctctcgtgcaagaccgcggacgaggacgtgttcgatgccgcgtacatgcactgggtcaggcaagcgcccgggcaaacgttcgagtggttgggctggatgaagcccgtgaccggggccgtgagctatgcaaggaaatttcaagggcgcgtgagcttttacatgaccagggaactgggcatggcctatatggatctcaggaacttgcgctttgacgataccgcggtctatttctgtgccaggaaaacggccggggacgtgagcggggacaatcgcgggtactttttcgatctctggggcagaggctcgcgcgtgatcgtgagctcg

SEQ ID NO: 57417 - RNA, 381 nt, synthetic construct
  misc_feature 1..381: note = derived and/or modified sequence opt11 from anti-HIV-1_HeavyChain
  source 1..381: mol_type = other RNA
caggtgtatatggagcaggcgggggggggaatgaagaagccgggggcgagtatgacggtgagttgtaagacggcggatgaggatatatttgatgcggcgtatatgcattgggtgaggcaggcgccggggcagacgtttgagtggctggggtggatgaagccggtgacgggggcggtgaattatgcgaggcagtttcaggggagggtgagtttttataggacgagggagttggggatggcgtatatggatttgaggaatttgaggttcgatgatacggcggtgtatttttgtgcgaggaagacggcgggggatgtgagcggggataatagggggtatttttttgatttgtgggggagggggagtagagtgatagtgagtagt

SEQ ID NO: 57418 - RNA, 381 nt, synthetic construct
  misc_feature 1..381: note = derived and/or modified sequence opt11 from anti-HIV-1_HeavyChain
  source 1..381: mol_type = other RNA
caggtctatatggagcaagcgggcgggggcgtgaaaaagcccggggcctcggtcacgctctcgtgcaagaccgcggacgaggacgtgttcgatgccgcgtacatgcactgggtaaggcaagcgcccgggcaaacgttcgagtggttgggctggatgaagcccgtgaccggggccgtgagctatgccaggaaatttcaagggcgcgtgagcttttacatgaccagggaattgggcatggcctatatggatctcaggaacttgcgctttgacgataccgcggtatatttctgtgccaggaaaacggccggggacgtgagcggggacaatcgcgggtactttttcgatctatggggcaggggatcgtgggtgatcgtgagctcg

SEQ ID NO: 57419 - RNA, 381 nt, synthetic construct
  misc_feature 1..381: note = derived and/or modified sequence opt11 from anti-HIV-1_HeavyChain
  source 1..381: mol_type = other RNA
caggtgcagttggtgcagagcggggcggaggtgaagaagccgggggcgagcgtgacgttgagttgtaagacggcggatgaggatgtgtttgatgcggcgtatatgcattgggtgaggcaggcgccggggcagacgtttgagtggttggggtggatgaagccggtgacgggggcggtgaattatgcgagaaagtttcaggggagggtgagtttttataggacgagggagttggggatagcgtatatggatttgaggaatctgaggtttgatgatacggcggtgtatttttgtgcgagaaagacggcgggggatgtgagtggggataagaggggatttttttttgatttgtgggggagggggagtagggtgatagtgagtagc

SEQ ID NO: 57420 - RNA, 384 nt, synthetic construct
  misc_feature 1..384: note = derived and/or modified sequence opt11 from anti-HIV-1_HeavyChain
  source 1..384: mol_type = other RNA
cagagccatctcgagcaatcgggctcggccatgaaaaagcccggggcctcggtcagggtctcgtgctggacctcggaagatatctttgacacgaccgagctcatatactgggtcaggcaagcgcccgggcaagggctcgagtggataggatgggtcaagatcgtgagcgggaccgtgaactttgcctcgctcgatttcaggaacaggatctcgctctcacgcgatcgcgggctctcgaccgcgtacatggacatacgcgggctcacgcaagatgacacggccacgtacttttgcgcgcgccagaaatttgcctcgcgctatagcggggaccagggctcgtactttgacttgtgggggcgcgggaccctgatcgtggtctcgagc

SEQ ID NO: 57421 - RNA, 384 nt, synthetic construct
  misc_feature 1..384: note = derived and/or modified sequence opt11 from anti-HIV-1_HeavyChain
  source 1..384: mol_type = other RNA
caggcgcacttggaacagagcgcgagcggggtaaggaggccgggggcgagtgtgagagtgagctgttggacgagcgaggacatattcgagaggtcggaattgatatattgggtgagacaggcgccggggagggggctggaatggatagggtggataaaattggtgtcgggggcggtaaatttcgggagcgtggactttagggatagggtgagcttgacgagggacagggacttgttcacggcacatatggatataaggggattgacacagggggatacggcgacatatttctgtgcaaggcagaagttcgagagcaggtacacgggagggcaggggtggtatttcgatctgtgggggagggggacgcacatagtagtgagctcg

SEQ ID NO: 57422 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcctagaatggatcgggtgggtgaaaacggtcacgggcgcggtcaattacgggagcttgaactttcgctcgcgcataagcctgaccagggacagggacttgttcacggcccatatggatatcaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 57423 - RNA, 384 nt, synthetic construct
  misc_feature 1..384: note = derived and/or modified sequence opt11 from anti-HIV-1_HeavyChain
  source 1..384: mol_type = other RNA
caagcgcacctggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtctcgggcgcggtcaatttcgggagcccgaactttcgccatcgcgtgagcttgaccagggacagggacttgttcacggcccatatggatatcaggggcttgacccagggcgataccgcgacctatttctgtgccagacaaaagttcgagagcaggtacacgggcgggcaagggtggtatttcgatctctggggcaggggcacgcacatagtcgtgagctcg

SEQ ID NO: 57424 - RNA, 384 nt, synthetic construct
  misc_feature 1..384: note = derived and/or modified sequence opt11 from anti-HIV-1_HeavyChain
  source 1..384: mol_type = other RNA
caggtccatctcgagcaatcgggctcgggcgtgaaaaagcccggggcctcagtcagagtctcgtgctggagctcggaagatatctttgaaaggaccgagctcatacactgggtcaggcaagcgcccgggcaagggctcgagtggataggctgggtcaagacagtgaccggggccgtgaactttggctcgctcgatttcaggcacaggatctcgctcacgcgcgatcgcgatttatttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57425 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaagacatcttcgacaccaccgaactaatctactgggtccgccaagcccccggccaaggcctcgaatggataggctgggtcaaaatcgtctccggcacagtcaacttcgcctcactcgacttccgcaaccgcatctccctcggccgcgaccgagacctctccaccgcctacatggacatccgcggcctcacccaagacgacaccgccacctacttctgcgcccgccaaaaattcgcctcccgctactcaggcgaccaaggctcctacttcgacctctggggccgcggcaccctcatcgtcgtctcctcc

SEQ ID NO: 57426 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgcgtgagctgttggacgagcgaggacatattcgagcgcacggaactgatccattgggtgcgccaggccccgggccagggcctggaatggatagggtgggtgaaaacggtcacgggcacggtcaatttcgggagcttgaactttcgccagcgcgtgagcttgaccagggacagggacttgttcacggcccatatggatatcaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 57427 - RNA, 384 nt, synthetic construct
  misc_feature 1..384: note = derived and/or modified sequence opt11 from anti-HIV-1_HeavyChain
  source 1..384: mol_type = other RNA
caatcccacctcgaacaatccggctccgccatgaaaaaacccggcgcctccgtccgcgtctcctgctggacctccgaaggcatcttcgacaccaccgaactcatctactgggtcagacaagcccccggccaaggcctcgaatggatcggctgggtcaaaatcgtctccggcaccgtcaacttcgcctccctcgacttccgcaaccgcatctccctctcccgcgaccgcgacctctccaccgcatacatggacatccgcggactcacccaagacgacaccgccacctacttctgcgcccgccaaaaattcgcctcccgctactccggcgaccaaggctcctacttcgacctctggggccgcggcaccctcatcgtcgtctcctcc

SEQ ID NO: 57428 - RNA, 384 nt, synthetic construct
  misc_feature 1..384: note = derived and/or modified sequence opt11 from anti-HIV-1_HeavyChain
  source 1..384: mol_type = other RNA
caatcgcgcttggaacagagcgggagcgcgatgaagaaaccgggcgcgagcgtgcgcgtgagctgttggacgagcgaggacatattcgataccacggaattgatctattgggtgcgccaggccccgggccagggcttggaatggatcgggtgggtgaaaatagtctcgggcacggtcaatttcgcgagcctggactttcgcaatcgcatcagcttgagcagggacagagacttaagcacggcccatatggatataaggggcttgacccaggacgataccgcgacctatttctgtgccaggcaaaagttcgcgagcaggtactcgggcgatcaagggagctatttcgatctctggggcaggggcacgctcataatcgtgagctcg

SEQ ID NO: 57429 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaaccgggcgcgagcgtgcgagtgagctgttggacgagcgaggacatattcgagaaatcggaattgatccattgggtgcgccaggccccgggccagggcttggaatggatcgggtgggtgaaaacggtcacgggcgcggtcaatttcggaagctcggactttcgccagcgcgtgagcttgaccagggacagggacttgttcacggcccatatggatatcaggggcttgacacagggcgataccgcgacctatttctgtgccaggcaaaagttcgagagcaggtacacgggcgggcaagggtggtatttcgatctctggggcaggggcacgcacatagtcgtgagctcg

SEQ ID NO: 57430 - RNA, 384 nt, synthetic construct
  misc_feature 1..384: note = derived and/or modified sequence opt11 from anti-HIV-1_HeavyChain
  source 1..384: mol_type = other RNA
caatcgcacttggaacagagcgggagcgcgatgaagaaaccgggcgcgagcgtgcgcgtgagctgttggacgagcgaggacatattcgataccacggaattgatctattgggtgcgccaggccccgggccagggattggaatggatcgggtgggtgaaaatagtctcgggcacggtcaatttcgcgagctcggactttcgcaatcgcatcagcttgagcagggacagagacttgagcacggcctatatggatataaggggcttgacacaggacgataccgcgacctatttctgtgcaaggcaaaagttcgcgagcaggtactcgggcgatcaagggagctatttcgatctctggggcaggggcacgctcataatcgtgagctcg

SEQ ID NO: 57431 - RNA, 384 nt, synthetic construct
  misc_feature 1..384: note = derived and/or modified sequence opt11 from anti-HIV-1_HeavyChain
  source 1..384: mol_type = other RNA
caggcccatctcgagcaatcgggctcgggcgtgaaaaagcccggggcctcggtcagggtctcgtgctggacctcggaagatatctttgaaaggaccgagctcatacactgggtcaggcaagcgcccgggcaagggctcgagtggataggctgggtcaagatcgtgagcgggaccgtgaactttgcctcgctcgatttcaggaacaggatctcactctcgcgagatcgcgatctctcgaccgcgtacatggacatacgcgggctcacgcaagatgacacggccacgtacttttgcgcgcgccagaaatttgcctcgcgctatagcggggaccagggctcgtactttgacttgtgggggcgcgggaccctgatcgtggtctcgagc

SEQ ID NO: 57432 - RNA, 384 nt, synthetic construct
  misc_feature 1..384: note = derived and/or modified sequence opt11 from anti-HIV-1_HeavyChain
  source 1..384: mol_type = other RNA
aggcacacgtgggagcaatcgggatcgggcgtgaaaaagcccggggcatcggtcagggtctcgtgctggagctcggaagatatctttgaaaggaccgagctcatacactgggtcaggcaagcgcccgggcaagggctcgagtggataggctgggtcaagaccgtgaccggggccgtgaactttggctcgctcgatttcaggcacaggatctcgctcacgcgcgatcgagatctctttaccgcgcacatggacatacgcgggctcacgcaaggggacacggccacgtacttttgcgcgcgccagaaatttgaatcgcgctataccgggggccagggctggtactttgacttgtgggggcgcgggacccatatcgtggtctcgagc

SEQ ID NO: 57433 - RNA, 384 nt, synthetic construct
  misc_feature 1..384: note = derived and/or modified sequence opt11 from anti-HIV-1_HeavyChain
  source 1..384: mol_type = other RNA
aggcacacgtgggagcaatcgggctcgggcgtgaaaaagcccggggcctcggtcagggtctcgtgctggacctcggaagatatctttgaaaggaccgagctcatacactgggtcaggcaagcgcccgggcaagggctagagtggataggctgggtcaagaccgtgaccggggccgtgaactttggctcgctcgatttcaggcacaggatctcgctcacgcgcgatcgcgatctctttaccgcgcacatggacataagagggctcacgcaaggggacacggccacgtacttttgcgcgcgccagaaatttgaatcgcgctataccgggggccagggctggtactttgacttgtgggggcgcgggacccatatagtggtctcgagc

SEQ ID NO: 57434 - RNA, 414 nt, synthetic construct
  misc_feature 1..414: note = derived and/or modified sequence opt11 from anti-HIV-1_HeavyChain
  source 1..414: mol_type = other RNA
caagcccacctcgaacaatccggctccggcgtcaaaaaacccggcgcctccgtccgcgtctcctgctggacctccgaagacatcttcgaacgctcagaactcatacactgggtccgccaagcccccggccaaggcctagaatggatcggatgggtcaaaaccgtcaccggcgccgtcaacttcggctcccccaacttccgccaccgagtctccctcacccgagaccgcgacctcttcaccgcccacatggacatccgcggcctcacccaaggcgacaccgccacctacttctgcgcccgccaaaaatactacgccggcggccaaggctggtacttcgacctctggggccgaggcaccctcatcgtcgtctcctccgcctccaccaaaggcccctccgtcttccacgacctccgc

SEQ ID NO: 57435 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggcaccgggccagggattggaatggatcgggtgggtgaaaatagtctcgggcgcggtcaatttcgggagcccgaactttcgccagcgcgtgagcctgaccagggacagggacttgttcacggcccatatggatatcaggggcctgacccagggcgatacagcgacctatttctgtgccaggcaaaagttcgagcgcgggggccagggctggatctttgacttgtgggggcgcgggaccttgatcgcggtctcgagcgcgagcacgaaagggccctcggtctttcccacgatctgtgtc

SEQ ID NO: 57436 - RNA, 417 nt, synthetic construct
  misc_feature 1..417: note = derived and/or modified sequence opt11 from anti-HIV-1_HeavyChain
  source 1..417: mol_type = other RNA
caagcgcacttggaacagagcgggagcggggtcaagaaaccgggcgcgagcgtgcgcgtgagctgttggacgagcgaggacatattcgagaaatcagaattgatccactgggtgcgccaggccccgggccagggcttggaatggatcgggtgggtgaaagcggtctcgggcgcggtcaattacgggagcttggactttcgacatcgcgtgagcctgaccagggacagagacctattcacggcccatatggatataaggggcttgacccaggacgataccgcgatctatttctgtgccaggcaaaagttcgcgcgcggggaccagggctggttctttgacttgtgggggcgcgggaccttgatcgtggtctcgagcgcgagcacgaaagggccatcggtctttccccatgacttgcgc

SEQ ID NO: 57437 - RNA, 417 nt, synthetic construct
  misc_feature 1..417: note = derived and/or modified sequence opt11 from anti-HIV-1_HeavyChain
  source 1..417: mol_type = other RNA
caagcgcacctggaacagagcgggagcggggtcaagaaagtgggagcaagcgtgcgcgtgagctgttggacaagcgaggacatattcgagcgcacggaattgatccactgggtgcgccaggccccgggccagggcctggaatggatcggatgggtaaaagcggtctcgggcgcggtcaactacggaagcctggactttcgccaccgcgtgagcctgaccagggacagggacttgttcacggcccatatggatatcagaggcctgacccaagacgataccgcgatctatttctgcgccaggcaaaagttcgcgcgcggagaccagggctggttctttgacttgtggggacgcgggaccttaatcgtagtctcaagcgcgagcacgaaagggccctcagtcttcccccatgacctgcgc

SEQ ID NO: 57438 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggagtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgagatctctttaccgcgcacatggacatacgcgggctcacgcaaggggacacggccacatacttttgcgcgcgccagaaattttacgcgggcgggcaagggtggtatttcgatctctggggcaggggcacgctcatagtcgtgagctcggcctcgaccaagggcccgagcgtgttcccgcacgatctaagg

SEQ ID NO: 57439 - RNA, 423 nt, synthetic construct
  misc_feature 1..423: note = derived and/or modified sequence opt11 from anti-HIV-1_HeavyChain
  source 1..423: mol_type = other RNA
caagtgtacatggaacaggccggggccggggtcaagaaaccgggcgcgagcgtgacattgagctgtaaaacggccgatgaagatgtctttgacgcggcctatatgcattgggtgcgccaggccccgggccagacctttgaatggctcgggtggatgaaaccggtcacgggcgcggtctcgtacgcgcgcaagttccagggcagggtatcgttctatatgacgcgcgagctcgggatggcgtacatggacttgcgcaatctcaggttcgatgacacggccgtgtacttttgcgcgcgcaagaccgcgggcgatgtctcgggcgataacaggggctatttctttgacttgtgggggcgcgggagcagggtcatagtctcgagcgcgagcacgaaagggccctcagtctttccccatgacttgcgc

SEQ ID NO: 57440 - RNA, 426 nt, synthetic construct
  misc_feature 1..426: note = derived and/or modified sequence opt11 from anti-HIV-1_HeavyChain
  source 1..426: mol_type = other RNA
caatcccacctcgaacaatcaggctccgccatgaaaaaacccggcgcctccgtccgcgtctcctgctggacctccgaagacatcttcgacacaaccgaactcatctactgggtccgccaagcccccggccaaggcctcgaatggatcggctgggtcaaaatcgtctccggcaccgtcaacttcgcctcactcgacttccgcaaccgcatctccctatcccgcgaccgagacctctcaaccgcctacatggacatccgcggcctcacccaagacgacaccgccacctacttctgcgcccgccaaaaattcgcctcccgatactctggcgaccaaggctcctacttcgacctctggggccgcggcaccctcatcgtcgtctcctccgcctccaccaaaggcccctccgtcttccccaccatctacgtc

SEQ ID NO: 57441 - RNA, 372 nt, synthetic construct
  misc_feature 1..372: note = derived and/or modified sequence opt11 from anti-HIV-1_HeavyChain
  source 1..372: mol_type = other RNA
caagtgcaattggtccagagcggggccgaggtcaagaaaccgggcgcgagcgtgaaagtgagctgtaaagcgagcgggggcacgctctcgagctatgccataagctgggtcaggcaagcgcccgggcaagggctcgagtggataggctgggtcaagaccgtgaccggggccgtgaactttggctcggcctgtttcaggcacagggtctcactcacgcgcgatcgcgatctatttaccgcgcacatggacatacgcgggctcacgcaaggggacacggccacgtacttttgcgcgcgccagaaattttacaagggcgggcaagggtggtatttcgatctctggggcaggggcacgctcatagtcgtgagctcg

SEQ ID NO: 57442 - RNA, 372 nt, synthetic construct
  misc_feature 1..372: note = derived and/or modified sequence opt11 from anti-HIV-1_HeavyChain
  source 1..372: mol_type = other RNA
cacgtgcgcttggtccagagcggggccgaggtcgagaaaccgggcgcgagcgtgaaagtgagctgtgaaacgagcaattacccgttcaatatgtatggcatgacctgggtcaggcaagcgcccgggcaagggctagagtggataggctgggtcaagatcgtgagcggggcagtgaactttggctcgcccaatttcaggcaaagagtctcgctcacgcgcgatcgcgatctatttaccgcgcacatggacatacgcgggctcacgcaaggggacacggccacgtacttttgcgcgcgccagaaatttgaaaggggcgggcaagggtggatattcgatctctggggcaggggcacgctcatagccgtgagctcg

SEQ ID NO: 57443 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcaggcgtgaaaaagctcggggcctcggtcagggtctcgtgctggacctcggaagatgtctttgaaaggaccgagctcatacactgggtcaggcaagcgcccgggcaagggctcgagtggataggatgggtcaaggccgtgagcggggccgtgaactatggctcgctcgatttcaggcacagggtctcgctcacgcgcgatcgcgatctctttaccgcgcacatggacatacgcgggctaacgcaagatgacacggccacgtacttttgcgcgcgacagaaattttacgcgggagggcaagggtggtatttcgatctctggggcaggggcacgctcatagtagtgagctcg

SEQ ID NO: 57444 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaagcccggggcctcggtcagggtctcgtgctggagctcggaagatatctttgaaaggaccgagctaatacactgggtcaggcaagcgcccgggcaagggctcgagtggataggctgggtcaagaccgtgaccggggccgtgaactttggctcgctcgatttcaggcacaggatctcgctcacgcgcgatcgcgatctctttaccgcgcacatggacatacgcgggctcacgcaaggggacacggccacgtacttttgcgcgcgccagaaatttgaaaggggcgggcaagggtggtatttcgatctctggggcaggggcacgctcatagtcgtgagctcg

SEQ ID NO: 57445 - RNA, 375 nt, synthetic construct
  misc_feature 1..375: note = derived and/or modified sequence opt11 from anti-HIV-1_HeavyChain
  source 1..375: mol_type = other RNA
aggcacacgtgggagcaatcgggctcgggcgtgaaaaggcccggggcctcggtcagggtctcgtgctggacctcggaagatatctttgaaacgaccgagctcatacactgggtcaggcaagcgcccgggcaagggctcgagtggataggctgggtcaagaccgtgagcggggccgtgaactttggctcactcaatttcaggcacagggtctcgctcacgagagatcgcgacctctcgaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 57446 - RNA, 381 nt, synthetic construct
  misc_feature 1..381: note = derived and/or modified sequence opt11 from anti-HIV-1_HeavyChain
  source 1..381: mol_type = other RNA
caggtgtttatggagcaggcgggggcggggatgaagaagccgggggcgagtatgacggtgagttgtaagacggcggatgaggatgtgtttgatgcggcgtatatgcattgggtgaggcaggcgccggggcagacgtttgagtggttggggtggatgaagccggtgacgggggcggtgaattatgcgaggcagtttcaggggagggtgagtttttataggacgagggagttggggatagcgtatatggatctgagggatttgaagtttgatgatacggcggtgtatttttgtgcgaggaagacgaagggggatgtgagcggggatgatagggggtttttttttgatctgtgggggagagggacgagggtgatagtgagtagt

SEQ ID NO: 57447 - RNA, 384 nt, synthetic construct
  misc_feature 1..384: note = derived and/or modified sequence opt11 from anti-HIV-1_HeavyChain
  source 1..384: mol_type = other RNA
caagtgcacttggaacagagcgggagcggggtaaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcttggactttcgccatcgcatcagcttgaccagggacagggacttgttcacggcccatatggatataaggggcttgacccagggcgataccgcgacctatttctgtgcaaggcaaaagttcgagagcaggtacacgggcgggcaagggtggtatttcgatctatggggcaggggcacgcacatagtcgtgagctcg

SEQ ID NO: 57448 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcaggcgtgaaaaagctcggggcctcggtcagggtctcgtgctggacctcggaagatatcttcgaaaggaccgagctcatacactgggtcagacaagcgcccgggcaagggctagagtggataggctgggtcaaggccgtgagcggggccgtgaactatggctcgctcgatttcagacacagggtctcgctcacgcgcgatcgcgatctctcgaccgcacacatggacatacgcgggctcacgcaagatgacacagccacgtacttttgcgcgcgccagaaatttgccaggggcgatcaagggtggtttttcgatctatggggaaggggcacgctcatagtcgtgagctcggcctcgaccaagggcccgagcgtgttcccgaccatatgcgtg

SEQ ID NO: 57449 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagcccggggcatcggtcagggtctcgtgctggacctcggaagatatctttgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtacttctgcgcgcgccagaaattttacgcgggcgggcaagggtggtatttcgatctctggggcaggggcacgctcatagtcgtgagctcggcctcgaccaagggcccgagcgtgttcccgaccatatgcgtg

SEQ ID NO: 57450 - RNA, 417 nt, synthetic construct
  misc_feature 1..417: note = derived and/or modified sequence opt11 from anti-HIV-1_HeavyChain
  source 1..417: mol_type = other RNA
caggcccatctcgagcaatcgggctcgggcgtgaaaaagctcggggcctcggtcagggtctcatgctggacctcggaagatgtctttgaaaggaccgagctcatacactgggtcaggcaagcgcccgggcaagggctcgagtggataggctgggtcaaggccgtgagcggggccgtgaactatggctcgctcgatttcaggcacagggtctcgctaacgcgcgatcgcgatctatttaccgcgcacatggacatacgagggctcacgcaagatgacacggccacgtacttctgcgcgcgccagaaattctacgcgggcgggcaagggtggtacttcgatctctggggcaggggcacgctcatagtcgtgagctcggcctcgaccaagggcccgagcgtgttcccgcacgatctcagg

SEQ ID NO: 57451 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagatagtgtcgggggcggtgaatttcgggagcccgaactttaggcagagggtgagcttgacgagggacagggacttgttcacggcgcatatggatataagggggttgacgcagggggatacggcgacgtatttctgtgcgaggcagaagttcgagaggggagggcaggggtggtactttgacttgtgggggagagggacgttgatagtggtgagtagc

SEQ ID NO: 57452 - RNA, 384 nt, synthetic construct
  misc_feature 1..384: note = derived and/or modified sequence opt11 from anti-HIV-1_HeavyChain
  source 1..384: mol_type = other RNA
caagcgcacttggaacagagcgggagcggggtcaagaaattgggcgcgagcgtgcgcgtgagctgttggacgagcgaggacatattcgagcgcacggaattgatacattgggtgcgacaggccccgggccagggcttggaatggatcgggtgggtgaaaacggtcacgggcgcggtcaatttcgggagcttggactttcgccatcgaatcagcttgaccagggacagggacttgttcacggcccatatggatataaggggcttgacccagggcgataccgcgacctatttctgtgccaggcaaaagttcgagagcaggtacacgggcgggcaagggtggtatttcgatctctggggcaggggcacgcacatagtcgtgagctcg

SEQ ID NO: 57453 - RNA, 426 nt, synthetic construct
  misc_feature 1..426: note = derived and/or modified sequence opt11 from anti-HIV-1_HeavyChain
  source 1..426: mol_type = other RNA
caagcccacctcgaacaatcaggctccggcgtcaaaaaacccggcgcctccgtccgcgtctcctgctggtcctccgaagacatcttcgaacgcaccgaactaatccactgggtccgccaagcccccggccaaggcctcgaatggatcggctgggtcaaaaccgtcaccggcgccgtcaacttcggctccctcgacttccgccaccgcatctccctcacccgcgaccgcgacctcttcaccgcccacatggacatccgcggcctcacccaaggcgacaccgcaacctacttctgcgcccgccaaaaattcgaatcccgatacaccggcggccaaggctggtacttcgacctatggggccgcggcacccacatcgtcgtctcctccgcctccaccaaaggcccctccgtcttccccaccatctgcgtc

SEQ ID NO: 57454 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcacgagcgtgcgcgtgagctgttggacgagcgaggacatattcgagcgaacggaattgatccattgggtgcgacaggccccgggccagggcttggaatggatcgggtgggtgaaaacggtcacgggcgcggtcaatttcgggagcccgaactttcgacatcgcgtgagcttgaccagggacagggacttgttcacggcccatatggatatcaggggcttgacccagggcgataccgcgacctatttctgtgccaggcaaaagttcgagcgagggggccagggctggtactttgacttgtgggggcgcgggaccttgatcgtggtctcgagc

SEQ ID NO: 57455 - RNA, 381 nt, synthetic construct
  misc_feature 1..381: note = derived and/or modified sequence opt11 from anti-HIV-1_HeavyChain
  source 1..381: mol_type = other RNA
caggtccagctcgtgcaatcaggcgcggaagtcaaaaagcccggggcctcagtaaaggtctcgtgcaaggcctcgggctatacctataccacgtacggggtctcgtggctgcgccaggtcccgggccagcgcccggaatggatggggtggatacgcccgaaaacgggcgcgcgcaatcaagcgcgccagttccagcccaggatctcgctcacgcgcgatcgcgcgctctcgaccgcgtacttggacttgaactcgctcacgagcgcggactcgggcacgtacttttgcgcgcgccagacctttaaaccggacttttactttgccgatcaagggtggtcgttcaatctctggggcaggggcgcgcactttatcgtgagctcg

SEQ ID NO: 57456 - RNA, 384 nt, synthetic construct
  misc_feature 1..384: note = derived and/or modified sequence opt11 from anti-HIV-1_HeavyChain
  source 1..384: mol_type = other RNA
cgcgcgcacttggaacagagcgggagcggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggagcggtcaattacgggagcttggactttcgccatcgagtgagcttgaccagggacagggacttgttcacggcccatatggatatcaggggcttgacccaggacgataccgcgacctatttctgtgccaggcaaaagttcgagagcaggtacacgggcgggcaagggtggtatttcgatctctggggcaggggcacgcacataaccgtgagctcg

SEQ ID NO: 57457 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtaagggtgagctgttggacgagcgaggacatattcgagaggacggagttgatacattgggtaaggcaggcgccggggcaggggttggagtggatagggtgggtgaagatagtgagtggggcggtgaatttcgggagcccgaactttaggcagagggtgagcttgacgagggacagggacttgttcacggcacatatggatataagggggctgacgcagggggatacggcgacgtattactgtgcgaggcagaagttcgagaggggggggcaggggtggatatttgacttgtgggggagggggacgttgatagcggtgagtagc

SEQ ID NO: 57458 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtatcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgcgatcgcgatctctttaccgcgcacatggacatacgcgggctcacacaagatgacacggccacgtacttttgcgcgcgccagaaatttgccaggggcgatcaagggtggtttttcgatctctggggccatggcacgctcatagtcgtgagctcg

SEQ ID NO: 57459 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagagaacggagttgatacattgggtgaggcaggcgccggggcaggggttggagtggatagggtgggtgaagacggtgacgggggcggtgaatttcgggagcccgaactttaggcatagagtgagcttgacgagggacagggacttgttcacggcgcatatggatataagggggttgacgcagggggatacggcgacgtatttctgtgcgagacagaagttcgagagaggagggcaggggtggtactttgacttgtgggggcacgggacgttgatagtggtgagtagc

SEQ ID NO: 57460 - RNA, 375 nt, synthetic construct
  misc_feature 1..375: note = derived and/or modified sequence opt11 from anti-HIV-1_HeavyChain
  source 1..375: mol_type = other RNA
caggcccacctcgagcaatcgggctcgggcgtgaaaaagcccggggcatcggtcagggtctcgtgctggacctcggaagatatctttgaaaagagcgagctcatacactgggtcaggcaagcgccagggcaagggctcgagtggataggctgggtcaagaccgtgaccggggccgtgaactttggctcgagcgatttcagacaaagagtctcgctcacgcgcgatggagatctatttaccgcgcacatggacatacgcgggctaacgcaaggggacacggccacgtacttttgcgcgcgccagaaattttacgcgggcgggcaagggtggtatttcgatctctggggcaggggcacgctcataatcgtgagctcg

SEQ ID NO: 57461 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcaagcgtacgagtgagctgttggacgagcgaggacatattcgagaaatcggaactgatccattgggtgcgccaggccccgggccagggcttggaatggatcgggtgggtgaaaacggtaacaggcgcggtcaatttcgggcaccagatctcggacagggtctcgctcacgcgcgaccgcgatctctttaccgcgcacatggacatacgcgggctcacgcaaggggacacggccacgtacttttgcgcgcgccagaaattttacgcgggcgggcaagggtggtatttcgatctctggggccatggcacgctaatagtcgtgagctcg

SEQ ID NO: 57462 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtaagggtgagctgttggacgagcgaggacatattcgagagaacggagctgatacattgggtgagacaggcgccggggcaggggttggagtggatagggtgggtgaagacggtgagtggggcggtgaatttcgggagcccgaactttaggcatagggtgagcttgacgagggacagggacttgttcacggcacatatggatataagggggttgacgcagggggatacggcgacgtatttctgtgcgaggcagaagttcgagaggggagggcaggggtggtactttgacttgtgggggcacgggacgttgatagtggtgagtagc

SEQ ID NO: 57463 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcggggccggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtctcgggcgcggtaaatttcgggagcccgaactttcgccatcgcgtgagcttgaccagggacagagacctgttcacggcccatatggatatcaggggcttgacccagggcgataccgcgacctattactgtgccaggcaaaagttcgagcgcgggggccagggctggtactttgacttgtgggggcgcgggaccttgatcgtggtctcgagc

SEQ ID NO: 57464 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggatcgggcgtgaaaaagctcggggcctcggtcagggtctcgtgctggacctcggaagatatctttgaaaggaccgagctcatacactgggtcaggcaagcgcccgggcgcgggctcgagtggataggctgggtcaaggccgtgagcggggccgtgaactatggctcgctcgatttcaggcacagggtctcgctcacgcgcgatcgcgatctctttaccgcgcacatggacatacgcgggctcacgcaagatgacacggccacgtactattgcgcgcgccagaaatttgaaaggggcgggcaagggtggatattcgatctctggggcaggggcacgctcatagccgtgagctcg

SEQ ID NO: 57465 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaaaagagcgagctcatacactgggtcaggcaagcgcccgggcaagggctagagtggataggctgggtaaagaccgtgaccggggccgtgaactttggctcgagcgatttcaggcaaagggtctcgctcacgcgcgatcgcgatctctttaccgcgcacatggacatacgcgggctcacgcaaggggacacggccacgtactattgcgcgcgccagaaattttacgcgggcgggcaagggtggtatttcgatctctggggcaggggcacgctcatagtcgtgagctcg

SEQ ID NO: 57466 - RNA, 375 nt, synthetic construct
  misc_feature 1..375: note = derived and/or modified sequence opt11 from anti-HIV-1_HeavyChain
  source 1..375: mol_type = other RNA
caagcccacctcgaacaatccggctccggcgtcaaaaaacccggcgcctccgtcagagtctcctgctggacctccgaagacatcttcgaacgcaccgaactcatccactgggtccgccaagcccccggccaaggcctcgaatggatcggctgggtcaaaaccgtcaccggcgccgtcaacttcggctcccccaacttccgccaccgcgtctccctcacccgcgaccgcgacctcttcaccgcccacatggacatccgaggcctcacccaaggcgacaccgccacctacttctgcgcccgccaaaaattctacaaaggcggccaaggctggtacttcgacctctggggccgcggcaccctcatcgtcgtctcctcc

SEQ ID NO: 57467 - RNA, 372 nt, synthetic construct
  misc_feature 1..372: note = derived and/or modified sequence opt11 from anti-HIV-1_HeavyChain
  source 1..372: mol_type = other RNA
tacgtggaactgggcacgaacacgggcccggaagtgcgcaagcccggggcctcggtcaagatctcgtgcaagacctcgggctatatctttaccgataactatttccattggttgcgccaggccccggccgtgggcctggaatggatggggtggataaactcgcacaatggctataccaagagcgcgaaaaagttccagggcagaatcacgatgacgcgcgataccgcggtcgataccgcgtacatggaattgatcgatctcacgagcgatgacacggccacgtactattgcgcgcgccagaaattttacgcgggcggacaagggtggtatttcgatctctggggctgtggcacgctcatagtcgtgagctcg

SEQ ID NO: 57468 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcaggctcgggcgtgaaaaagcccggggcctcggtcagggtctcgtgctggacctcggaagatatctttgaaaagagcgagctcatacactgggtcaggcaagcgcccgggcaagggctcgagtggataggctgggtcaagaccgtgaccggggccgtaaactttggctcgagcgatttcaggcaaagggtctcgctcacgcgagatagagatctctttaccgcgcacatggacatacgcgggctcacgcaaggggacacggccacgtacttttgcgcgcgccagaaattttacgcgggcgggcaagggtggtatttcgatctctggggcaggggcacgctcatatgcgtgagctcg

SEQ ID NO: 57469 - RNA, 375 nt, synthetic construct
  misc_feature 1..375: note = derived and/or modified sequence opt11 from anti-HIV-1_HeavyChain
  source 1..375: mol_type = other RNA
caggcgcatttggagcagagtgggagcggggtgaagaagccgggggcgagtgtgagggtgagttgttggacaagcgaggacatatttgagaggacggagttgatacattgggtgaggcaggcgccggggcaggggttggagtggatagggtgggtgaagacggtgacgggggcggtgaatttcgggagcagtgactttaggcagagggtgagtctgacgagggacagggacttgtttacggcgcatatggatataagggggttgacgcagggggatacggcgacgtattactgtgcgaggcagaagttttatgcgggggggcaggggtggtattttgacttgtgggggagggggacgttaatagtggtgagtagc

SEQ ID NO: 57470 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgaacggaattgatccattgggtgcgccaggccccgggccagggcttggaatggatcgggtgggtgaaaccggtcacgggcgcagtcaatttcgggagcccgaactttcgccatcgcgtgagcttgaccagggacagggacttgttcacggcccatatggatatcaggggcttgacccagggcgatacagcgacctatttctgtgccaggcaaaagttcgagcgcgggggccagggctggtactttgacttgtgggggcgcgggaccttgatcgtggtctcgagc

SEQ ID NO: 57471 - RNA, 375 nt, synthetic construct
  misc_feature 1..375: note = derived and/or modified sequence opt11 from anti-HIV-1_HeavyChain
  source 1..375: mol_type = other RNA
caggtgcagttggtgcagagtggggcggaggtgaagaagccgggggcgagtgtgagggtgagttgttggacgagtgaggatatatttgagaagagtgagttgatacattgggtgaggcaggcgccggggcaggggttggagtggatagggtgggtgaagacggtgacgggggcggtgaattttgggagtagtgattttaggcagagggtgagtctgacgagggacagggacttgtttacggcgcatatggatataagggggttgacgcagggggatacggcgacgtattattgtgcgaggcagaagtttgagaggggggggcaggggtggtattttgacctgtgggggagggggacgttgatagtggtgagtagt

SEQ ID NO: 57472 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtatcgtgctggacctcagaagatatctttgaaaggaccgagctcatacactgggtcaggcaagcgcccgggcaagggctcgagtggataggctgggtcaaggccgtgagcggggccgtgaactatggctcgctcgatttcaggcacagggtctcgctcacgcgtgatcgcgatctctcgacagcgcacatggacatacgcgggctcacgcaagatgacacggccacgtactcgtgcgcgcgccagaaatttgccaggggcgatcaagggtggtttttcgatctctggggcaggggcacgctaatagtcgtgagctcg

SEQ ID NO: 57473 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccggggacgagcgtgagagtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggatataagggggttgacgcagggggatacggcgacgtattactgtgcgaggcagaagttcgagaggggggggcaggggtggtactttgacttgtgggggagggggacgttgatagtggtgagtagc

SEQ ID NO: 57474 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgacaggccccgggccagggcttggaatggatcgggtgggtgaaaacggtcacgggcacggtcaatttcgggagcttgaactttcgccagcgcgtgagcttgaccagggacagggacctgttcacggcccatatggatatcaggggcttgacccagggcgataccgcgacatatttctgtgccaggcaaaagttcgcgcgcggggaccagggctggttctttgacctgtgggggcacgggaccttgatcgtggtctcgagc

SEQ ID NO: 57475 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaaccgggcgcgagcgtgcgcgtgagctgttggacgagcgaggacatattcgagcgcacggaattgatccattgggtgcgccaggccccgggccagggcttggaatggatcgggtgggtgaaaacggtcacgggcgcggtcaatttcgggagcccgaactttcgccatcgcgtgagcttgaccagggacagggacccgttcacggcccatatggatatcaggggcctgacacagggcgataccgcgacctatttctgtgccagacaaaagttcgagcgcgggggccagggctggtactttgacttgtgggggcacgggaccttgatcgtggtctcgagc

SEQ ID NO: 57476 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcatcggtcagggtatcgtgctggacctcggaagatatctttgaaaggaccgagctcatacactgggtcaggcaagcgcccgggcaagggctcgagtggataggctgggtcaagacagtgaccggggccgtgaactttggctcgcccaatttcaggcacagggtctcgctcacgcgcgatcgcgatctctttaccgcgcacatggacatatgcgggctcacgcaaggggacacggccacgtacttttgcgcgcgccagaaatttgaaaggggcgggcaagggtggtatttcgatctctggggccatggcacgctcatagtcgtgagctcg

SEQ ID NO: 57477 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactatggctcgctcgatttcaggcaaagggtctcgctcacgcgcgatcgagatctctttaccgcgcacatggacatacgcgggctcacgcaaggggacacggccacgtactattgcgcgcgccagaaattttacgcgggcgggcaagggtggtatttcgatctctggggcaggggcacgctcatagtcgtgagctcg

SEQ ID NO: 57478 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgagtgagctgttggacgagcgaggacatattcaagagcgagctcatacactgggtcaggcaagcgcccgggcaagggctcgagtggataggctgggtcaagaccgtgaccggggcagtgaactttggctcgagcgatttcaggcaaagggtctcgctcacgcgcgatcgcgatctatttaccgcgcacatggacatacgcgggctcacgcaaggggacacggccacgtacttttgcgcgcgccagaaattttacgcgggcgggcaagggtggtatttcgatctctggggccatggcacgctcatagtcgtgagctcg

SEQ ID NO: 57479 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccgggacctcggtcagggtctcgtgctggacctcggaagatatctttgaaaggaccgagctcatacactgggtcaggcaagcgcccgggcaagggctcgagtggataggctgggtcaagaccgtgaccggggccgtgaactttggctcgcccaatttcaggcacagggtctcgctcacgcgcgatcgcgatctctttaccgcgcacatggacatacgcgggctcacgcaaggggacacggccacgtacttttgcgcgcgccagaaatttgccaggggcgatcaagggtggtttttcgatctctggggccatggcacgctcatagtcgtgagctcg

SEQ ID NO: 57480 - RNA, 375 nt, synthetic construct
  misc_feature 1..375: note = derived and/or modified sequence opt11 from anti-HIV-1_HeavyChain
  source 1..375: mol_type = other RNA
caagcgcacttggaacagagcgggagcggggtcaagaaattgggcgcgagcgtgcgcgtgagctgttggacgagcgaggacatattcgagcgcacggaattgatccattgggtgcgccaggccccgggccagggcttggaatggatcgggtgggtgaaagcggtctcgggcgcggtcaattacgggagcttggactttcgacatcgcgtgagcttgaccagggacagggacttgttcacggcacatatggatatcaggggcttgacccaggacgataccgcgacctattactgtgccaggcaaaagttcgcgcgcggggaccagggctggttctttgacttgtgggggcgcgggaccttgatcgtggtctcgagc

SEQ ID NO: 57481 - RNA, 381 nt, synthetic construct
  misc_feature 1..381: note = derived and/or modified sequence opt11 from anti-HIV-1_HeavyChain
  source 1..381: mol_type = other RNA
caagtccaactcgtccaatccggcgccgaagtcaaaaaacccggcgcctccgtcaaagtctcctgcaaagcctcaggctacaccttcaccgactactacctccactgggtccgccaagcccccggccaaggcctcgactgggtcggctggatcaaccccaactccggcggcaccaactacgcccaaaaattccaaggccgcgtcgccatgacccgcgacacctccctctcctccgtctacctcgacctcaactccctcacctccgccgactccggcacctacttctgcgcccgccaaaccttcaaacccgacttctacttcgccgaccaaggctggtccttcaacctctggggccaaggctcccacttcatcgtctcctcc

SEQ ID NO: 57482 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcaggcgtgaaaaagcccggagcctcggtcagggtctcgtgctggacctcggaagatatctttgaaaagagcgagctcatacactgggtaaggcgcgcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgcgggctcacgcaaggggacacggccacgtactattgcgcgcgccagaaattttacgcgggcgggcaagggtggtatttcgatctctggggcaggggcacgctcatagtcgtgagctcg

SEQ ID NO: 57483 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgaccgtgagctgttggacgagcgaggacatattcgagaaatcggaattgatccattgggtgcgccaggccccgggccagggcttggaatggatcgggtgggtgaaaacggtcacgggcgcggtcaatctcgtataccagatctcggacagggtctcgctcacgcgcgatcgcgggctctttaccgcgcacatggacatacgcgggctcacgcaaggggacacggccacgtactattgcgcgcgccagaaattttacgcgggcgggcaagggtggtatttcgatctatggggcaggggcacgctcatagtcgtgagctcg

SEQ ID NO: 57484 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagatatctttgaagggagcgagctcatacactgggtcaggcaagcgcccgggcaagggctcgagtggataggctgggtcaagaccgtgaccggggccgtgaactttggctcggcctatttcaggcacagggtctcgctaacgcgcgatcgcgatctctttaccgcgcacatggacatacgcgggctcacgcaaggggacacggccacgtacttttgcgcgcgacagaaattttacaagggcgggcaagggtggtatttcgatctatggggccatggcacgctaatagtcgtgagctcg

SEQ ID NO: 57485 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggcgtgaaaaagcccggggcctcggtcagggtctcgtgctggacctcggaagacatctttgaaaggaccgagctcatacactgggtcagacaagcgccagggcaagggctcgagtggataggctgggtcaagaccgtgaccggggccgtgaactatggctcactcaatttcaggagcaggatctcgctcacgcgcgatcgcgatctctttaccgcacacatggacatacgcgggctcacggaaggggacacggccacgtacttttgcgcgcgccagaaattttacgcgggcgggcaagggtggtatttcgatctatggggccatggcacgctcatagtcgtgagctcg

SEQ ID NO: 57486 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcgggagtgaaaaagcccggggcctcagtcagggtatcgtgctggacctcggaagatatctttgaaaggaccgagctcatacactgggtcaggcaagcgcccgggcaagggctcgagtggataggctgggtcaagaccgtgagcggggccgtgaactttggctcgcccaatttcaggcacagggtctcgctcacgcgcgatcgcgatctctttaccgcgcacatggacatacgcgggctcacgcaaggggacatggccacgtacttttgcgcgcgccagaaatttgaaaggggcgggcaagggtggtatttcgatctctggggccatggcacgctcatagtcgtgagctcg

SEQ ID NO: 57487 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaaggagccggggacgagcgtgagggtgagctgttggacgagcgaggacatattcgagaggacggagttgatacattgggtgaggcaggcgccggggcaagggttggagtggatagggtgggtgaagacggtgacgggggcggtgaatttcgggagcccgaactttaggcatagggtgagcttgacgagggacagggacttgttcacggcgcatatggatataagggggctgacgcagggggatacggcgacgtatttctgtgcgaggcagaagttcgagaggggggggcaggggtggatatttgacttgtgggggagggggacgttgatagcggtgagtagc

SEQ ID NO: 57488 - RNA, 375 nt, synthetic construct
  misc_feature 1..375: note = derived and/or modified sequence opt11 from anti-HIV-1_HeavyChain
  source 1..375: mol_type = other RNA
caggtgcagttggagcagagcgggagtggggtgaagaagttgggggcgagcgtgagggtgagctgttggacgagcgaggacatattcgggaggacggagttgatacattgggtgaggcaggcgccggggcaggggttggagtggatagggtgggtgaaggcggtgagtggggcggtgaattacgggagcttggactttagacatagggtgagcttgacgagggacagggacttgttcacggcgcatatggatataagggggttgacgcaggacgatacagcgacgtattactgtgcgaggcagaagttcgcgagaggggaccaggggtggttctttgacttgtgggggagggggacgttgatagtggtgagtagc

SEQ ID NO: 57489 - RNA, 372 nt, synthetic construct
  misc_feature 1..372: note = derived and/or modified sequence opt11 from anti-HIV-1_HeavyChain
  source 1..372: mol_type = other RNA
caagcgcacctggaacagagcgggagcggggtcaagaaaccgggcgcgagcgtgcgagtgagctgttggacgagcgatgacatattcaagacagagctcatacactgggtcaggcaagcgcccgggcaagggctcgagtggataggctgggtcaagaccgtaaccggggccgtgaactttggctcgcccaatttcaggcaaagggtctcgctcacgcgcgatcgcgatctctttaccgcgcacatggacatacgcgggctcacgcaagatgacacggccacgtacttttgcgcgcgccagaaatttgccaggggcgatcaagggtggtttttcgatctctggggcaggggcacgctcatagtcgtgagctcg

SEQ ID NO: 57490 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagcggggtgaagaagccgggggcgagcgtgagggtgagctgttggacgagcgaggacatattcgagaggacggagttgatacattgggtgaggcaggcgccggggcaggggttggagtggatagggtgggtgaagacggtgacgggggcggtgaatttcgggagcccgaactttaggcatagggtgagcttgacgagggacagggacttgttcacggcgcatatggatataagggggttgacgcagggggatacggcgacgtattactgtgtgaggcagaagttcgagaggggggggcaggggtggtactttgacttgtgggggagagggacgttgatagtggtgagtagc

SEQ ID NO: 57491 - RNA, 375 nt, synthetic construct
  misc_feature 1..375: note = derived and/or modified sequence opt11 from anti-HIV-1_HeavyChain
  source 1..375: mol_type = other RNA
caggtccagctagtgcaatcgggcgcggaagtgaaaaagcccggggcctcggtcaaggtctcgtgctggacctcggaagatatcttcgaaaagagcgagctcatacactgggtcaggcaagcgcccgggcaagggctcgagtggataggctgggtcaagaccgtgaccggggccgtgaactttggctcgagcgatttcaggcaaagggtctcgctcacgcgcgatcgcgatctctttaccgcgcacatggacatacgagggctcacgcaaggggacacggccacgtactattgcgcgcgccagaaattttacgcgggcgggcaagggtggtatttcgatctatggggcaggggcacgctcatagtcgtgagctcg

SEQ ID NO: 57492 - RNA, 375 nt, synthetic construct
  misc_feature 1..375: note = derived and/or modified sequence opt11 from anti-HIV-1_HeavyChain
  source 1..375: mol_type = other RNA
caggcccatctcgagcaatcgggctcaggagtgaaaaagctcggggcctcggtcagggtctcgtgctggacctcggaagatatctttgaaaggaccgagctcatacactgggtcaggcaagcgcccgggcaagggctcgagtggataggctgggtcaaggccgtgagcggggccgtgaactacggctcgctagatttcaggcacagggtctcgctcacgcgcgatcgagatctctttaccgcgcacatggacatacgcgggctcacgcaaggggacacggccacgtacttttgcgcgcgacagaaattttacaagggcgggcaagggtggtatttcgatctctggggcaggggcacgctcatagtagtgagctcg

SEQ ID NO: 57493 - RNA, 372 nt, synthetic construct
  misc_feature 1..372: note = derived and/or modified sequence opt11 from anti-HIV-1_HeavyChain
  source 1..372: mol_type = other RNA
caagcgcacttggaacagagcgggagcggggtcaagaaaccgggcgcgagcgtgcgcgtgagctgttggacgagcgaggacatattcgagaaatcggaattgatccattgggtgcgccaggccccgggccagggcttggaatggatcgggtgggtgaaaacggtcacgggcgcggtcaatttcgcgcaccagatctcggacagggtctcgctcacgcgcgatcgcgatctctttaccgcgcacatggacatacgcgggctcacgcaaggggacacggccacgtactattgcgcgcgccagaaattttacgcgggcgggcaagggtggtatttcgatctctggggaaggggcacgctcatagtcgtgagctcg

SEQ ID NO: 57494 - RNA, 375 nt, synthetic construct
  misc_feature 1..375: note = derived and/or modified sequence opt11 from anti-HIV-1_HeavyChain
  source 1..375: mol_type = other RNA
caggcgcacttggagcagagcgggagtggggtgaagaagccgggggcgagcgtgagggtgagctgttggacgagcgaggacatattcgggaggacggagttgatacattgggtgagacaggcgccggggcaggggttggagtggatagggtgggtgaagacggtgagtggggcggtgaatttcgggagcccgaactttaggcatagagtgagcttgacgagggacagggacttgttcacagcgcatatggatataagggggttgacgcagggggatacggcgacgtatttctgtgcgaggcagaagttcgagaggggggggcaggggtggtactttgacctgtgggggagggggacgttgatatgtgtgagtagc

SEQ ID NO: 57495 - RNA, 636 nt, synthetic construct
  misc_feature 1..636: note = derived and/or modified sequence opt11 from anti-HIV_5CIN_LightChain
  source 1..636: mol_type = other RNA
gaaatcgtcctcacacaatcccccggcacccaatccctctcccccggcgaaagagccaccctctcctgccgcgcctcccaatccgtcggcaacaacaaactcgcctggtaccaacaacgccccggacaagcaccccgcctactcatctacggcgcctcctcccgcccttccggcgtcgccgaccgattctcaggatccggctcaggcaccgacttcaccctcacaatctcccgcctcgaacccgaagacttcgccgtctactactgccaacaatacggccaatccctctccaccttcggccaaggcaccaaagtcgaagtcaaacgcacagtcgccgccccctctgtattcatcttcccaccctccgacgaacaacttaaatccggaaccgcctcagtcgtctgcctcctcaacaacttctatccccgcgaagccaaagtccaatggaaagtcgacaacgccctccaatccggcaactcccaagaatccgtcaccgaacaagactccaaagactccacatactcactatcctcaaccctcaccctctcaaaagccgactacgaaaaacacaaagtctacgcctgcgaagtcacccaccaaggcctctcctcccccgtaaccaaatcattcaaccga

SEQ ID NO: 57496 - RNA, 672 nt, synthetic construct
  misc_feature 1..672: note = derived and/or modified sequence opt11 from anti-HIV_5CIN_HeavyChain
  source 1..672: mol_type = other RNA
gtccaactcgtacaatcaggcgcagaagtaaaaagaccaggaagctcagtcacagtctcatgcaaagcctccggcggaagcttcagcacatacgccctctcatgggtgcgacaagccccaggcagaggcctggaatggatgggcggcgtcatcccactactcaccatcaccaactacgcccccaggttccagggccgcatcacaatcaccgccgaccgctcaacctcaaccgcatacctagaactaaactcactccgacccgaagacaccgccgtatactactgcgcccgcgaaggcaccaccggcagcggcggcaaacccataggcgcattcgcacactggggccagggaaccctcgtaaccgtgagctccgcctccacaaaaggcccaagcgtcttccccctcgcaccctccagcaaaagcaccagcggcggcaccgcagcactcggatgcctggttaaagactacttccccgaaccagtcaccgtctcatggaacagcggcgccctcacctcaggagtacacacattccccgccgtactccaaagctccggcctatactcactatcaagcgtcgtcaccgtcccaagctcaagcctcggcacacaaacctacatctgcaacgtaaaccacaaaccctccaacacaaaagtagacaaaaaagtcgaaccc

SEQ ID NO: 57497 - RNA, 678 nt, synthetic construct
  misc_feature 1..678: note = derived and/or modified sequence opt11 from anti-HIV_5CIL_HeavyChain
  source 1..678: mol_type = other RNA
gtccaactcgtccaatccggagccgaagtcaaacgccccggctcctcagtcacagtctcctgcaaagcctccggcggctccttctcaacctacgccctctcatgggtccgccaagcccccggccgaggcctagaatggatgggcggcgtcatccccctcctaaccataaccaactacgccccccgcttccaaggccgcatcaccatcaccgccgaccgctccacctccaccgcctacctcgaactcaactccctccgccccgaagacaccgccgtatactactgcgcccgagaaggcaccaccggcgacggcgacctcggaaaacccatcggcgccttcgcccactggggccaaggaaccctcgtcaccgtctcctcagcatcaaccaaaggaccctccgtcttcccactcgccccctcctccaaatcaacctctggcggcaccgccgccctcggctgcctagtcaaagactacttccccgaacccgtcaccgtatcctggaactccggcgcactcacctccggcgtccacaccttccccgccgtcctccaatcctcaggcctctactccctttcctcagtcgtcaccgtcccctcttcctccctcggcacccaaacctacatctgcaacgtcaaccacaaaccctccaacaccaaagtcgacaaaaaagtcgaaccc

SEQ ID NO: 57498 - RNA, 678 nt, synthetic construct
  misc_feature 1..678: note = derived and/or modified sequence opt11 from anti-HIV_5CIP_A-Chain
  source 1..678: mol_type = other RNA
gtccaactcgtacaatccggcgccgaagtcaaacgccccggctcatccgtcaccgtctcctgcaaagcatccggcggctccttctccacctacgccctttcctgggtacgacaagcccccggccgaggcctcgaatggatgggcggagtaatcccactcctaaccatcacaaactacgcccccagattccaaggccgcatcaccatcacagccgaccgctccacctcaaccgcctacctcgaactcaactcactccgccccgaagacaccgccgtctactactgcgcccgcgaaggcaccactggatggggctggctaggcaaacccatcggcgccttcgcccactggggccaaggcaccctcgtcaccgtctcttccgcctcaacaaaaggcccatccgtcttcccactcgccccatcctccaaatccacctccggcggaaccgccgcactcggctgcctcgtcaaagactacttccccgaacccgtcaccgtctcatggaactccggcgccctcacctccggcgtacacaccttcccagccgtcctccaatcctccggtctctactcactctcctccgtcgtcacagtaccctcctcctcactcggcacacaaacctacatctgcaacgtcaaccacaaaccatctaacaccaaagtcgacaaaaaagtcgaaccc

SEQ ID NO: 57499 - RNA, 681 nt, synthetic construct
  misc_feature 1..681: note = derived and/or modified sequence opt11 from anti-HIV_5CIP_HeavyChain
  source 1..681: mol_type = other RNA
gtccaactcgtacaatccggcgccgaagtcaaacgccccggctcatccgtcacggtctcatgcaaagcctccggcggatccttctccacctacgccctctcctgggtccgccaagcccccggccgaggcctagaatggatgggcggcgtcatccccctcctcacaataacaaactacgccccccgcttccaaggccgcatcaccatcacagccgaccgctccacctcgaccgcctacctcgaactaaacagcctccgccccgaagacaccgccgtctactactgcgcccgcgaaggcacaaccggctggggatggctaggcaaacccatcggcgccttcgcccactggggccaaggcaccctcgtcacagtttcatccgcatcaaccaaaggcccatccgtcttcccactagccccctcatccaaatccacctcaggcggcaccgccgcacttggatgcctcgtcaaagactacttccccgaacccgtcaccgtctcctggaactccggagccctaacatccggcgtccacacattcccagccgtactccaaagctcgggcctctactcactctcctcagtcgtcaccgttccctcatcctccctaggcacacaaacctacatctgcaacgtcaaccacaaaccctccaacaccaaagtagacaaaaaagtagaaccaaaa

SEQ ID NO: 57500 - RNA, 630 nt, synthetic construct
  misc_feature 1..630: note = derived and/or modified sequence opt11 from anti-HIV_4JKP_LightChain
  source 1..630: mol_type = other RNA
gaaatcgtactcacccaatcccccgccaccctatccctttccccaggcgaaaccgcaatcatctcctgccgcacctcccaatacggatccctagcctggtaccaacaacgccccggccaagccccccgactcgtcatctactccggctccacccgcgccgccggcatcccagacagattctccggctctcgttggggagccgactacaacctctccatctccaacctcgaatccggcgacttcggcgtctactactgccaacaatacgaattcttcggccaaggcaccaaagtccaagtcgacatcaaacgcaccgtcgcagcaccatcagtcttcatcttccccccctcagacgaacaactcaaatcaggcaccgcctccgtcgtctgcctcctcaacaacttctacccccgagaagccaaagtccaatggaaagtcgacaacgccctccaatccggcaactcccaagaatccgtcaccgaacaagactccaaagactcaacctactccctctcctccaccctcaccctctccaaagccgactacgaaaaacacaaagtctacgcatgcgaagtcactcaccaaggcctctcctcgcccgtcaccaaatcattcaaccgaggcgaatgc

SEQ ID NO: 57501 - RNA, 678 nt, synthetic construct
  misc_feature 1..678: note = derived and/or modified sequence opt11 from anti-HIV_3TNN_E-Chain
  source 1..678: mol_type = other RNA
gaagtccagctagtcgaatccggcggcggactcgtccaacccggcggctccctccgcctttcctgcgccgcctcaggcttcaccttctccacctacgccatgtcatgggtccgccaagcccccggaaaaggcctcgaatgggtatcctcaatcaacaactccggccgcaacactttctccgccgactccgtaaaaggccgcttcaccatctcccgcgacaactccaaaaacaccctcttcctcgtcatgaactcactccgcgccgaagacaccgccgtatactactgcgccaaagacctccgactcggcggcggctccgactactggggccaaggcactctcgtcaccgtctcctccgcctccaccaaaggcccctccgtcttcccactagccccctcctccaaatccacctcaggcggcaccgccgccctcggctgcctcgtcaaagactacttccccgaaccagtcaccgtctcctggaactcaggagccctcacctccggcgtccacacattccctgccgtcctccaatcctccggcctatactcactctcctccgtcgtcaccgtcccatcctcctcactaggcacccaaacatacatatgcaacgtcaaccacaaaccctcaaacaccaaagtcgacaaacgcgtagaacccaaatcctgcgacaaaacacac

SEQ ID NO: 57502 - RNA, 705 nt, synthetic construct
  misc_feature 1..705: note = derived and/or modified sequence opt11 from anti-HIV_3BQU_B-Chain
  source 1..705: mol_type = other RNA
cgaatcaccctcaaagaatccggcccacccctcgtcaaacccacccaaaccctaaccctaacctgctcattctccggcttctcactctccgacttcggcgtcggcgtcggctggatccgccaaccacccggcaaagccctcgaatggctcgctatcatctactcagacgacgacaaacgctactccccctccctcaacacccgtctaaccatcaccaaagacacctccaaaaaccaagtcgtactcgtcatgacccgagtctcccccgtcgacaccgccacctacttctgcgcccaccgccgcggccccaccaccctattcggcgtccccatcgcccgcggacccgtcaacgccatggacgtctggggacaaggcatcaccgtcaccatctcctccacttctaccaaaggcccctccgtcttccccctcgccccctcctcaaaatccaccgccggcggcgccgccgccctaggctgcctcgtcaaagactacttccctgaacccgttaccgtctcctggaactccggcgccctcacctcaggcgtccacacctttcccgccgtcctccaatcctccggcctctactccctctcctccgtcgtcaccgtcccctcatcctccctcggcacccaaacatacacttgcaacgtcaaccacaaaccctccaacaccaaagtcgacaaacgcgtcgaacccaaatcatgc

SEQ ID NO: 57503 - RNA, 642 nt, synthetic construct
  misc_feature 1..642: note = derived and/or modified sequence opt11 from anti-HIV_3BQU_A-Chain
  source 1..642: mol_type = other RNA
gccctacaactcacccaatccccctcatccctatccgcctccgtcggagaccgcataaccatcacctgccgcgcctcccaaggcgtcacctcagccctcgcctggtaccgacaaaaacctggctcaccccctcaacttctcatatacgacgcatcatcactcgaatccggagtcccctctagattctccggctccggctcaggcaccgaattcaccctcaccatctccaccctccgccccgaagacttcgccacctactactgccaacaactccacttctacccccacaccttcggcggcggcacccgcgtcgacgtcagacgcaccgtcgccgccccctccgtcttcatattccccccctcagacgaacaactaaaatccggcacagcctcagtcgtctgcctcctcaacaacttctacccacgcgaagcaaaagtccaatggaaagtcgacaacgccctccaatccggaaactcccaagaaagcgtcaccgaacaagactccaaagactccacctactccctctcctccaccctaaccctctccaaagccgactacgaaaaacacaaagtctacgaatgcgaagtcacccaccaaggcctatcctcacccgtcaccaaatccttcaaccgcggcgaatgc

SEQ ID NO: 57504 - RNA, 387 nt, synthetic construct
  misc_feature 1..387: note = derived and/or modified sequence opt11 from anti-HIV_IgG_VR-Chain
  source 1..387: mol_type = other RNA
atggaaacccccgcccaactcctcttcctcctcctcctatggctccccgacaccaccggcgaaatcgtcctcacccaatcccccggaaccctctccctctccgccggcgaacgcgccaccctctcctgccgcgcctcccaatccgtctcctcccgctacctcgcctggtaccaacaaaaacccggccaagcaccccgcctcctcatctacggcgcctcctcccgcgccaccggcatccccgaccgcttctccggctccggctccggcaccgacttcaccctcaccatctcccgcgtcgaacccgaagacttcgccggctactactgccaacaatacgacaactcagtctgcaccttcggccaaggcaccaaactcgaaatcaaacgc

SEQ ID NO: 57505 - RNA, 348 nt, synthetic construct
  misc_feature 1..348: note = derived and/or modified sequence opt11 from anti-HIV_IgG_HeavyChain
  source 1..348: mol_type = other RNA
atgaaacacctctggttcttcctcctcctcgtcgccgccccccgctgggtcctctcccaagtccaactccaagaatccggccccggcctcgtcaaaccctccgaaaccctctccctcacctgcaccgtctccggcggctccatctcctcccactactggtcctggatccgccaatcccccggcaaaggcctccaatggatcggctacatctactactccggctccaccaactactccccctccctcaaatcccgcgtcaccatctccgtcgaaacctccaaaaaccaattctccctcaaactcacctccatgaccgccgccgacaccgccgtctactactgcgcccgc

SEQ ID NO: 57506 - RNA, 714 nt, synthetic construct
  misc_feature 1..714: note = derived and/or modified sequence opt11 from anti-HIV_4P9M_HeavyChain
  source 1..714: mol_type = other RNA
caaatccacctcgtccaatccggcacagaagtcaaaaaacccggctcctccgtcacagtctcctgcaaagcctacggcgtaaacaccttcggtctctacgccgtcaactgggtccgacaagcccccggccaatccctcgaatacatcggccaaatatggcgctggaaatcatcagcctcccaccacttccgaggccgcgtcctcatctccgccgtcgacctcaccggatcctccccccccatctcctcactcgagataaaaaacctaacctccgacgacaccgcagtctacttctgcaccaccacctccacctacgacaaatggtccggcctacaccatgacggcgtcatggcattctcatcctggggccaaggcacactcatctccgtctccgccgcctcaaccaaaggcccctctgtcttccccctcgcaccctcctccaaatccacctccggcggaaccgccgcactcggctgcctcgtcaaagactacttccccgaacccgtcacagtctcctggaactccggagccctcacctccggcgtccacaccttccccgccgtcttacaatcctccggcctctactccctatcctccgtcgtcaccgtcccctcctcctccttaggcacccaaacctacatatgtaacgtcaaccacaaaccctccaacaccaaagtagacaaacgagtcgaacctaaatcatgcgacaaaacc

SEQ ID NO: 57507 - RNA, 645 nt, synthetic construct
  misc_feature 1..645: note = derived and/or modified sequence opt11 from anti-HIV_4P9M_LightChain
  source 1..645: mol_type = other RNA
gacatacaaatgacccaatccccctcaaccctctccgcctccatcggcgacaccgtccgcatctcctgccgagcctcccaatccatcaccggcaactgggtcgcctggtaccaacaacgccccggcaaagcaccccgactactcatctaccgcggcgccgccctcctcggaggcgtcccctcccgattctctggctccgccgccggcacagacttcaccctcaccatcggcaacctacaagccgaagacttcggcaccttctactgccaacaatacgacacctaccccggcaccttcggccaaggaacaaaagtagaagtcaaacgcaccgtcgccgccccctcagtcttcatcttcccaccctccgacgaacaactaaaatccggcaccgcctccgtcgtctgcctcctaaacaacttctacccccgcgaagccaaagtccaatggaaagtagacaacgccctccaatccggcaactcccaagaatccgtcaccgaacaagactccaaagactccacctactccctctcctccaccctcaccctctcaaaagccgactacgaaaaacacaaagtctacgcctgcgaagtcacccaccaaggcctctcatcccccgtcaccaaatccttcaaccgcggcgaatgc

SEQ ID NO: 57508 - RNA, 558 nt, synthetic construct
  misc_feature 1..558: note = derived and/or modified sequence opt11 from anti-HIV_4P9H_C-Chain
  source 1..558: mol_type = other RNA
aaaaaagtcgtcctaggcaaaaaaggcgacaccgtcgaactcacctgcacggcctcccaaaaaaaatccatccaattccactggaaaaactcaaaccaaatcaaaatcctcggtaaccaaggcagcttcctcaccaaaggcccctcaaaactcaacgaccgcgccgactcccgccgctcactctgggaccaaggcaacttccccctcataataaaaaacctcaccatcgaagactccgacacctacatctgcgaagtcgaagaccaaaaagaagaagtccaacttctagtcttcggcctcactgcaaactccgacacccacctcctacaaggccaatccctcaccctcaccctcgaatccccccccggctcctccccctccgtccaatgccgctccccccgcggaaaaaacatccaaggcggcaaaaccctctccgtctcacaactcgaactccaagactccggcacctggacctgcaccgtcctccaaaaccaaaaaaaagtcgaattcaaaatcgacatcgtcgtcctcgccttccaaaaagccatagacggacgc

SEQ ID NO: 57509 - RNA, 462 nt, synthetic construct
  misc_feature 1..462: note = derived and/or modified sequence opt11 from anti-HIV_4YBL_A-Chain
  source 1..462: mol_type = other RNA
gtccccgtctggaaagacgccgacaccaccctcttctgcgcctccgacgccaaagcccacgaaaccgaatgccacaacgtctgggccacccacgcatgcgtccccaccgaccccaacccacaagaaatccacctcgaaaacgtcaccgaaaacttcaacatgtggaaaaacaacatggtagaacaaatgcaagaagacgtcatctccctctgggaccaatgcctccaacccggcggcgcccccaaaatctccttcgaccccatccccatccactactgcacccccgccggctacgtcatcctcaaatgcaacgacaaaaacttcaacggcaccggaccctgcaaaaacgtctcctccgtccaatgcacacacggcatcaaacccgtcgtctcctccggcggaggcaacatcaaagacaactggcgctccgaactctacaaatacaaagtcgtccaaatcgaa

SEQ ID NO: 57510 - RNA, 1056 nt, synthetic construct
  misc_feature 1..1056: note = derived and/or modified sequence opt11 from anti-HIV_4R4N_V-Chain
  source 1..1056: mol_type = other RNA
atctggaaagacgccaacaccacccttttctgcgcctccgacgccaaagcatacgacacagaagtacacaacgtctgggcaacacacgcctgcgtacccaccgacccatcaccccaagaactcaaaatggaaaacgttacagaagaattcaacatgtggaaaaacaacatggtggaacaaatgcacaccgacatcatcagcctatgggaccaatcactcaaaccctgcgtccaactaaccggcggctccgcactcacccaagcctgcccgaaagtaaccttcgaaccaatccccatccactactgcgcccccgccggctacgccatcctcaaatgcaatgacaaagaattcaacggcacaggactatgcaaaaacgtgtccaccgtccaatgcacccacggcataagacccgtcgtctccacccaactcctcctcaacggctccctagccgaaggcaaagtcatgatccgcagcgaaaacatcaccaacaacgtcaaaaacataatcgtgcaactaaacgaatccgtcacaataaactgcacccgacccaacaacggaggctcgggctcaggaggagacatccgccaagcccactgcaacgtctccggctcccaatggaacaaaaccctgcaccaagtcgtcgaacaactccgcaaatactggaacaacaacaccatcatctttaactcatcctcaggcggcgacctcgaaatcacaacccactccttcaactgcggcggggaattcttctactgcaacacctccgggctcttcaactccacatgggttaacggcaccgcctccattgaaaacggcacaatcaccctaccctgccgcatcaaacaaatcataaacatgtggcaacgcgtaggccaagccatctacgccccccccatccaaggagtaatcagatgcgtctccaacatcacgggcctaatcctcacccgcgacggcggcggaaactcaaacgaaaatgaaaccttcagaccaggcggcggcgacatgcgcgacaactggcgcagcgaactctacaaatacaaagtcgtcaaaatcgaa

SEQ ID NO: 57511 - RNA, 1065 nt, synthetic construct
  misc_feature 1..1065: note = derived and/or modified sequence opt11 from anti-HIV_4JKP_G-Chain
  source 1..1065: mol_type = other RNA
gtctggaaagacgccgacacaacactcttctgcgccagcgacgccaaagcccacgaaacagaatgccacaacgtctgggcgacacacgcctgcgtccccaccgaccccaacccccaagaaatacacctcgaaaacgtaaccgaaaacttcaacatgtggaaaaataacatggtcgaacaaatgcaagaagacgtcatctcactatgggaccaatgtctacaaccctgcgtaaaactcaccggcggcagcgtcatcaaacaagcctgccccaaaatatcattcgaccccatccccatccactactgcacccccgccggctacgtaatcctcaaatgcaacgacaaaaacttcaacggcaccggcccctgcaaaaacgtctcctccgtccaatgcacacacggcatcaaaccagtcgtctccacccaactactactaaacggcagcctcgcagaagaagaaatcatcatccgttccgaaaacctaaccaacaacgccaaaaccatcatcgtacacctcaacaaatcagtggaaatcaactgcacacgcccgtcaaacggcggatccggctccggcggcgacatccgaaaagcctactgcgaaatcaacggaacaaaatggaacaaagtcctaaaacaagtcacagaaaaactcaaagaacacttcaacaacaaaaccatcatcttccaaccccccagcggaggcgacctcgaaatcaccatgcaccacttcaactgccgcggagaattcttctactgcaacaccacccaactattcaacaacacgtgcattggcaacgaaacaatgaaaggctgcaacggcaccatcaccctaccatgcaagatcaaacaaatcataaacatgtggcaaggcaccggccaagccatgtacgcgccccccatcgacggcaaaatcaactgcgtatccaacatcaccggaatcctcctaacccgagacggaggcgccaacaacacctccaacgaaaccttccgcccaggcggcggcaatatcaaggacaactggcgatctgaactctacaaatacaaagtcgtccaaatcgaaggctcc

SEQ ID NO: 57512 - RNA, 723 nt, synthetic construct
  misc_feature 1..723: note = derived and/or modified sequence opt11 from anti-HIV_3BQU_D-Chain
  source 1..723: mol_type = other RNA
atgggctggtcatggatcttcctcttcctcctctccggaaccgctggcgtccactcaggcgtccaactccaacaatccggacccgaactagtaaaacccggcgcctccgtcaaaatgtcctgcaaagcctccggctactccttcaccgactacttcatgcactgggtcaaacaatcacacggcaaatcactcgactggatcggatacatcaactgctacaccggcgccaccaactactcacaaaaattcaaaggaaaagccacattcaccgtcgacacctcctccaacaccgcatacatgcaattcaactctctcacctccgaagactccgcagtctactactgcgcccgcacctccatcggctacggctcctccccccctttcccctactggggccaaggaaccctcgtcaccgtctccgcagccaaaaccacacccccctccgtctaccccctcgcacccggctccgcagcacaaaccaactccatggtaacactcggctgcctcgtcaaaggctacttccccgaacccgtcaccgtcacatggaactcaggcagcctctcctccggcgtccacaccttccccgccgtactccaatccgacctctacaccctatcctcctccgtcaccgtaccctcctcccctcgcccctccgaaaccgtcacctgcaacgtcgcccacccagcatcctccaccaaagtcgacaaaaaaatcgtcccccgc

SEQ ID NO: 57513 - RNA, 699 nt, synthetic construct
  misc_feature 1..699: note = derived and/or modified sequence opt11 from anti-HIV_3BQU_C-Chain
  source 1..699: mol_type = other RNA
atgaccatgttctccctcgcactcctcctctccctccttctcctatgcgtctccgactccggcgcagaaaccacagtcacccaatcccccgcctccctctccatgtcaataggcgaaaaagtcaccatccgctgcataacctccaccgacatcgatgacgacatgaactggtaccaacaaaaacccggcgaacccccacgcctcctaatctccgacggcaacacactacgcccaggcgtcccctcccgcttctcttcctcaggatacggcaccgacttcgtcttcaccatagaaaacatgctctccgaagacgtcgccgactactactgcctccaatcagacaacctcccctacaccttcggaggaggaaccaacctagagataaaacgcgccgacgcagccccaacagtatccatcttcccaccctcatccgaacaactcacctcaggcggcgcctccgtcgtctgcttcctcaacaacttctaccccaaagacatcaacgtcaaatggaaaatcgacggctccgaacggcaaaacggcgtcctaaactcctggaccgaccaagactcaaaagactccacctactccatgtcctccaccctcaccctcaccaaagacgaatacgaacgacacaactcctatacctgcgaagccacccacaaaacctccacatcccccatcgtcaaatccttcaaccga

SEQ ID NO: 57514 - RNA, 333 nt, synthetic construct
  misc_feature 1..333: note = derived and/or modified sequence opt11 from anti-HIV_Ig_LightChain
  source 1..333: mol_type = other RNA
gacgtcgtcctcacccaatcccccgcctccctcgccgtctccctcggccaacgcgccaccatctcctgcaaagcctcccaatccgtcgactacgacggcgactcctacatgaactggtaccaacaaaaacccggccaaccccccaaactcctcatccacgccgcctccaacctcgtatccggcatgcccgcccgattctccggctccggctccggcaccgacttcaccctcaacatccaccccgtcgaagaagaagacgccgccacctactactgccaacaatccatcgaagacccccccaccttcggcggcggcaccaaactcgaaatcaaa

SEQ ID NO: 57515 - RNA, 342 nt, synthetic construct
  misc_feature 1..342: note = derived and/or modified sequence opt11 from anti-HIV_Ig_HeavyChain
  source 1..342: mol_type = other RNA
gacgtccaactccaacaatccggccccggcctcgtcaaaccctcccaatccctctcccacacctgcaccgtcaccggctactccatcacctccgactacgcctggaactggatccgccaattccccggcaacaaactcgaatggatgggctacatctccttctccggctccacctcctacaacccctccctcaaatcccgcatctccatcacccgcgacacctccaaaaacctcttcttcctccaactaaactccgtcaccaccgaagacaccgccacctactactgcgcccgcggcctccccgactactggggccaaggcaccaccctcaccgtctcctcc

SEQ ID NO: 57516 - RNA, 1083 nt, synthetic construct
  misc_feature 1..1083: note = derived and/or modified sequence opt11 from anti-HIV_4P9H_G-Chain
  source 1..1083: mol_type = other RNA
gtctggaaagacgccgacacaaccctattctgcgcctcagacgccaaagctcacgaaaccgaatgccacaacgtctgggccacccacgcctgcgtccccaccgaccccaacccacaggaaatccacctcgaacaagtaaccgaaaacttcaacatgtggaaaaacaacatggtcgaacaaatgcaagaagacgtaatctcactctgggaccaatgcctacaaccctgcgtaaaactcaccggcggctcagtaatcaaacaagcatgccccaaaatctcattcgaccccatcccgatccattactgcacccccgccggctacgtcatcctaaaatgcaacgacaaaaacttcaacggcaccggcccctgcaaaaacgtatcatccgtccaatgcacccacggcataaaaccagtcgtctccacccaactactcctcaacggctccctagccgaagaagaaatcataatccgctccgaaaacctaaccaacaacgccaagaccatcatcgtccacctacaaaaatccgtagaaatcaactgcaccagaccctcaaacggcggttccggcagcgggggagacatccgaaaagcctactgcgaaatacaaggcactaaatggaacaaagtcctcaaacaagtcaccgaaaaactcaaagaacacttcaacaacaaaacaatcatattccaaccaccctccggcggagacctggaaatcacaatgcaccacttcaactgccgcggcgagttcttctactgcaacaccacccaactattccaaaatacctgcataggaaacgaaaccatgaagggctgcaacggcaccatcaccctaccctgcaaaataaaacaaatcataaacatgtggcaaggcaccggccaagccatgtacgcacccccgatcgacggcaaaatcaactgcgtctcccaaatcacaggcatccttctaacccgagacggcggcgccaacaacacctcaaacgaaaccttccgaccaggaggcggcaacataaaagacaactggcgctcagaactctacaaatacaaagtcgtccaaatcgaaggcagccaccaccaccaccaccac

SEQ ID NO: 57517 - RNA, 147 nt, synthetic construct
  misc_feature 1..147: note = derived and/or modified sequence opt11 from anti-HIV_Chain
  source 1..147: mol_type = other RNA
caagtgcaattggtccagagcgggggccagatgaagaaaccgggcgagagcatgcgcataagctgtcgcgcgagcgggtacgagttcatagactgtaccttgaactggatcaggctcgcgcccgggaaaaggcccgagtggatgggc

SEQ ID NO: 57518 - RNA, 180 nt, synthetic construct
  misc_feature 1..180: note = derived and/or modified sequence opt11 from anti-HIV_Chain
  source 1..180: mol_type = other RNA
ccctgctgcttcgcctacatcgcccgccccctcccccgcgcccacatcaaagaatacttctacacctccggcaaatgctccaaccccgccgtcgtcttcgtcacccgcaaaaaccgccaagtctgcgccaaccccgaaaaaaaatgggtccgcgaatacatcaactccctcgaaatgtcc

SEQ ID NO: 57519 - RNA, 249 nt, synthetic construct
  misc_feature 1..249: note = derived and/or modified sequence opt11 from anti-HIV_Chain
  source 1..249: mol_type = other RNA
ctcgaatggatgggccgcatcatccccgccatcgacgacgtcacctacgcccaaaccttccgcggccgcgtcaccttctccgccgacaaattcaccaccaccgcctacatggacctcaccggcctccgctccgaagacaccgccacctacttctgcgcccgcgacccccaagtcaaccgccgcggcaactgcttcgaccactggggccaaggcaccctcgtcaccgtctcctccgcctccaccaaaggc

SEQ ID NO: 57520 - RNA, 270 nt, synthetic construct
  misc_feature 1..270: note = derived and/or modified sequence opt11 from anti-HIV_Chain
  source 1..270: mol_type = other RNA
gacgtcgtcatgacccaatcccccctctccctccccgtcaccctcggccaacccgcctccatctcctgccgctcctcccaatccctcgtctactcccacggcgacacctacctcaaatgcttccaacaacgccccggccaatccccccgccgccccatctacaaagtctccaaccgcgactccggcgtccccgaccgcttctccggctccggctccggcaccgacttcaccctcaaaatctcccgcgtcgaagccgaagacgtcggcgtc

SEQ ID NO: 57521 - RNA, 294 nt, synthetic construct
  misc_feature 1..294: note = derived and/or modified sequence opt11 from anti-HIV_Chain
  source 1..294: mol_type = other RNA
agctcgttcgcgatctcatgggtgcgccaggccccgggccagggcttggaatggatgggcgggataatcccgatctttgaagcgacctcgtacgcgcaaaagttccaggacaggctcacgatcacgaccgatgaatcgaccacgaccgcgtacatggacttgagctcgctcaggagcgaggacacggccgtgtactattgcgcgcgcgcgcaaggggacatactcacggaagggtactttgactattgggggcaagggaccttggtcacggtctcgagcgcgagcacgaaaggg

SEQ ID NO: 57522 - RNA, 297 nt, synthetic construct
  misc_feature 1..297: note = derived and/or modified sequence opt11 from anti-HIV_Chain
  source 1..297: mol_type = other RNA
aacaccttcacctcccactacgtccactgggtccgccaagcccccggccaaggcctcgaatggatgggcatgatcaaccccggcggcaccacccgctacgcccccaaattccaagaccgagtcaccctcacccgcgacacctccacccgcaccgtctacatggaactccgctccctccgctccgaagacaccgccgtctactactgcgcccgcccccaatacaacctcggccgcgaacccctcaacgtatggggccaaggcaccatggtcaccgtctcctccgcctccaccaaaggc

SEQ ID NO: 57523 - RNA, 297 nt, synthetic construct
  misc_feature 1..297: note = derived and/or modified sequence opt11 from anti-HIV_Chain
  source 1..297: mol_type = other RNA
atccgctccttctactggcactggatccgccaatcacccggcaaaggcctcgaatggctcggctccgtcttcgacaacggcctcaccacccacaacccctccctcaaatcccgcctcaccatctccgaagacccctcacgcaaccaaatctccctcaaactccgctccatgaccgccgccgacaccgccgtctactactgcgcccgcggcgactacgacatcctcacctcatcctaccaattcgactactggggccaaggcaccctcgtcgccgtctcctccgcctccaccaaaggc

SEQ ID NO: 57524 - RNA, 300 nt, synthetic construct
  misc_feature 1..300: note = derived and/or modified sequence opt11 from anti-HIV_Chain
  source 1..300: mol_type = other RNA
caatccgccctcacccaacccgccttcgtctccggctcccccggccaatccatcaccctctcctgcaccctcggcaccgaagacgtctcctggtaccaacaacgccccaactccgccccccgcctcatcatcttcgacgtcaaaaaacgcccctccgacgtctccgaccgcttctccggccacaactccgacaccgccgccttcctcaccatctccgaactccgccccgaagacgaagccgactacttctgcacctcctggccctaccgcttcgaccgcggcaccaaagtcgacgtcgcc

SEQ ID NO: 57525 - RNA, 300 nt, synthetic construct
  misc_feature 1..300: note = derived and/or modified sequence opt11 from anti-HIV_Chain
  source 1..300: mol_type = other RNA
caatccgccctcacccaacccgccttcgtctccggctcccccggccaatccatcaccctctcctgcaccctcggcaccgaagacgtctcctggtaccaacaacgccccaactccgccccccgcctcatcatcttcgacgtcaaaaaacgcccctccgacgtctccgaccgcttctccggccacaactccgacaccgccgccttcctcaccatctccgaactccgccccgaagacgaagccgaatacttctgcacctcctggccctaccgcttcggccgcggcaccaaagtcgacgtcgcc

SEQ ID NO: 57526 - RNA, 300 nt, synthetic construct
  misc_feature 1..300: note = derived and/or modified sequence opt11 from anti-HIV_Chain
  source 1..300: mol_type = other RNA
caatccgccctcacccaccccgccttcgtctccggctcccccggccaatccatcaccctctcctgcaccctcggcaccgaagacgtctcctggtaccaacaacgccccaactccgccccccgcctcatcatcttcgacgtccgcaaacgcccctccgaagtctccgaccgcttctccggccacaaatccgacaccgccgccttcctcaccatctccgacctccgccccgaagacgaagccgaatacttctgcacctcctggccctaccgcttcgaccgcggcacccgcctcgacgtcgcc

SEQ ID NO: 57527 - RNA, 300 nt, synthetic construct
  misc_feature 1..300: note = derived and/or modified sequence opt11 from anti-HIV_Chain
  source 1..300: mol_type = other RNA
caatccgtcctcacccaacccgccttcgtctccggctcccccggccaatccatcaccatctcctgcaccgtcggcaccaccgacgtctcctggtaccaacaacgccccaactccgccccccgcctcatcatcttcgacgtcaaaaaacgaccctccggcgtctccgaccgcttctccggctcctcatccgacaacgccgccttcctcaccatcgccggcctccgccccgaagacgaagccgaatactactgcacctcatggccctaccgcttcggccgcggcaccaaagtcgacgtcggc

SEQ ID NO: 57528 - RNA, 300 nt, synthetic construct
  misc_feature 1..300: note = derived and/or modified sequence opt11 from anti-HIV_Chain
  source 1..300: mol_type = other RNA
caatccgtcctcacccaacccgccttcgtctccgcctcccccggccaatccatcaccctctcctgcaacctcggcaccgactacgtctcctggtaccaacaacgaccctcctccgccccccgcctcatcatcttcgacgtcaaaaaccgcccctccggcgtctccgaccgcttctccggctacaactccgacaccgccgccttcctcaccatctccggcctccaacccgaagacgaagccgaatactactgcacctcctggccctacaacttcggccccggcaccaaagtcgacgtcacc

SEQ ID NO: 57529 - RNA, 300 nt, synthetic construct
  misc_feature 1..300: note = derived and/or modified sequence opt11 from anti-HIV_Chain
  source 1..300: mol_type = other RNA
caatccgtcctcacccaacccgcctccgtctccggctcccccggccaatccatcaacatctcctgcgccggccgctccgaccgcgtctcctggtaccaacaacgccccaacggcgtccccaaactcctcctcttcgacgtctaccgccgcccctccggagtctccgaccgcttctccggctcccactccgacgacaccgccttcctcaccatctccggcctccaaaccgacgacgaagccgactactactgcacctcccacccctacgccttcggccccggcaccaaagtcaacgtcctc

SEQ ID NO: 57530 - RNA, 300 nt, synthetic construct
  misc_feature 1..300: note = derived and/or modified sequence opt11 from anti-HIV_Chain
  source 1..300: mol_type = other RNA
caatccgtcctcacccaacccgccttcgtctccggctcccccggccaatccatcaccctctcctgcaccctcggcaccgaagacgtctcctggtaccaacaacgccccaactccgccccccgcctcatcatcttcgacgtcaaaaaacgcccctccgacgtctccgaccgcttctccggccacaactccgacaccgccgccttcctcaccatctccgaactccgccccgaagacgaagccgaatacttctgcacctcctggccctaccgcttcggccgcggcaccaaagtcgacgtcgcc

SEQ ID NO: 57531 - RNA, 306 nt, synthetic construct
  misc_feature 1..306: note = derived and/or modified sequence opt11 from anti-HIV_Chain
  source 1..306: mol_type = other RNA
caatccgccctcacccaacccgcctccgtctccggctcccccggccaatccatcaccatctcctgcaccgccgactccgactacgtctcctggtaccaacaacgccccaactccgcccccaaactcatcctcttcgacgtcaactcccgcccctccggcgtctccgaccgctactccggctcccgctccggcaacaccgcctccctcaccatctccggcctccaacgcgaagacgaagccgactacttctgcaccccctggccctacgacttccgccccggcacccgcgtcttcgtcctcggccaa

SEQ ID NO: 57532 - RNA, 306 nt, synthetic construct
  misc_feature 1..306: note = derived and/or modified sequence opt11 from anti-HIV_Chain
  source 1..306: mol_type = other RNA
caatccgccctcacccaacccgccttcgtctccggctcccccggccaatccatcaccctctcctgctccctcggcaccgccgacgtctcctggtaccaacaacgccccaactccgccccccgcctcatcatcttcgacgtcaaaaaacgcccctccgacgtctccgaccgcttctccggccacaactccgacaccgccgccttcgtcaccatctccgaactccgccccgaagacgaagccgaatacttctgcacctcctggccctaccgcttcggccccggcaccaaagtcgacgtcgcccgccaa

SEQ ID NO: 57533 - RNA, 306 nt, synthetic construct
  misc_feature 1..306: note = derived and/or modified sequence opt11 from anti-HIV_Chain
  source 1..306: mol_type = other RNA
caatccgtcctcacccaacccgcctccgtctccggctcccccggccaaaccatctccatctcctgctccggcaccttcggctccgactccgtctcctggtaccaacaattccccaactccgcccccaccctcatcatcttcgacgtccaccgccgcccctccggcatctccacccgcttctccggctccacctccggcgacaccgcctccctcaccatctccaccctccaccgcgaagacgaagccttctactactgcacctcccacccctacgacttcggcggcggcacctacgtcatcgtcctc

SEQ ID NO: 57534 - RNA, 306 nt, synthetic construct
  misc_feature 1..306: note = derived and/or modified sequence opt11 from anti-HIV_Chain
  source 1..306: mol_type = other RNA
caatccgtcctcacccaacccgcctccgtctccggctcccccggccaaaccatctccatctcctgctccggcaccttcggctcagactccgtctcctggtaccaacaataccccaactccgcccccaccctcatcatcttcgacgtccaccgccgcccctccggcatctccacccgcttctccggctccacctccggcgacaccgcctccctcaccatctccaccctccaccgcgaagacgaagcctactactactgcacctcccacccctacgacttcggcggcggcacctacgtcatcgtcctc

SEQ ID NO: 57535 - RNA, 306 nt, synthetic construct
  misc_feature 1..306: note = derived and/or modified sequence opt11 from anti-HIV_Chain
  source 1..306: mol_type = other RNA
caatccgccctcacccaacccgcctccgtctccggctcccccggccaatccatcaacatctcctgcgccggccgctccgaccgcgtctcctggtaccaacaacgccccaacggcgtccccaaactcctcatgttcgacgtctaccgccgcccctccggcgtctccgaccgattctccggctcccactccggcgacaccgccttcctcaccatctccggcctccaaaccgaagacgaagccgactactactgcacctcccacccctacgccttcggcgccggcaccaaagtcaacgtcctccgccaa

SEQ ID NO: 57536 - RNA, 306 nt, synthetic construct
  misc_feature 1..306: note = derived and/or modified sequence opt11 from anti-HIV_Chain
  source 1..306: mol_type = other RNA
gacatccaaatgacccaatccccctcctccctctccgcctccgtcggcgaccgcgtctccatccactgccaagccggccaaggcatcggctcctccctcaactggtaccaacaaaaacccggccgcgccccccgcctcctcgtccacggcgcctccaacctccaacgcggcgtcccctcccgcttctccggctccggcttccacaccaccttcaccctcaccatctcctccctccaacccgacgacgtcgccacctactggtgcgccgccctcgaattcttcggccccggcaccaaagtcgaaatc

SEQ ID NO: 57537 - RNA, 309 nt, synthetic construct
  misc_feature 1..309: note = derived and/or modified sequence opt11 from anti-HIV_Chain
  source 1..309: mol_type = other RNA
gacatccaaatgacccaatccccctcctccctctccgcctccgtcggcgacaccgtcaccatcacctgccaagccaacggctacctcaactggtaccaacaacgccgcggcaaagcccccaaactcctcatctacgacggctccaaactcgaacgcggcgtcccctcacgcttctccggccgccgctggggacaagaatacaacctcaccatcaacaacctccaaccagaagacatcgccacctacttctgccaagtctacgaattcgtcgtccccggcacccgactcgacctcaaacgcaccgtcgcc

SEQ ID NO: 57538 - RNA, 309 nt, synthetic construct
  misc_feature 1..309: note = derived and/or modified sequence opt11 from anti-HIV_Chain
  source 1..309: mol_type = other RNA
gacatccaaatgacccaatccccctcctccctctccgcccgcgtcggcgacaccgtcaccatcacctgccaagccaacggctacctcaactggtaccaacaacgccgcggcaaagcccccaaactactcatctacgacggctccaaactcgaacgcggcgtccccgcccgcttctccggccgccgctggggccaagaatacaacctcaccatcaacaacctccaacccgaagacgtcgccacctacttctgccaagtctacgaattcatcgtccccggcacccgcctcgacctcaaacgcaccgtcgcc

SEQ ID NO: 57539 - RNA, 309 nt, synthetic construct
  misc_feature 1..309: note = derived and/or modified sequence opt11 from anti-HIV_Chain
  source 1..309: mol_type = other RNA
gacatccaaatgacccaatccccctcctcactctccgcccgcgtcggcgacaccgtcaccatcacctgccaagccaacggctacctcaactggtaccaacaacgccgcggcaaagcccccaaactcctcatctacgacggctccaaactcgaacgcggcgtcccctcccgcttctccggccgccgctggggccaagaatacaacctcaccatcaacaacctccaacccgaagacatcgccacctacttctgccaagtctacgaattcgccgtccccggcacccgcctcgacctcaaacgcaccgtcgcc

SEQ ID NO: 57540 - RNA, 309 nt, synthetic construct
  misc_feature 1..309: note = derived and/or modified sequence opt11 from anti-HIV_Chain
  source 1..309: mol_type = other RNA
gacatccaaatgacccaatccccctcctccctctccgcctccgtcggcgacaccgtcaccatcacctgccaagccaacggctacctcaactggtaccaacaacgccgcggcaaagcccccaaactcctcatctacgacggctccaaactcgaacgcggcgtcccctcccgattctccggccgccgctggggccaagaatacaacctcaccatcaacaacctccaagccgaagacatcgccacctacttctgccaagtctacgaattcgccgtccccggcacccgcctcgacctcaaacgcaccgtcgcc

SEQ ID NO: 57541 - RNA, 309 nt, synthetic construct
  misc_feature 1..309: note = derived and/or modified sequence opt11 from anti-HIV_Chain
  source 1..309: mol_type = other RNA
gacatccaaatgacccaatccccctcctcactctccgcctccgtcggcgacaccgtcaccatcacctgccaagccaacggctacctcaactggtaccaacaacgccgcggcaaagcccccaaactcctcatctacgacggctccaaactcgaacgcggcgtcccctcccgcttctccggccgccgctggggccaagaatacaacctcaccatcaacaacctccaacccgaagacatcgccacctacttctgccaagtctacgaattcatcgtccccggcacccgcctcgacctcaaacgcaccgtcgcc

SEQ ID NO: 57542 - RNA, 309 nt, synthetic construct
  misc_feature 1..309: note = derived and/or modified sequence opt11 from anti-HIV_Chain
  source 1..309: mol_type = other RNA
gacatccaaatgacccaatccccctcctccctctccgcccgcgtcggcgacaccgtcaccatcacctgccaagccaacggctacctcaactggtaccaacaacgccgcggcaaagcccccaaactcctcatctacgacggctccaaactcgaaaccggcgtcccctcccgcttcaccggccgccgctggggccaagaatacaacctcaccatcaacaacctccaacccgaagacatcgccacctacttctgccaagtctacgaattcatcgtccccggcacacgcctcgacctcaaacgcaccgtcgcc

SEQ ID NO: 57543 - RNA, 312 nt, synthetic construct
  misc_feature 1..312: note = derived and/or modified sequence opt11 from anti-HIV_Chain
  source 1..312: mol_type = other RNA
gacatccaaatgacccaatccccctcctccctctccgcctccgtcggcgacaaagtcaccatcacctgccaaacctccgccggctacctcaactggtaccaacaacgccgcggccgcgcccccaaactcctcatgtacgacggctcccgcctcgtcaccggcgtcccctcccgcttctccggccgccgctggggcacccaatacaacctaaccatcggctccctccaacccgaagacgtcgccacctactactgccaagtctacgaattcttcggccccggcacccgcctcgacctcaaacgcaccgtcgcc

SEQ ID NO: 57544 - RNA, 312 nt, synthetic construct
  misc_feature 1..312: note = derived and/or modified sequence opt11 from anti-HIV_Chain
  source 1..312: mol_type = other RNA
gacatccaaatgacccaatccccctcctccctctccgcctccgtcggcgacaaagtcaccatcacctgccaaacctccgccggctacctcaactggtaccaacaacgccgcggccgcgcccccaaactcctcatgtacgacggctcccgcctcgtcaccggcgtcccctcacgcttctccggccgccgctggggcacccaatacaacctcacaatcggctccctccaacccgaagacatcgccacctactactgccaagtctacgaattcttcggccccggcacccgcctcgacctcaaatccaccgtcgcc

SEQ ID NO: 57545 - RNA, 312 nt, synthetic construct
  misc_feature 1..312: note = derived and/or modified sequence opt11 from anti-HIV_Chain
  source 1..312: mol_type = other RNA
gacatccaaatgacccaatccccctcctccctctccgcccgcgtcggcgacaccgtcaccatcacctgccaagccaacggctacctcaactggtaccaacaacgccgcggcaaagcccccaaactcctcatctacgacggctccaaactcgaacgcggcgtccccgcccgcttctccggccgccgctggggccaagaatacaacctcaccatcaacaacctccaacccgaagacgtcgccacctacttctgccaagtctacgaattcatcgtccccggcacccgcctcgacctcaaacgcaccgtcgccgcc

SEQ ID NO: 57546 - RNA, 312 nt, synthetic construct
  misc_feature 1..312: note = derived and/or modified sequence opt11 from anti-HIV_Chain
  source 1..312: mol_type = other RNA
tgcacggtctcgggcgggagcataatctcgtactattggaattggatacgccagagcccgggcaagggcttggaatggctcgggtacatattcgatggcgggcgcgcgaactataacccgagcttgcgctcgcgcttgaccatgagcgtggacacgagcaagaaccagatctcgctcaaggtcaagagcgtgaccgcggccgatagcgcgatctattactgtgccaggctcgatggcgaggcctttcgctattactttgactcgtgggggcaagggaccttggtcacggtctcgagcgcgagcacgaaaggg

SEQ ID NO: 57547 - RNA, 312 nt, synthetic construct
  misc_feature 1..312: note = derived and/or modified sequence opt11 from anti-HIV_Chain
  source 1..312: mol_type = other RNA
gtctcgggcgggcgctttagcaattacgggctctcgtgggtgcgccaggccccgggccagggcctggaatggatggggcgcatagtcccggccataaacagggccaagtacgcgcaaaagttccagggcagggtcatactcacggccgataaaataaccgataccgcgtacatggaattgcgatcgctcaggagcgaggacacggccatattctattgcgcgcgcgatccccagatcgagatcaggggcaatgcctttgacatatgggggcaagggaccgtggtcacggtctcgagcgcgagcacgaaaggg

SEQ ID NO: 57548 - RNA, 315 nt, synthetic construct
  misc_feature 1..315: note = derived and/or modified sequence opt11 from anti-HIV_Chain
  source 1..315: mol_type = other RNA
tccgacatctccgtcgcccccggcgaaaccgcccgcatctcctgcggcgaaaaatccctcggctcccgcgccgtccaatggtaccaacaccgagccggccaagccccctccctcatcatctacaacaaccaagaccgcccctccggcatccccgaacgcttctccggctcccccgactcccccttcggcaccaccgccaccctcaccatcacctccgtcgaagccggcgacgaagccgactactactgccacatctgggactcccgcgtccccaccaaatgggtcttcggcggcggcaccaccctcaccgtcctc

SEQ ID NO: 57549 - RNA, 315 nt, synthetic construct
  misc_feature 1..315: note = derived and/or modified sequence opt11 from anti-HIV_Chain
  source 1..315: mol_type = other RNA
tcctccatgtccgtctcccccggcgaaaccgccaaaatctcctgcggcaaagaatccatcggctcccgcgccgtccaatggtaccaacaaaaatccggccaacccccctccctcatcatctacaacaaccaagaccgcccctccggcgtccccgaacgcttctccgccacccccgacttcggcgccggcaccaccgccaccctcaccatcaccaacgtcgaagccgacgacgaagccgactactactgccacatctacgacgcccgcggcggcaccaactgggtcttcgaccgcggcgccaccctcaccgtactc

SEQ ID NO: 57550 - RNA, 315 nt, synthetic construct
  misc_feature 1..315: note = derived and/or modified sequence opt11 from anti-HIV_Chain
  source 1..315: mol_type = other RNA
tcgttcgtgagcgtggccccgggccagaccgcgcgcataacctgtggcgaggaatcgctcgggagcaggagcgtgatctggtaccagcaaaggcccgggcaagcgccctcgctcataatctataacaataacgatcgcccgagcgggatcccggaaaggttctcgggctcgcccgggagcacgttcgggaccacggccacgctcacgatcacgagcgtggaagcgggcgatgaagcggactattactgtcacatatgggatagcaggcgcccaaccaattgggtgttcggggaagggaccacgctcacggtcttg

SEQ ID NO: 57551 - RNA, 315 nt, synthetic construct
  misc_feature 1..315: note = derived and/or modified sequence opt11 from anti-HIV_Chain
  source 1..315: mol_type = other RNA
tccttcgtctccgtcgcccccggccaaaccgcccgcatcacctgcggcgaagaatccctcggctcccgctccgtcatctggtaccaacaacgccccggccaagccccctccctcatcatgtacaacaaccacgaccgcccctccggcatccccgaacgcttctccggctcccccggctccaccttcggcaccaccgccaccctcaccatcacctccgtcgaagccggcgacgaagccgactactactgccacatctgggactcccgccgccccaccaactgggtcttcggcgaaggcaccaccctaaccgtcctc

SEQ ID NO: 57552 - RNA, 315 nt, synthetic construct
  misc_feature 1..315: note = derived and/or modified sequence opt11 from anti-HIV_Chain
  source 1..315: mol_type = other RNA
gacatccaaatgacccaatccccctcctccctctccgcctccgtcggcgacaaagtcaccatcacctgccaaacctccgccggctacctcaactggtaccaacaacgccgcggccgcgcccccaaactcctcatgtacgacggctcccgcctcgtcaccggcgtcccctcccgcttctccggccgccgctggggcacccaatacaacctcaccatcggctccctccaacccgaagacatcgccacctactactgccaagtctacgaattcttcggccccggcacccgcctcgacctcaaatccaccgtcgccgcc

SEQ ID NO: 57553 - RNA, 315 nt, synthetic construct
  misc_feature 1..315: note = derived and/or modified sequence opt11 from anti-HIV_Chain
  source 1..315: mol_type = other RNA
gacatccaaatgacccaatccccctcatccctctccgcctccgtcggcgaccgcgtctccatcaactgccaagccggccaaggcctcggctcctccctcaactggtaccaacaaaaacccggccgcgcccccaaactcctcgtccacggcgcctccaacctccaacgcggcgtcccctcccgcttctccggatccggcttccacaccaccttcaccctcaccatctcctccctccaacccgacgacgtcgccacctacttctgcgccgccttccaatggttcggccccggcaccaaagtcgaaatcaaacgcacc

SEQ ID NO: 57554 - RNA, 318 nt, synthetic construct
  misc_feature 1..318: note = derived and/or modified sequence opt11 from anti-HIV_Chain
  source 1..318: mol_type = other RNA
tgcaccgtctccggcggctccatctcctccgccggctactactggacctggatccgccaacaccccggcaaaggcctcgaattcatcggctacatctactacatcggcaccacctactacaacccctccctcaaatcccgcctcaccatctccatcgacacctccaaaaaccaattctccctcaaactctcctccgtcaccgccgccgacaccgccatctactactgcgcccgcgactacaccgcccgcggccgccacttcttcgactactggggccaaggcgccctcgtcaccgtctcctccgcctccaccaaaggc

SEQ ID NO: 57555 - RNA, 321 nt, synthetic construct
  misc_feature 1..321: note = derived and/or modified sequence opt11 from anti-HIV_Chain
  source 1..321: mol_type = other RNA
tcgagcctgcccttgagcctggccccgggcgcgaccgcgaaaataccctgtggcgagaaatcgcgcgggagcagggccgtgcaatggtaccagcaaaagcccgggcaagcgcccacgctcataatctataacaaccaagatcgcccggccggggtctcggaaaggtactcgggcaatcccgatgtcgcgatcggagtcacggccacgctcacgatctcgcgcgtggaagcgggcgatgaagcggaatattactgtcactattgggatagcaggagcccgatctcgtgggtattcgggggctggacccagctcacggtcttg

SEQ ID NO: 57556 - RNA, 321 nt, synthetic construct
  misc_feature 1..321: note = derived and/or modified sequence opt11 from anti-HIV_Chain
  source 1..321: mol_type = other RNA
tcctccctccccctctccgtcgcccccggcgccaccgccaaaatagcctgcggcgaaaaatccttcgcctcccgcgccgtccaatggtaccaacaaaaacccggccaagcccccgtcctcatcatctacaacaaccaagaccgccccgccggcgtctccgaacgcttctccggcacccccgacgtcggcttcggctccaccgccaccctcaccatctcccgcgtcgaagccggcgacgaagccgactactactgccacaaatgggactcccgctcccccctctcctgggtcttcggcggcggcacccaactcaccgtcctc

SEQ ID NO: 57557 - RNA, 321 nt, synthetic construct
  misc_feature 1..321: note = derived and/or modified sequence opt11 from anti-HIV_Chain
  source 1..321: mol_type = other RNA
gacatccaaatgacccaatcaccctcatccctctccgcctccatcggcgaccgcgtcaccatcacctgccgcgcctcccaagacatcgccaactacctcaactggtaccaaaaaaaatccggcaccccccccaaactcctcatcttcgccgccaccaacctccaccgcggcgtctccccccgcttcaccggctccggccacggcacccacttctccctcaccatcaccaacgtccaacacgaagacttcggcaactacttctgccaacaatccttcgccaccgtcggctccttcggccaaggcacctgggtcgacatccgc

SEQ ID NO: 57558 - RNA, 321 nt, synthetic construct
  misc_feature 1..321: note = derived and/or modified sequence opt11 from anti-HIV_Chain
  source 1..321: mol_type = other RNA
gacatccaaatgacccaatccccctcctccctctccgcctccatcggcgaccgcgtcaccatcacctgccgcgcctcccaagacatcgccaactacctcaactggtaccaaaaaaaatccggcaccccccccaaactcctcatcttcgccgccaccaacctccaccgcggcgtctccccccgcttcaccggctccggccacggcacccacttctccctcaccatcaccaacgtccaacacgaagacttcggccactacttctgccaacaatccttcgccaccgtcggctccttcggccaaggcacctgggtcgacatccgc

SEQ ID NO: 57559 - RNA, 321 nt, synthetic construct
  misc_feature 1..321: note = derived and/or modified sequence opt11 from anti-HIV_Chain
  source 1..321: mol_type = other RNA
gacatccaaatgacccaatccccctcctccctctccgcctccgtcggcgaccgcgtcaccatcacctgccgcgcctcccaagacatcgccaactacctcaactggtaccaaaaaaaatccggcaccccccccaaactcctcatcttcgccgccaccaacctccaccgcggcgtctccccccgcttctccggctccggctccggcacccacttctccctcaccatcaccaacgtccaatacgaagacttcgccaactacttctgccaacactccttcggcaccatcggcaccttcggccaaggcacctgggtcgacatccgc

SEQ ID NO: 57560 - RNA, 321 nt, synthetic construct
  misc_feature 1..321: note = derived and/or modified sequence opt11 from anti-HIV_Chain
  source 1..321: mol_type = other RNA
gacatccaaatgacccaatccccctcctccctctccgcctccatcggcgaccgcgtcaccatcacctgccgcgcctcccaagacatcgccaactacctcaactggtaccaaaaaaaatccggcaccccccccaaactcctcatcttcggcgcaaccaacctccaccacggcgtctccccccgcttctccggctccggccacggcacccacttctccctcaccatcaccaacgtccaacacgaagacttcgccaactacttctgccaacaatccttccaaaccgtcggctccttcggccaaggcacctgggtcgacatccgc

SEQ ID NO: 57561 - RNA, 321 nt, synthetic construct
  misc_feature 1..321: note = derived and/or modified sequence opt11 from anti-HIV_Chain
  source 1..321: mol_type = other RNA
gagatcgtgctaacgcaatcgcccgcgaccttgagcttgagcccgggcgagaccgcgatcataagctgtcgcacgagccagagcgggagcttggcctggtaccagcaaaggcccgggcaagcgcccaggctcgtgatctatagcgggagcacgcgcgcggccgggatcccggacaggttctcgggctcgcgctggggcgcggactataacttgagcataagcaatctcgagagcggggactttggcgtgtactattgccagcaatatgaatttttcgggcaagggaccaaggtccaggtcgatatcaagcgcacggtcgcg

SEQ ID NO: 57562 - RNA, 321 nt, synthetic construct
  misc_feature 1..321: note = derived and/or modified sequence opt11 from anti-HIV_Chain
  source 1..321: mol_type = other RNA
gacatccaaatgacccaatccccctcctcactctccgcctccatcggcgaccgcgtcaacatcacctgccaagcctcccgcgacaccggctccgccctcaactggtaccaacaaaaagtcggccgccccccccgcctcctcatctccgccgtctccaacctcggcgccggcgtcccctcccgcttctccggccgccgctccggcacccaatccaccctcaccatcaacaccctccaacccgaagacatcgccacctacttctgccaacactacgaattcttcggccccggcaccaaagtcgacatcaaacgcaccgtcgcc

SEQ ID NO: 57563 - RNA, 321 nt, synthetic construct
  misc_feature 1..321: note = derived and/or modified sequence opt11 from anti-HIV_Chain
  source 1..321: mol_type = other RNA
gacatccaaatgacccaatccccctcctccctctccgcctccgtcggcgaccgcgtcaccatcacctgccaagccggccaaggcatcggctcctccctccaatggtaccaacaaaaacccggcaaagcccccaaactcctcgtccacggcgcctccaacctccaccgcggcgtcccctcccgattctccggctccggcttccacaccaccttctccctcaccatctccggcctccaacgcgacgacttcgcaacctacttctgcgccgtcctcgaattcttcggccccggcaccaaagtcgaaatcaaacgcaccgtcgcc

SEQ ID NO: 57564 - RNA, 324 nt, synthetic construct
  misc_feature 1..324: note = derived and/or modified sequence opt11 from anti-HIV_Chain
  source 1..324: mol_type = other RNA
tcctacgtccgccccctctccgtcgccctcggcgaaaccgcctccatctcctgcggccgccaagccctcggctcacgcgccgtccaatggtaccaacaccgccccggccaagcccccatcctcctcatctacaacaaccaagaccgcccctccggcatccccgaacgcttctccggcacccccgacatcaacttcggcacccgcgccaccctcaccatctccggcgtcgaagccggcgacgaagccgactactactgccacatgtgggactcccgctccggcttctcctggtccttcggcggcgccacccgcctcaccgtcctc

SEQ ID NO: 57565 - RNA, 324 nt, synthetic construct
  misc_feature 1..324: note = derived and/or modified sequence opt11 from anti-HIV_LightChain
  source 1..324: mol_type = other RNA
gacatcctcatgacccaatccccctccctcctctccgcctccgtcggcgaccgcgtcaccatcacctgcaaagcctcccaagacgtctccaccgccgtcgcctggtaccaacaaaaacccggcaaagcccccaaactcctcatctactgggcctccacccgccacaccggcgtcccctcccgcttcaccggctccggctccggcaccgacttcaccctcaccatctcccgcctccaagccgaagacttcgccctctactactgccaacaacactacaccaccccctggaccttcggcggcggcaccaaagtcgaaatcaaacgc

SEQ ID NO: 57566 - RNA, 324 nt, synthetic construct
  misc_feature 1..324: note = derived and/or modified sequence opt11 from anti-HIV_LightChain
  source 1..324: mol_type = other RNA
gacatcgtcatgacccaatccccctccctcctctccgcctccgtcggcgaccgcgtcaccatcacctgcaaagcctcccaagacgtctccaccgccgtcgcctggtaccaacaaaaacccggcaaagcccccaaactcctcatctactgggcctccacccgccacaccggcgtcccctcccgattctcaggctccggctccggcaccgacttcaccctcaccatctcctccctccaacccgaagacttcgccctctactactgccaacaacactacaccaccccctggaccttcggcggcggcaccaaagtcgaaatcaaacgc

SEQ ID NO: 57567 - RNA, 324 nt, synthetic construct
  misc_feature 1..324: note = derived and/or modified sequence opt11 from anti-HIV_Chain
  source 1..324: mol_type = other RNA
gacatccaaatgacccaatcaccctcctccctctccgcctccgtcggcgacaccgtcaccatcaactgccaaaccaacaaaggctacctcaactggtaccaacaacgccgcggccgcgcccccaaactcctcatgtacgacggctccaaactcgtcaccggcgtcccctcccgcttctccggccgccgctggggcacccaatacaacctcaccatcggctccctccaacccgaagacatcgccacctactactgccaagtctacgaattcttcggccccggcacccgcctcgacctaaaacgaaccgtcgcagccccctccgac

SEQ ID NO: 57568 - RNA, 333 nt, synthetic construct
  misc_feature 1..333: note = derived and/or modified sequence opt11 from anti-HIV_Chain
  source 1..333: mol_type = other RNA
ctctccgcctacgtcggcgaccgcgtcaccataacctgccgcgcctcccaaaacatcaacacctacctcaactggtaccaacaacgccccggcaaagcccccaaactcctcatctacgccgcctccaccctccaatccggcgtcccctcccgcttctccggctccggctccggcaccgacttcaccctcaccatctccaacctcgaaaccgaagacttcgccgtctactactgccaacaaacctactcctccgtcaccttcggccaaggcaccaaactagaaacccgccgcaccgtagccgccccctccgtcttcatcttccccccctccgac

SEQ ID NO: 57569 - RNA, 333 nt, synthetic construct
  misc_feature 1..333: note = derived and/or modified sequence opt11 from anti-HIV_Chain
  source 1..333: mol_type = other RNA
gaaatcgtcctcacccaatcccccgccaccctctccctctcacccggcgaacgcgccaccctctcctgccgcgcctcccaaggcgtcaacttcgtcgtctggtaccaacaaaaacgcggccaagccccccgcctcctcatctacggcaactcagaccgcgtccccggcgtccccgaccgcttctccgcccgcggctccggcaccgaattctccctcgtcatctcctccgtcgaacccgacgacttcgccctctactactgccaagaatactcctccaccccctacaacttcggccccggcacccgcgtcgaccgcaaacgcaccgtcgccgcc

SEQ ID NO: 57570 - RNA, 336 nt, synthetic construct
  misc_feature 1..336: note = derived and/or modified sequence opt11 from anti-HIV_HeavyChain
  source 1..336: mol_type = other RNA
gaagtcaaactagaagaatccggcggcggcctcgtccaacccggcggctcccgcaaactctcctgcgccgcctccggcttcaccttctcctccttcggcatgcactgggtccgccaagcccccgaaaaaggcctcgaatgggtcgcctacatctcctccggctcctccaccctccactacgccgacaccgtcaaaggccgcttcaccatctcccgcgacaaccccaaaaacaccctcttcctccaaatgaaactcccctccctctgctacggcctcctcggctcccgcaacctctcccaccgcctcctctcccaaaacgacacccccatctgcctc

SEQ ID NO: 57571 - RNA, 336 nt, synthetic construct
  misc_feature 1..336: note = derived and/or modified sequence opt11 from anti-HIV_Chain
  source 1..336: mol_type = other RNA
gagatcgtgctcacacaatcgcccgcgaccttgagcttgagcccgggcgagcgcgcgaccttgagctgtcgcgcgagccagggcgtgaactttgtcgtgtggtatcaacagaaaaggggccaggccccgcgcttgctcatatacgggccctcggacagggccccgggcgtgcccgatcgctttagcgcacgcgggagcgggaccgagttctcgctcgtgatctcaagcgtggaaccggacgatttcgcgctctattactgtcaagagtactcgagcacgccctataactttggcacgggcacgcgcgtggacaggaaaaggaccgtggccgcgccc

SEQ ID NO: 57572 - RNA, 336 nt, synthetic construct
  misc_feature 1..336: note = derived and/or modified sequence opt11 from anti-HIV_Chain
  source 1..336: mol_type = other RNA
caaaccctctccctcacctgctccgtctccggcggctccatctcctccgccggctactactggggctggatccgccaacaccccggcaaaggcctcgaatggatcggccacatctactactccggcaacaccaactacaacccctccctcaaatcccgcctctccatgtccgtcgaaacctccaaaaaccaattctccctcaacctcgcctccgtcaccgccgccgacaccgccgtctacttctgcgcccgagactactccgccgccggccgccacctcttcgactcctggggccaaggcatcctcgtcaccgtctcctccgcctccaccaaaggc

SEQ ID NO: 57573 - RNA, 336 nt, synthetic construct
  misc_feature 1..336: note = derived and/or modified sequence opt11 from anti-HIV_LightChain
  source 1..336: mol_type = other RNA
gacatcgtcatgacccaacaaacccccctcaccctctccatcaccatcggccaacccgcctccatctcctgcaaatcctcccaatccctcctcgactccgacggcaaaacctacctcaactggctcctccaacgccccggccaatcccccaaacgccttatctactggatgtccaaactcgactccggcgtccccgaccgcttcaccggctccggctccggcaccgacttcaccctcaaaatctcccgcgtcgaagccgaagacctaggcgtctactactgctggcaaggcacccacttcccctggaccttcggcggcggcaccaaactcgaactc

SEQ ID NO: 57574 - RNA, 339 nt, synthetic construct
  misc_feature 1..339: note = derived and/or modified sequence opt11 from anti-HIV_LightChain
  source 1..339: mol_type = other RNA
gacatcgtcatcacccaatccaccaaattcatgtccacctcagtcggcgaccgcgtctccatcacctgcaaagcctcccaagacgtctccaccgccgtcgcctggtaccaacaaaaacccggccaatcccccaaactcctcatctactgggcctccacccgccacaccggcgtccccgaccgcttcaccggctccggctccggcaccgactacaccctcaccatctcccgcgtccaagccgaagacctcgccctctactactgccaacaacactacaccaccccctggaccttcggcggcggcaccaaactcgaaatcaaacgcaccgtcgccgccccc

SEQ ID NO: 57575 - RNA, 339 nt, synthetic construct
  misc_feature 1..339: note = derived and/or modified sequence opt11 from anti-HIV_Chain
  source 1..339: mol_type = other RNA
gacatccaaatgacccaatccccctcctcactctccgcccgcgtcggcgacaccgtcaccttcacctgccaagccaacggctacctcaactggtaccaacaacgccgcggcaaagcccccaaactcctcatctacgacggctccaaactcgaacgcggcgtcccctcccgcttctccggccgtcgctggggccaagaatacaacctcaccatcaacaacctccaacccgaagacatcgccacctacttctgccaagtctacgaattcgccgtccccggcacccgcctagacctcaaacgaaccgtcgccgccccctccgtcttcatcttcccctccgac

SEQ ID NO: 57576 - RNA, 339 nt, synthetic construct
  misc_feature 1..339: note = derived and/or modified sequence opt11 from anti-HIV_Chain
  source 1..339: mol_type = other RNA
caatccgtcctcacccaacccgcctccgtctccggctcccccggccaatccatcaccatctcctgcaccggcaccaactccgacgtcggctactcctacgtctcctggttccaacaacaccccggcaaagtccccaaactcctcatctacgacgtctcacgccgctcctcaggcgtctccaaccgcttctccggctcccgctccggcaacaccgcctccctcaccatctccggcctccgcgccgaagacgaagccgactactactgcggctccttcaccacctccctcaccctcgtcttcggcggcggcaccaaactcgccgtcctcgtctccccctcc

SEQ ID NO: 57577 - RNA, 339 nt, synthetic construct
  misc_feature 1..339: note = derived and/or modified sequence opt11 from anti-HIV_Chain
  source 1..339: mol_type = other RNA
tccctctccgcctccgtcggcgaccgcgtcaccatcacctgccgcgcctccgaatccatctccttctacctcaactggtaccaacaaaaacccggcaaagcccccgaactcctcatcttcgccacctcaaccctccactccggcgtcccctcccgcttctccggctccggctccggcaccgacttcaccctcaccatctcctccctacaactcgaagacttcgccacctactactgccaacaatcctcctccacccccttcaccttcggcggcggcaccaaagtcgaaatcaaacgcaccgtcgccgccccctccgtcttcatcttccccccctcagac

SEQ ID NO: 57578 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctccgcctccgtcggcgacaccgtcaccatcacctgccaagccaacggctacctcaactggtaccaacaacgccgcggaaaagcccccaaactcctcatctacgacggctccaaactcgaacgcggcgtcccctcccgcttctccggccgccgctggggccaagaatacaacctcaccatcaacaacctccaacccgaagacatcgccacctacttctgccaagtctacgaattcatcgtccccggcacccgcctcgacctcaaacgcaccgtcgccgccccctccgtcttcatcttccccccctccgac

SEQ ID NO: 57579 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctcactctccgcccgcgtcggcgacaccgtcaccatcacctgccaagccaacggctacctcaactggtaccaacaacgccgcggcaaagcacccaaactcctcatctacgacggctcaaaactcgaacgcggcgtcccctcccgcttctccggccgccgctggggccaagaatacaacctcaccatcaacaacctccaacccgaagacatcgccacctacttctgccaagtctacgaattcgccgtccccggcacccgcctcgacctcaaacgcaccgtcgccgccccctccgtcttcatcttccccccctccgac

SEQ ID NO: 57580 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctccgcccgagtcggcgacaccgtcaccatcacctgccaagccaacggctacctcaactggtaccaacaacgccgcggcaaagcccccaaactcctcatctacgacggctccaaactcgaacgcggcgtcccctcccgcttctccggccgccgctggggccaagaatacaacctcaccatcaacaacctccaacccgaagacatcgccacctacttctgccaagtctacgaattcgtcgtccccggcacccgcctcgacctcaaacgcaccgtcgccgccccctccgtcttcatcttccccccctccgac

SEQ ID NO: 57581 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctccgcccgcgtcggcgacaccgtcaccttcacctgccaagccaacggctacctcaactggtaccaacaacgccgcggcaaagcccccaaactcctcatctacgacggctccaaactcgaacgcggcgtcccctcccgcttctccggccgccgctggggccaagaatacaacctaaccatcaacaacctccaacccgaagacatcgccacctacttctgccaagtctacgaattcgccgtccccggcacccgactcgacctcaaacgcaccgtcgccgccccctccgtcttcatcttccccccctccgac

SEQ ID NO: 57582 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctccgcctccgtcggcgacaccgtcaccatcacctgccaagccaacggctacctcaactggtaccaacaacgccgcggcaaagcccccaaactcctcatgtacgacggctccaccctcgaacgcggcgtacccgcccgcttctccggccgccgctggggccaagaatacaacctcaccataaacaacctccaacccgaagacgtcgccacctacttctgccaagtctacgaattcatcgtccccggcacccgcctcgacctcaaacgcaccgtcgccgccccctccgtcttcatcttccccccctccgac

SEQ ID NO: 57583 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctccgcctccgtcggcgacaccgtcaccatcacctgccaagccaacggctacctcaactggtaccaacaacgccgcggcaaagcccccaaactactcatctacgacggctccaaactcgaacgaggcgtcccctcccgattctccggccgccgctggggccaagaatacaacctaaccatcaacaacctccaagccgaagacatcgccacctacttctgccaagtctacgaattcgccgtccccggcacccgcctcgacctcaaacgcaccgtcgccgccccctccgtcttcatcttccccccctccgac

SEQ ID NO: 57584 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcatccctctccgcctccgtcggcgacaccgtcaccttcacctgccaagccaacggctacctcaactggtaccaacaacgccgcggcaaagcccccaaactcctcatctacgacggctcccgcctcgaacgcggcgtcccctcccgcttctccggccgccgctggggccaagaatacaacctcaccatcaacaacctccaacccgaagacatcgccacctacttctgccaagtctacgaattcgccgtccccggcacccgcctcgacctcaaacgcaccgtcgccgccccctctgtcttcatcttccccccctccgac

SEQ ID NO: 57585 - RNA, 342 nt, synthetic construct
  misc_feature 1..342: note = derived and/or modified sequence opt11 from anti-HIV_Chain
  source 1..342: mol_type = other RNA
gacatccaaatgacccactccccctcctccctctccgcctccgtcggcgacaccgtcaccatcacctgccaagccaacggctacctcaactggtaccaacaacgccgcggcaaagcccccaaactcctcatctacgacggctccaaactcgaaaccggcgtcccctcccgcttcaccggccgccgctggggccaagaatacaacctaaccatcaacaacctccaacccgaagacatcgccacatacttctgccaagtctacgaattcatcgtccccggcacccgcctcgacctcaaacgcaccgtcgccgccccctccgtcttcatcttccccccctccgac

SEQ ID NO: 57586 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctccgcccgcgtcggcgacaccgtcaccatcacctgccaagccaacggctacctcaactggtaccaacaacgccgcggcaaagcccccaaactcctcatctacgacggctccaaactcgaaaccggcgtcccctcccgcttcaccggccgccgctggggccaagaatacaacctcaccatcaacaacctccaacccgaagacatcgccacctacttctgccaagtctacgaattcatcgtccccggcacccgcctcgacctcaaacgcaccgtcgccgccccctccgtcttcatcttccccccctccgac

SEQ ID NO: 57587 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctcactctccgcccgcgtcggcgacaccgtcaccttcacctgccaagccaacggctacctcaactggtaccaacaacgccgcggcaaagcccccaaactcctaatctacgacggctccaaactcgaacgcggcgtcccatcccgcttctccggccgcggctggggccaagaatacaacctcaccatcaacaacctccaacccgaagacatcgccacctacttctgccaagtctacgaattcgccgtccccggcacccgcctcgacctcaaacgcaccgtcgccgccccctccgtcttcatcttccccccctccgac

SEQ ID NO: 57588 - RNA, 342 nt, synthetic construct
  misc_feature 1..342: note = derived and/or modified sequence opt11 from anti-HIV_Chain
  source 1..342: mol_type = other RNA
gacatccaaatgacccaatccccctcctccctctcagcctccgtcggcgacaccgtcaccatcacctgccaagccaacggctacctcaactggtaccaacaacgccgcggcaaagcccccaaactcctcatctacgacggctccaaactcgaacgcggcgtcccctcccgcttctcaggccgccgctggggccaagaatacaacctcaccatcaacaacctccaacccgaagacatcgccacctacttctgccaagtctacgaattcgtcgtccccggcacccgcctcgacctcaaacgcaccgtagccgccccctccgtcttcatcttccccccctccgac

SEQ ID NO: 57589 - RNA, 342 nt, synthetic construct
  misc_feature 1..342: note = derived and/or modified sequence opt11 from anti-HIV_Chain
  source 1..342: mol_type = other RNA
tcccaatccgtcgtcacccaagaaccctccctcaccgtctcccccggcggaaccgtcaccctcacctgcggcccctccaccggcgccgtcacctccggcttctacccccactggttccaacaaaaacccggccaagccccccgcgccctcatctactccacctccaacaaatactcctggaccccagcccgcttctccggctccctcctcggcggcaaagccgtcctcaccctctccgacgtccaacccgacgacgaagccgaatactactgcctcctcctcctctactacggcggcccctggatcttcggcggcggcaccaaactcaccgtcctcgtctcc

SEQ ID NO: 57590 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggagacaaagtcaccatcacctgccaaacctccgccggctacctaaactggtaccaacaacgccgcggccgcgcccccaaactcctcatgtacgacggctcccgcctcgtcaccggcgtcccctcccgcttctccggccgccgctggggcacccaatacaacctcaccatcggctccctccaacccgaagacgtcgccacctactactgccaagtctacgaattcttcggccccggcacccgcctcgacctcaaacgcaccgtcgccgccccctccgtcttcatcttccccccctcagac

SEQ ID NO: 57591 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggcgacaccgtcaccatcacctgccaaaccaccaaaggctacctcaactggtaccaacaacgccgcggccgcgcccccaaactcctcatgttcgacggctccaaactcgtcaccggcgtcccctcccgcttctccggccgccgctggggcacccaatacaacctcaccatcggctccctccaacccgaagacctcgccacctactactgccaagtctacgaattcttcggccccggcacccgcctcgacctcaaacgcaccgtcgccgccccctccgtcttcatcttccccccctccgac

SEQ ID NO: 57592 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggcgacaccgtcaccatcacctgccaaaccaacaaaggctacctcaactggtaccaacaacgccgcggccgcgcccccaaactcctcatgtgcgacggctccaaactcgtcaccggcgtcccctcccgcttctccggccgccgctggggaacccaatacaacctcaccatcggctccctccaacccgaagacatcgccacctactactgccaagtctacgaattcttcggccccggcacccgcctcgacctcaaacgcaccgtcgccgccccctccgtcttcatcttccccccctccgac

SEQ ID NO: 57593 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcccgcgtcggcgacaaagtcaccatcacctgccaaacctccgccggctacctcaactggtaccaacaacgccgcggccgcgccccaaaactcctcatgtacgacggctcccgcctcgtcaccggcgtcccctcccgcttctccggccgccgctggggcacccaatacaacctcaccatcggctccctccaacccgaagacatcgccacctactactgccaagtctacgaattcttcggccccggcacccgcctagacctcaaacgcacagtcgccgccccctccgtcttcatcttccccccctccgac

SEQ ID NO: 57594 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggcgacaccgtcaccatcacctgccaaaccaacaaaggctacctcaactggtaccaacaaaaacgcggccgcgcccccaaactcctcatgtacgacggctccaaactcgtcacaggcgtcccctcccgcctctccggccgccgctggggcacccaatacaacctcaccatcggctccctccaacccgaagacatcgccacctactactgccaagtctacgaattcttcggccccggcacccgcctcgacctaaaacgcaccgtcgccgccccctccgtcttcatcttccccccctccgac

SEQ ID NO: 57595 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggcgacaccgtcaccatcacctgccaaaccaacaaaggctacctcaactggtaccaacaacgccgcggccgagcccccaaactcctcatgtacgacggctccaaactcgtcaccggcgtcccctcccgcctctccggccgccgctggggcacccaatacaacctcaccatcggctccctccaacccgaagacatcgccacctactactgccaagtctacgaattcttcggccccggcacccgcctcgacctcaaacgcaccgtcgccgccccctccgtcttcatcttccccccctccgac

SEQ ID NO: 57596 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggcgacaccgtcaccatcacatgccacaccaacaaaggctacctcaactggtaccaacaacgccgcggccgcgcccccaaactcctcatgttcgacggctccaaactcgtcaccggcgtcccctcccgcttctccggccgccgctggggcacccaatacaacctaaccatcggctccctccaacccgaagacatcgccacctactactgccaagtctacgaagtcttcggccccggcacccgcctcgacctcaaacgcaccgtcgccgccccctccgtcttcatcttcccaccctccgac

SEQ ID NO: 57597 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctatccgcatccgtcggcgacaccgtcaccatcaactgccaaaccaacaaaggctacctcaactggtaccaacaacgccgcggccgcgcccccaaactcctcatgtacgacggctccaaactcgtcaccggcgtcccctcccgcttctccggccgccgctggggcacccaatacaacctcaccatcggctccctccaacccgaagacatcgccacctactactgccaagtctacgaattcttcggccccggcacccgcctcgacctcaaacgcaccgtcgccgccccctcagtcttcatcttccccccctccgac

SEQ ID NO: 57598 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcccgcgtcggcgacaaagtcaccatcacctaccaaacctccgccggctacctcaactggtaccaacaacgccgcggccgcgcccccaaactcctcatgtacgacggctcccgcctcgtcaccggcgccccctcccgcttctccggccgccgctggggcacccaatacaacctcacaatcggctccctccaacccgaagacatcgccacctactactgccaagtctacgaattcttcggccccggcacacgcctcgacctcaaacgcaccgtcgccgccccctccgtcttcatcttccccccctccgac

SEQ ID NO: 57599 - RNA, 345 nt, synthetic construct
  misc_feature 1..345: note = derived and/or modified sequence opt11 from anti-HIV_Chain
  source 1..345: mol_type = other RNA
gacatccaaatgacccaatccccctcctccctctccgcctccgtcggcgacaccgtcaccatcacctgccaaaccaacaaaggctacctcaactggtaccaacaacgccgcggccgcgcccccaaactcctcatgtacgacggctccaaactcgtcaccggcgtcccctcacgcttctccggccgccgctggggcacccaatacaacctcaccatcggctccctccaacccgaagacatcgccacctactactgccaagtctacgaattcttcggccccggcacccgcctcgacctcaaacgcaccgtcgccgccccctccgtcttcatcttccccccctccgac

SEQ ID NO: 57600 - RNA, 345 nt, synthetic construct
  misc_feature 1..345: note = derived and/or modified sequence opt11 from anti-HIV_Chain
  source 1..345: mol_type = other RNA
gtcaccctctccctctcccccggcgaacgcgccaccctctcctgccgcgcctcccaaaccatctccaacaactacctcgcctggtaccaacaaaaacccggccaagccccccgcctcctcatctacggcgcctcctccggcgccaccggcctccccgaccgcttctccggctccggctccggcaccgacttcaccctcaccatctcccgcctcgaacccgaagacttcgccgtctactactgccaccaatacgccctctccccctggaccttcggccgaggcaccaaagtcgaaatcaaacgcaccgtcgccgcaccctccgtcttcatcttccccccctccgac

SEQ ID NO: 57601 - RNA, 345 nt, synthetic construct
  misc_feature 1..345: note = derived and/or modified sequence opt11 from anti-HIV_Chain
  source 1..345: mol_type = other RNA
accctctccgcctccgtcggcgaccgcgtcaccatcacctgccgcgcctcccaatccatcaacaactacctcaactggtaccaacaaaaacccggcaaagcccccaaactcctcatctacgccgcctcctccctccaatcaggcgtcccctcccgcttctccggctccggctccggcaccgacttcaccctcaccatctcctccctccaacccgaagacttcgtcacctactactgccaacaaacctactccaacccccgcatgttcggccaaggcaccaaagtcgaaatcaaacgcaccgtcgccgccccctccgtcttcatcttccccccctccgacgaacaa

SEQ ID NO: 57602 - RNA, 345 nt, synthetic construct
  misc_feature 1..345: note = derived and/or modified sequence opt11 from anti-HIV_Chain
  source 1..345: mol_type = other RNA
caatccgcactcacccaagccccctccgcctccggcacccccggccaacgcgtcaccatctcctgctccggcggcggctccaacatcggcggcaacctcgtctcctggtaccaacacttccccggcgccgcccccaaactcctcatctaccgcaacgaccaacgcccctccggcgtccccgaccgcttctccgcctccaaatccggcacctccgcctccctcgccatctccggcctccgctccgacgacgaagccacctacttctgcgccgcctacgactccaccctctccctccgcctcttcggcggcggcaccaccctcgccgtcctctcccaacccaaagcc

SEQ ID NO: 57603 - RNA, 345 nt, synthetic construct
  misc_feature 1..345: note = derived and/or modified sequence opt11 from anti-HIV_Chain
  source 1..345: mol_type = other RNA
aaaccctcccaaaccctctccctcacctgcaccgtatccggcggctccatctcctccgccggctactactggacctggatccgccaccaccccggcaaaggcctcgaattcatcggctacatctaccacatcggcaccccctactacaacccctcactcaaatcccgcctcaccatctccatcgacacctccaaaaaccaattctccctcaaactctcctccgtcaccgccgccgacaccgccatctactactgcgcccgcgactacaccgcccgaggccgacacttcttcgactactggggccaaggcgccctcgtcaccgtctcctccgcctccaccaaaggc

SEQ ID NO: 57604 - RNA, 345 nt, synthetic construct
  misc_feature 1..345: note = derived and/or modified sequence opt11 from anti-HIV_Chain
  source 1..345: mol_type = other RNA
ccctccgaaaccctctccctcacctgccgcgtctccggcgcctctatctccaacttctactggacctggatccgccaacccgccggcaaaggcctagaatggatcggccgcctatactcctccgacaaaaccaactacaacccctccctcaacggccgcgtcaccatgtccctcgacacctccaaaaaccaattctccctccgcctcacctccatgaccgacgccgacaccgccatctactactgcgcccgcgaaaaaggccaatgggtcaccctccccccctactacttcgactcctggggccaaggcatcctcgtcaccgtctcctccgcctccaccaaaggc

SEQ ID NO: 57605 - RNA, 348 nt, synthetic construct
  misc_feature 1..348: note = derived and/or modified sequence opt11 from anti-HIV_Chain
  source 1..348: mol_type = other RNA
ggccccgccaccctctccgtctcccccggcgaacgcgccaccctctcctgccgcgcctcccaatccctccgcaacaacctcgcctggtaccaacaaaaaaccggccaatccccccgcctcctcatctacgccgtctccacccgcgccaccggcatccccccccgcttctccggcggcggctccggcaccgaattcaccctcaccatcgactcactccaatccgaagacttcgccgtctacttctgccaacaatacgactcaccccaatggaccttcggccaaggcaccaaagtcgaaatcaaacgcaccgtcgcagccccctccgtcttcatcttccccccctccgac

SEQ ID NO: 57606 - RNA, 348 nt, synthetic construct
  misc_feature 1..348: note = derived and/or modified sequence opt11 from anti-HIV_Chain
  source 1..348: mol_type = other RNA
gcccccgtcaccctctccgcctccgtcggcgacaccgtaaccatcacctgccgcgcctcccaacccatcgccaccttcctcaactggtaccaacacaaacccggccaagcccccaaactcctcatctacgccgcctccaccttccaacgcggcgccccctcccgctactcaggctccggctccggcaccgacttcaccctcaccatcaactccctacaacccgaagacctagccacctactactgccaacaaaccttcaccgaccccgtcaccttcggccaaggcacccgcctcgaaatcaaacgcaccgtcgccgccccctccgtcttcatcttccccccctccgac

SEQ ID NO: 57607 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccatcggcgacaccgtccgcatctcctgccgcgcctcccaatccatcaccggcggctggctcgcctggtaccaccaacgccccggcaaagccccccgcctactcatctaccgcggctcccgcctcctcggcggcgtcccctcccgcttctccggctccgccgccggcaccgacttcaccctcaccatcgccaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57608 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctatccgcctccatcggcgacaccgtccgcatctcctgccgcgcctcccaatccatcaccggcaactgggtcgcctggtaccaacaacgccccggcaaagccccccgcctcctcatctaccgcggcgccgccctcctcggcggcgtcccctcccgcttctccggctccgccgccggcaccgacttcaccctcaccatcggcaacctccaaaccgaagacttcggcaccttctactgccaacaatacgacacctaccccggcaccttcggccaaggcaccaaagtcgaagtcaaacgcaccgtcgccgccccctccgtcttc

SEQ ID NO: 57609 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccatcggcgacaccgtccgcatctcctgccgcgcctcccaatccatcaccggcaactgggtcgcctggtaccaacaacgccccggcaaagcaccccgcctcctcatctaccgcggcgccgccctactcggcggcgtcccctcccgcttccgcggatccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57610 - RNA, 351 nt, synthetic construct
  misc_feature 1..351: note = derived and/or modified sequence opt11 from anti-HIV_LightChain
  source 1..351: mol_type = other RNA
gacatccaaatgacccaatcaccctccaccctatccgcctcagtcggcgacaccgtccgcatatcctgccgcgcctcccaatccatcaccggcggctggctcgcctggtaccaccaacgccccggcaaagccccccgcctcctcatctaccgcggctcccgcctcctcggcggcgtcccctcacgcttctccggctccgccgccggcaccgacttcaccctcaccatcgccaacctccaagccgaagacttcggcaccttctactgccaacaatacgacacctaccccggcaccttcggccaaggcaccaaagtcgaagtcaaacgcaccgtcgccgccccctcagtcttc

SEQ ID NO: 57611 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccatcggcgacaccgtccgcatctcctgccgcgcctcccaatccatcaccggaaactgggtcgcctggtaccaacaacgccccggcaaagccccccgcctcctcatctaccgcggcgccgccctcctcggcggcgtcccctcccgcttctccggctccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57612 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccatcggcgacaccgtccgcatctcctgccgcgcctcccaatccatcaccggcggctgggtcgcctggtaccaccaacgccccggcaaagccccccgcctcctcatctaccgcggctcacgcctcctcggcggcgtcccctcccgcttctccggctccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57613 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccgtcggcgacaccgtccgcatctcctgccgcgcctcccaatccatcaccggcggctggctcgcctggtaccaccaacgccccggcaaagccccccgcctcctcatctaccgcggctcccgcctcctcggcggcgtcccctcccgcttctccggctccgccgccggcaccggcttcaccctcaccatcgccaacctccaagccgaagacttcggcacattctactgccaacaatacgacacctaccccggcaccttcggccaaggcaccaaagtcgaagtcaaacgcaccgtcgccgccccctccgtcttc

SEQ ID NO: 57614 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccgtcggcggcaccgtccgcatctcctgccgcgcctcccaatccatcaccggaggctggctcgcctggtaccaccaacgccccggcaaagcccccagactcctaatctaccgcggctcccgcctcctcggcggcgtcccctcccgcttctccggctccgccgccggcaccgacttcaccctcaccatcgccaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57615 - RNA, 351 nt, synthetic construct
  misc_feature 1..351: note = derived and/or modified sequence opt11 from anti-HIV_LightChain
  source 1..351: mol_type = other RNA
gacatccaaatgacccaatcaccctcaaccctaagcgccagcataggcgacaccgtccgcataagctgccgcgcaagccaaagcataaccggcaactgggtcgcatggtaccaccaacgcccaggcaaagccccacgcctactcatatacagaggcgcagccctactcggcggcgtaccctcacgcttcagcggaagcgcagccggaaccgacttcacactcacaatcggaaacctacaagccgaagacttcggaaccttctactgccaacaatacgacacctaccccggaacattcggccaaggcacaaaagtagaagtaaaaagaaccgtcgccgcaccctcagtcttc

SEQ ID NO: 57616 - RNA, 351 nt, synthetic construct
  misc_feature 1..351: note = derived and/or modified sequence opt11 from anti-HIV_LightChain
  source 1..351: mol_type = other RNA
gacatccaaatgacccaatcaccctccaccctctccgcctccatcggcgacaccgtcatgatctcctgccgcgcctcccaatccatcaccggcggctggctcgcctggtaccaccaacgccccggcaaagccccccgcctcctcatctaccgcggctccaaactcctcggcggcgtcccctcacgcttctccggctccgccgccggcaccggcttcaccctcaccatcggcaacctccaagccgaagacttcggcaccttctactgccaacaatacgacacctaccccggcaccttcggccaaggcaccaaagtcgaagtaaaacgcaccgtcgccgccccctccgtcttc

SEQ ID NO: 57617 - RNA, 351 nt, synthetic construct
  misc_feature 1..351: note = derived and/or modified sequence opt11 from anti-HIV_LightChain
  source 1..351: mol_type = other RNA
gacatccaaatgacacaatcaccctcaaccctaagcgcaagcgtaggcgacaccgtacgcataagctgccgcgcaagccaaagcataaccggaggctggctcgcatggtaccaccaacgcccaggcaaagccccacgcctactcatatacagaggctcccgcctactcggaggcgtaccctcacgcttcagcggaagcgcagccggcgccgacttcacactcacaatcgcaaacctacaagcagaagacttcggaaccttctactgccaacaatacgacacctaccccggaaccttcggccaaggcacaaaagtagaagtaaaaagaaccgtagccgcaccctcagtcttc

SEQ ID NO: 57618 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccatcggcgacaccgtccgcatctcctgccgcgcctcccaatccatcaccggcggctggctcgcctggtaccaccaacgccccggcaaagccccccgcctcctcatctaccgcggctcccgcctcgtcggcggcgtaccctcccgcttctccggctccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57619 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcatccatcggcgacaccgtccgcatctcctgccgcgcctcccaatccatcaccggcggctggctcgcctggtaccaccaacgccccggcaaagcaccccgcctcctcatctaccgcggctcccgcctcctaggcggcgtcccctccaaattctccggctccgccgccggcaccgacttcaccctcaccatcgccaacctccaagccgaagacttcggcaccttctactgccaacaatacgacacctaccccggcaccttcggccaaggcaccaaagtcgaagtcaaacgaaccgtcgccgccccctccgtcttc

SEQ ID NO: 57620 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccaccggcgacaccgtccgcatctcctgccgcgcctcccaatccatcaccggcaactgggtcgcctggtaccaacaacgccccggcaaagccccacgcctcctcatctaccgcggcgcagccctcctcggcggcgtcccctcccgcttccgcggctccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttc

SEQ ID NO: 57621 - RNA, 351 nt, synthetic construct
  misc_feature 1..351: note = derived and/or modified sequence opt11 from anti-HIV_LightChain
  source 1..351: mol_type = other RNA
gacatccaaatgacccaatccccctccaccctctccgcctccatcggcgacaccgtccgcatctcctgccgcgcctcccaatccatcaccggcaactggctcgcctggtaccaccaacgccccggcaaagccccccgcctcctcatctaccgcggctcccgcctcctcggcggcgtaccctcccgcttctccggctccgccgccggcaccgacttcaccctcaccatcgccaacctccaagccgaagacttcggcacattctactgccaacaatacgacacctaccccggcaccttcggccaaggcaccaaagtcgaagtcaaacgcaccgtcgccgccccctccgtcttc

SEQ ID NO: 57622 - RNA, 351 nt, synthetic construct
  misc_feature 1..351: note = derived and/or modified sequence opt11 from anti-HIV_Chain
  source 1..351: mol_type = other RNA
atcatcctcttcctcgtcgccaccgccaccggctcatgggcccaatccgccctcacccaaccccgctccgtctccggctccctaggccaatccgtcaccatctcctgcaccggctcctcctccgacgtcggccgctacaactacgtctcctggtaccaacaccaccccggcaaagcccccaaactcatgatctccgacgtcaacaaacgcccctccggcgtccccgaccgcttctccggctccaaatccggcaacaccgcctccctcaccatctcaggcctccaagccgaagacgaaaccgactactactgctgctcctacgccggctcatacatctgggtcttcggcggc

SEQ ID NO: 57623 - RNA, 351 nt, synthetic construct
  misc_feature 1..351: note = derived and/or modified sequence opt11 from anti-HIV_Chain
  source 1..351: mol_type = other RNA
cccgtcaccctctccgcctccgtcggcgaccgcgtcaccatcacctgccgcgcctccgaagacatctccaaatacctcaactggtaccaacacaaacccggcaaagcccccaaactcctcatctacaccgcctcctccctcgaaaccggcgtcccctcccgcttctccggctccggctccggcaccgacttctccctcaccatctcctccctccaacccgacgacttcgccacctactactgccaacaatcctacacctcctccgtcaccttcggccaaggcacccgagtcgaagtcaaacgcaccgtcgccgccccctccgtcttcatcttccccccctccgacgaacaa

SEQ ID NO: 57624 - RNA, 351 nt, synthetic construct
  misc_feature 1..351: note = derived and/or modified sequence opt11 from anti-HIV_Chain
  source 1..351: mol_type = other RNA
gtggaggaacccgggagctcggtaaaggtctcgtgcaaggcctcgggcgggagctcgaccgcgtacgggtactcgtgggtgcgccaggccccgggccagggctttgaatggatggggcgcataatcccgttctatggcataatcacgtacgcgcccaagttccagggcagggtcacgatcacagccgatcgctcgacctcgaccgtgtacatggaattgaccaggctcacgttcgcggacacggccttgttcttttgcgcgcgcgattacggggacccgcgcaatggctattactttgactcatgggatcaagggctctggctcacggtctcgagcgcgagcacgaaaggg

SEQ ID NO: 57625 - RNA, 351 nt, synthetic construct
  misc_feature 1..351: note = derived and/or modified sequence opt11 from anti-HIV_Chain
  source 1..351: mol_type = other RNA
caagtccgcctagaacaatccggcgccgccgtccgcacccccggcgcctccgtcaccctctcctgccaagcctccggctacaaattcgtcaactacatcatccactgggtccgccaacgccccggcctcgccttcgaatgggtcggcatgatcgacccctaccgcggccgcccctggtccgcccactccttcgaaggccgcctctccctctcacgcgacgtctccatggaaatcctctacatgaccctcacctccctccgctccgacgacaccgccacctacttctgcgcccgcgccgaagccgaatcccaatcccactcccgccccatcatctccacctccggcgcccgc

SEQ ID NO: 57626 - RNA, 351 nt, synthetic construct
  misc_feature 1..351: note = derived and/or modified sequence opt11 from anti-HIV_Chain
  source 1..351: mol_type = other RNA
gtccacctcgaagtccaactccaacaatcaggccccgaactcaaaaaacccggcgaaaccgtcaaaatctcctgcaaagcctccgtctacaccttcaccgaataccccatccactgggtcaaacaagcacccggcaaaggcttcaaatggatgggctggatcaacacctactccggcgaacccacctacgccgacgacttcaaaggccgcttcgccttctccctcgaaacctccgcctccaccgcctacctacaaatcaactccctcaaaaacgaagacaccgccacctacttctgcgcctccctcggccgcgactactggggccaaggccaaggcacaaccctcaccgtc

SEQ ID NO: 57627 - RNA, 354 nt, synthetic construct
  misc_feature 1..354: note = derived and/or modified sequence opt11 from anti-HIV_Chain
  source 1..354: mol_type = other RNA
ctctcagtctccctcggcgaacgcgccaccatcaactgcaaatcctcccaatccatcctctactcctccgacaaaaaaaactacctcgcctggtaccaacaaaaaatcggccaaccccccaaactcctcctctactgggcctccacccgcgaatccggaatccccgaccgcttctccggctccggctccggctccgacttcaccctcaccatctcctccctacaacccgaagacgtcgccgtctactactgccaacaatactacatctcccccttcaccttcggccccggcacaaaagtcgacctcaaacgcaccgtcgccgccccctccgtcttcatcttccccccctccgac

SEQ ID NO: 57628 - RNA, 354 nt, synthetic construct
  misc_feature 1..354: note = derived and/or modified sequence opt11 from anti-HIV_Chain
  source 1..354: mol_type = other RNA
caatccgtcctcacccaaccaccctccgcctccggcgcccccggccaacgcgtcaccatctcctgctccggcggcccctccaacgtcggcggcaactacgtctactggtaccgccaattccccggcaccgcccccaaactcctcatcctccgcgacgaccaacgaccctccggcgtccccgaccgcttctccgcctccaaatccggcaactccgcctccctcgccatctccggcctccgccccgacgacgaagccttctacttctgcgccacctacgactccgacggctccatccgcctcttcggcggcggaaccgccctcaccgtcctctcccaacccaaagccgccccctcc

SEQ ID NO: 57629 - RNA, 354 nt, synthetic construct
  misc_feature 1..354: note = derived and/or modified sequence opt11 from anti-HIV_Chain
  source 1..354: mol_type = other RNA
aaagcccccgccaccctctccctctcccccggcgaacgcgccaccctctcctgccgcgcctcccaatccgtcggctccgacctcgcctggtaccaacaaaaacccggccaagccccccgactcctcatctacgacgcctccaaccgcgccaccgccataccagcccgattctccggctccggctccggcaccgacttcaccctctccatctcctccctcgaacccgaagacttcgccgtatacttctgccaacaacgatacgacaaaatcaccttcggccaaggcacccgcctcgaaatccaacgcaccgtcgccgccccctccgtcttcatcttccccccctccgacgaacaa

SEQ ID NO: 57630 - RNA, 354 nt, synthetic construct
  misc_feature 1..354: note = derived and/or modified sequence opt11 from anti-HIV_Chain
  source 1..354: mol_type = other RNA
caagtccaactcgtccaatccggcgccgaagccaaacgccccggcgactcagtcaaagtctcctgcaaagcctccggctacaccttcaccgaatactacatccactgggtccgccaaacccccggccaaggcttcgaatggatgggcatcatcacccccggcgccggcaacaccacctacgcccaaaaattccaaggccgcatcaccgtcacccgcgacacctccgccgccaccgtctacatggaactctccaacctcacctccgaagacaccgccgtctacttctgctcacgcggagtctccttctggggccaaggcaccctagtcaccgtctcatccgcctccaccaaaggc

SEQ ID NO: 57631 - RNA, 354 nt, synthetic construct
  misc_feature 1..354: note = derived and/or modified sequence opt11 from anti-HIV_HeavyChain
  source 1..354: mol_type = other RNA
gaagtgaaactgcaacagagcggggccgagctcgtgcgcccgggcgcgagcgtgaaaatgagctgtaaagcgagcgggtacaggttcacgagctataacatgcactgggtcaagcaaacgcccaggcaagggctcgagtggataggcgcgatctatcccgggaacggggacacgagctataaccagaaatttaaagggaaagcgaccttgaccgtggacaagagctcgagcacggcctatatgcagctctcgagcttgacctcggaagatagcgcggtctatttctgtgccaggggcaggctctcgctcgggttcgattactggggccagggctcgaccttgaccgtgagctcg

SEQ ID NO: 57632 - RNA, 357 nt, synthetic construct
  misc_feature 1..357: note = derived and/or modified sequence opt11 from anti-HIV_Chain
  source 1..357: mol_type = other RNA
caagtccaactcgtccaatccggcaccgccgtcaaacgccccggcgcctccgtccgcgtctcctgccaagcctccggctacaccttcatcgaccacttcatctactggtggcgccaagcccccggccaaggcctcgaatggctcggctggatcaaccccctcacctcccaaccctcctacccctcacgcttccaaggccgcctcaccctcacccgcgacaccttcgacgaaatgctctacatggacctccgcggcctccgctccgacgacaccggcatctacttctgcgcccgccgccactccgactactgcgacttcgacatctggggctccggcacccaaatcatcgtctcctcc

SEQ ID NO: 57633 - RNA, 357 nt, synthetic construct
  misc_feature 1..357: note = derived and/or modified sequence opt11 from anti-HIV_Chain
  source 1..357: mol_type = other RNA
caagtccaactcgtccaatccggcaccgccgtcaaacgccccggcgcctccgtccgcgtctcctgccaagcctccggctacaccttcaccgactacttcatctactggtggcgccaagcccccggccaaggcctcgaatggctcggctggatcaaccccctcacctcacaaccctcctacccctcccgcttccaaggccgcctaaccctcacccgcgacaccttcgacgaaatgctctacatggacctccgcggcctccgctccgacgacaccggcatctacttctgcgcccgccgccactccgactactgcgacttcgacatctggggctccggcacccaaatcatcgtctcctcc

SEQ ID NO: 57634 - RNA, 357 nt, synthetic construct
  misc_feature 1..357: note = derived and/or modified sequence opt11 from anti-HIV_Chain
  source 1..357: mol_type = other RNA
caatccgtcctcacccaaccccgctccgtctccggctcccccggccaatccgtcaccatctcctgcaccggcacctcctccgacgtcggcggctacaactacgtctcctggtaccaacaacaccccggcaaagcccccaaaaccatgatcttcgacgtcaccaaacgcccctccggcgtccccgaccgcttctccggctccaaatccggcaacaccgcctccctcaccatctccggcctccaagccgaagacgaagccgactactactgctcctcctacgccggccgcaacaccttctacgtcttcggcaccggcaccaccgtcaccgtccaagtctccccctcccaaccccccccc

SEQ ID NO: 57635 - RNA, 357 nt, synthetic construct
  misc_feature 1..357: note = derived and/or modified sequence opt11 from anti-HIV_Chain
  source 1..357: mol_type = other RNA
gaaatcgtcctcacccaatcccccggcaccctctccctctcccccggcgaacgcgccaccctctcctgccgcgcctcccaatcagtctcctccaactacctcgcctggtaccaacaaaaacccggccaagccccccgcctcctcatctacggcgcctcctcccgcgccaccggcatccccgaccgcttctccggctccggctccggcaccgacttcaccctctccatctcacgcctcgaacccgaagacttcgccgtctactactgccaacaatacggcacctcctcctgcaccttcggccaaggaaccaaactcgaaatcaaacgcaccgtcgccgccccctccgtcttcatcttc

SEQ ID NO: 57636 - RNA, 357 nt, synthetic construct
  misc_feature 1..357: note = derived and/or modified sequence opt11 from anti-HIV_Chain
  source 1..357: mol_type = other RNA
ctatccgcctccgtcggcgaccgcgtcaccatcacctgccgcgcctcccaatcaatcgaccgctacctcaactggtaccaacaaaaacccggcaaagcccccaaactcctcatctacgccgcctcctccctccacaccgacgtcccctcccgattctccggctccggcgccggcacctacttcaccctaaccatcacctccctacaacccgaagacttcgccacctactactgccaacaatcccactccccctccttcggccaagaatcctactccatcaccttcggccaaggcacccgcctcgaaatcaaacgaaccgtcgccgccccctccgtcttcatcttccccccctccgac

SEQ ID NO: 57637 - RNA, 357 nt, synthetic construct
  misc_feature 1..357: note = derived and/or modified sequence opt11 from anti-HIV_Chain
  source 1..357: mol_type = other RNA
aacttcatgctcacacaagccccctccgcctccggcgcccccggccaacgcgtcaccatctcctgctccggcggcccctccaacgtcggcggcaactacgtctactggtaccgccaataccccggcaccgcccccaaactcctcatcctccgcgacgaccaacgaccctccggcgtccccgaccgcttctccgcctccaaatccggcaactccgcatccctcgccatctccgaactccgccccgacgacgaagccttctacttctgcgccacctacgactccgacggctccatccgcctcttcggcggcggcaccgccctcaccgtcctctcccaacccaaagccgccccctccgtc

SEQ ID NO: 57638 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctctccgcctccatcggcgaccgcgtcaacatcacctgccaagcctcccgcgacaccggctccgccctcaactggtaccaacaaaaagtcggccgccccccccgactcctcatctccgccgtctccaacctcggcgccggcgtcccctcccgcttctccggccgccgctccggcacccaatccaccctcaccatcaacaccctccaacccgaagacatcgccacctacttctgccaacactacgaattcttcggacccggcaccaaagtcgacatcaaacgcaccgtcgccgccccctccgtcttcatcttccccccctccgacgaacaa

SEQ ID NO: 57639 - RNA, 360 nt, synthetic construct
  misc_feature 1..360: note = derived and/or modified sequence opt11 from anti-HIV_Chain
  source 1..360: mol_type = other RNA
caatccgtcctcacccaacccgcctccgtctccggctcccccggacaatccatcaccatctcctgcaccggcacctccaacgacgtcggcggccaaaacttcgtctcctggtaccaacaacaccccggcaccgccccccaactcctcatctacgacgtcaccaaccgccccgccggcgtctcctcccgcttctccggctccaaatccggcaacaccgcctccctcaccatctccggcctccgcaccgaagacgaagccgactactactgcgcctccttcaccatcctaaacggcgtcgactacgtcttcggcaccggcaccaaagtcaccgtcctcctctccccctcccaaccctacctc

SEQ ID NO: 57640 - RNA, 360 nt, synthetic construct
  misc_feature 1..360: note = derived and/or modified sequence opt11 from anti-HIV_Chain
  source 1..360: mol_type = other RNA
aacttcatgctcacccaacccgcctccgtctccggctcccccggccaatccatcaccctctcctgcaccggcaccacctccgacgtccgcgactccaacttcgtctcctggtaccaacaagtccccggcaaagcccccaaactcatcatctacgacgtctccgcccgaccctccggcgtctccttccgcttctccggctccaaatccggcaacaccgcctccctcaccatctccggcctccaagccgaagacgaagccctctactactgctcctccttcacccccaccaacaccctcgtcttcggcggcggcaccaaactaaccgtcctcggccaacccaaagccgccccctccgtcacc

SEQ ID NO: 57641 - RNA, 360 nt, synthetic construct
  misc_feature 1..360: note = derived and/or modified sequence opt11 from anti-HIV_Chain
  source 1..360: mol_type = other RNA
caatccgccctcacccaaccccccgccgcctccggcgcccccggccaacgagtcaccatctcctgctccggcggcggctccaacgtcggcggcaacctcgtctcctggtaccaacaattccccggcgccgcccccaaacttatcctccaccgcgacggccaacgcccctccggcgtccccgaccgcttctccgcctccaaatccggcacctccgcctccctcaccatctccggcctccgctccgacgacgaagccacctacttctgcgccgcctacgactccgccgtctccctccccgtcttcggcggcggcaccaaactcaccgtactctcccaacccaaagccgcccccctcgtcacc

SEQ ID NO: 57642 - RNA, 360 nt, synthetic construct
  misc_feature 1..360: note = derived and/or modified sequence opt11 from anti-HIV_Chain
  source 1..360: mol_type = other RNA
caactagtcctcacccaacccccctccgtctccggaacccccggccaaaacgtcaccatctcctgctccggcggcggctcccacgtcggcggcaacctcgtctcctggtaccaacacttccccggcgccgcccccaaactcctcatccaccgcgacaaccaacgcccctccggcgtccccgaccgcttctccgccctcaaatccggcaactccgcctccctcgccatctccggcctccgctccgacgacgaagccttctacttctgcgccgtctacgactcctccctctccctcggcctcttcggcggcggcaccaaactcaccgtcctctcccaacccaaagccgccccctccgtcacc

SEQ ID NO: 57643 - RNA, 360 nt, synthetic construct
  misc_feature 1..360: note = derived and/or modified sequence opt11 from anti-HIV_Chain
  source 1..360: mol_type = other RNA
gacatccaaatgacccaatcaccctcctccctctccgcctccgtcggcgaccgcgtctccatccactgccaagccggccaaggcatcggctcctccctcaaatggtaccaacaaaaatccggccgcgccccccgcctcctcgtccacggcgcctcaaacctccaacgcggcgtcccctcccgcttctccggctccggcttccacaccaccttcaccctcaccatctcctccctccaaccagacgacgtcgccacctactggtgcgccgtcctcgaattcttcggccccggcaccaaagtcgaaatcaaacgcaccgtcgccgccccctccgtcttcatcttccccccctccgacgaacaa

SEQ ID NO: 57644 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctctccgcctccgtcggcgaccgtgtcaccatcacctgccaagcctcccaaggcatcggctcctccctccaatggtaccaacaaaaacccggccgagcccccaaactcctcgtccacggcgcctccaacctccaccgcggcgtcccctcccgcttctccggctccggcttccacacctccttcaccctcaccatctcctccctccaacccgacgacgtcgccacctacttctgcgccgtcctcgaattcttcggccccggcaccaaagtcgaaatcaaacgcaccgtcgccgccccctccgtcttcatcttccccccctccgacgaacaa

SEQ ID NO: 57645 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctctccgcctcagtcggcgaccgcgtctccatcaactgccaagccggccaaggcatcggctcctccctcaactggtaccaacaaaaacgcggcaaagcccccaaactcctcgtccacggcgcctccaccctccaacgcggcgtcccctcccgcttctccggctccggcttccacaccaccttcaccctcaccatctcctccctccaacccgacgacgtcgccacctacttctgcgaatccttccaatggttcggccccggcaccaaagtcgaaatcaaacgcaccgtcgcagccccctccgtcttcatcttccccccctccgacgaacaa

SEQ ID NO: 57646 - RNA, 360 nt, synthetic construct
  misc_feature 1..360: note = derived and/or modified sequence opt11 from anti-HIV_Chain
  source 1..360: mol_type = other RNA
tacatccaaatgacccaatccccctcctccctctccgcctccatcggcgaccgcgtcaccatcacatgccaagcaggccaaggcatcggctcctccctcaactggtaccaacaaaaacccggcaaagcccccaaactcctcgtccacggcgcctccaacctccaacgcggcgtctcctcccgcttctccggctccggcttccacaccaccttcaccctcaccatctcctccctccgacccgaagacgtcggcacctacttctgcgaagtctacgaattcatcggccccggcaccaaagtcgacatcaaacgcaccgtcgccgccccctccgtcttcatcttccccccctccgacgaacaa

SEQ ID NO: 57647 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctccccgcctcagtcggcgacaccgtcaccatcacctgccaagccggccaaggcatcggctcctccctccaatggtaccaacaacgccccggccgcgcccccaacctcctcgtctacgacgcctccaacctccaacgcggcgtcccctcccgcttcaccggcaccggcttccacaccaccttcaccctcaccatccgcggcctccgccccgaagacttcggcacctacttctgcgcctccctcgaattcttcggccccggcaccaaagtcgacatcaaacgcaccgtcgccgccccctccgtcttcatcttccccccctccgacgaacaa

SEQ ID NO: 57648 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctctccgcctccgtcggcgaccgcgtcaccatcacctgccaagcctcccaaggcatcggctcctccctccaatggtaccaacaaaaacccggccgcgcccccaacctcctcgtccacggcgcctccaacctccaccgcggcgtcccctcccgcttctccggctccggcttccacaccaccttctccctcaccatctccggccttcaacgcgacgacttcgccacctacttctgcgccgtcctcgaattcttcggccccggcaccaaagtcgacatcaaacgcaccgtcgccgccccctccgtcttcatcttccccccctccgacgaacaa

SEQ ID NO: 57649 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctctccgtctccgtcggcgaccgcgtctccatcacctgccgcgccacccaaggcatcggcaactccctcaactggtaccaacaaaaacccggcaaagcccccaaagtcctcatctacggcaccaccaaactccacggcggcgtcccctcccgcttctccggcggcggctccggctccacaggcaccctcaccatcgactccctccaacccgaagacatcgccacctacttctgccaactcttcgaattcttcggccccggcaccaaagtcgaaatcaaacgcaccgtcgccgccccctccgtcttcatcttccccccctccgacgaacaa

SEQ ID NO: 57650 - RNA, 360 nt, synthetic construct
  misc_feature 1..360: note = derived and/or modified sequence opt11 from anti-HIV_Chain
  source 1..360: mol_type = other RNA
gacatccaaatgacccaatccccctcctccctctccgcctccgtcggcgaccgcgtcaccatcacctgccaagccggccaaggcatcggctcctccctcaactggtaccaacaaaaacccggccgcgcccccaaactcctcgtctacggcgcctccaacctccaacgcggcgtcccctcccgcttctccggctccggcttccacaccaccttcaccctcaccatctcctccctccaacccgaagacttcgccacctacttctgctcagtctacgaattcctcggccccggcaccaaagtcgaaatcaaacgcaccgtcgccgccccctccgtcttcatcttccccccctccgacgaacaa

SEQ ID NO: 57651 - RNA, 360 nt, synthetic construct
  misc_feature 1..360: note = derived and/or modified sequence opt11 from anti-HIV_Chain
  source 1..360: mol_type = other RNA
ccgatgtttcaaccgggacagagcgggggagtagtggtgcaaagtggagagagcttgcacttgagctgtgaagcgagcgggttcaagttcgcgagccagatgatgcactgggtaaggcacgtgccagggagagggctagagtgggtggcattgataagttgggatggatcgggaaagctatttgcagatagcgtgagggggaggtttacgatacacaggtggaatgacaggaacagtctatatctagatgtaaagaacgtgaggccggaagatgcagcgatatattactgtacaaggaacgggttcgatgtatgggggcagggaatactggtgacagtgagctcggcatcgacaaaggga

SEQ ID NO: 57652 - RNA, 363 nt, synthetic construct
  misc_feature 1..363: note = derived and/or modified sequence opt11 from anti-HIV_HeavyChain
  source 1..363: mol_type = other RNA
gaagtcaaactcgtcgaatccggcggcggcctcgtccaacccggcggctccctccgcctatcctgcgccgcctccggcttcaccttctcctccttcggcatgcactgggtccgccaagcccccgaaaaaggcctcgaatgggtcgcctacatctcctccggctcctccaccctccactacgccgacaccgtcaaaggccgcttcaccatctcccgcgacaactccaaaaactccctctacctccaaatgaacctcctccgcgccgaagacaccgccgtctactactgcgcccgcggctcccgcaacctctcccaccgcctcctctcctactggggccaaggcaccctcgtcaccgtctcctcc

SEQ ID NO: 57653 - RNA, 363 nt, synthetic construct
  misc_feature 1..363: note = derived and/or modified sequence opt11 from anti-HIV_HeavyChain
  source 1..363: mol_type = other RNA
gaggtccagctcgtggaatcgggcgggggcctggtccagcccgggggctcgctcaggctctcgtgcgcggcctcgggctttacctttagctcgttcgggatgcattgggtgcgccaggccccgggcaagggcttggaatgggtctcgtacataagctcgggctcgagcacgctccattacgcggacacggtcaagggcaggttcacgatctcgcgcgataactcgaaaaatagcttgtacttgcaaatgaactcgctcagggccgaggacacggccgtgtactattgcgcgcgcgggagcaggaacttgagccatcgcttgctctcgtactggggccagggcacactcgtgaccgtgagctcg

SEQ ID NO: 57654 - RNA, 363 nt, synthetic construct
  misc_feature 1..363: note = derived and/or modified sequence opt11 from anti-HIV_Chain
  source 1..363: mol_type = other RNA
gacatccaaatgacacaatccccctcctccctctccgcctccgtcggcgaccgcgtcaccatcacctgccaagcctcccaaggcatctccaactccctcaactggtaccaacaaaaacccggcaaagccccccgcctcctcatctacggcacctccaccctccaacgcggcgtcccctcacgcttctccggctccggctccggcacccgcttcaccgtcaccatcaactccctccaacccgaagacatcgccacctacttctgccaacacaacgaattcttcggccgcggcaccaaagtcgacatcaaacgcaccgtcgccgccccctccgtcttcatcttccccccctccgacgaacaactc

SEQ ID NO: 57655 - RNA, 363 nt, synthetic construct
  misc_feature 1..363: note = derived and/or modified sequence opt11 from anti-HIV_Chain
  source 1..363: mol_type = other RNA
gacatccaaatgacccaatccccctcctccgtctccgcctccgtcggcgaccgcgtcaccatcacctgccaagcctcccgcgacaccgacaactccctcacctggtaccaacaaaaacccggccgcccccccaaactcctcatctaccacgtcgtcaacctcggccccggcgtcccctcccgcttctccggctccgcctcctccgccacccaatccaccctcatcatctccgacttccaacccgacgacgtcgccacctacttctgccaaaactacgaattcttcggccccggcaccaaagtcgaaatcaaacgcaccgtcgccgccccctccgtcttcatcttccccccctccgacgaacaa

SEQ ID NO: 57656 - RNA, 363 nt, synthetic construct
  misc_feature 1..363: note = derived and/or modified sequence opt11 from anti-HIV_Chain
  source 1..363: mol_type = other RNA
gaaatcgtcctcacccaatcccccggcaccctctccctctcccccggcgaacgcgccaccctatcctgccgcgcctcccaatccgtctcctccaacaacctagcctggtaccaacaaaaacccggccaagccccccgcctcctcatgtccggcgcctcctcccgcgccaccggcatccccgaccgattctccggctccggctccggcaccgacttcaccctcaccatctcccgcctcgaacccgaagacttcgccgtctaccactgccaacaatacggctcctccccccccaccttcggccaaggcaccaaagtcgaaatcaaacgcaccgtcgccgccccctccgtcttcatcttccccccc

SEQ ID NO: 57657 - RNA, 363 nt, synthetic construct
  misc_feature 1..363: note = derived and/or modified sequence opt11 from anti-HIV_Chain
  source 1..363: mol_type = other RNA
gacatccaaatgacccaatccccctcctccctctccgcctacgtcggcgaccgcgtcaccatcacctgccgcgcctcccaaaacatcaacacctacctcaactggtaccaacaacgccccggcaaagcccccaaactcctcatctacgccgcctccaccctccaatccggcgtcccctcccgcttctccggctccggctccggcaccgacttcaccctcaccatctccaacctcgaaaccgaagacttcgccgtctactactgccaacaaacctaccgctccgtcaccttcggccaaggcaccaaactcgaaatcaaacgcaccgtcgccgccccctccgtcttcatcttccccccctccgac

SEQ ID NO: 57658 - RNA, 363 nt, synthetic construct
  misc_feature 1..363: note = derived and/or modified sequence opt11 from anti-HIV_Chain
  source 1..363: mol_type = other RNA
gacatccaaatgacccaatcaccctcctccctctccgcctccgtcggcgaccgcgtcaccatcacctgccaagccggccaaggcatcggctcctccctccaatggtaccaacaaaaacccggcaaagcccccaaactcctcgtccacggcgcctccaacctccaccgcggcgtcccctcccgcttctccggctccggcttccacaccaccttctcactcaccatctccggcctccaacgcgacgacttcgccacctacttctgcgccgtcgtcgaattcttcggccccggcaccaaagtcgacataaaacgcaccgtcgccgccccctccgtcttcatcttccccccctccgacgaacaactt

SEQ ID NO: 57659 - RNA, 363 nt, synthetic construct
  misc_feature 1..363: note = derived and/or modified sequence opt11 from anti-HIV_Chain
  source 1..363: mol_type = other RNA
caagtgcaattggtcgagagcggggccgagctcaggaaaccgggcgagagcctggaaataagctgtaaagcgagcgggtactcgttctcgagccattggataggctgggccaggcaaatgcccgggaaagggctcgagtggatgggcataatctatcccggggactcgaacacgatctatagcccgagctttcaagggcaagtgaccataagcgcggacaagagcataaacacggcctatctccagtggtcgagcttgaaagcgagcgataccgcgatgtatttctgtgcctcgaactatcacgattacttttactggggccagggcacgctcgtgaccgtgagctcggcctcgaccaagggc

SEQ ID NO: 57660 - RNA, 363 nt, synthetic construct
  misc_feature 1..363: note = derived and/or modified sequence opt11 from anti-HIV_Chain
  source 1..363: mol_type = other RNA
tttgtccagctcgtggaatcgggcgggggcgtggtccagcccgggacctcgctcaggctctcatgcacgacatcgggctttatctttagcgattacgggatgcattgggtgcgccaggccgcgggcaagggcttggaatgggtcgcggtcatatggcatgacgggagcaatcgattttacgcggactcggtcaagggcagattcacgatctcgcgcgataactcgaaaaatgccgtgtacttggaaatgaacaatctcagggtcgaggacacggccttgtactattgcgcgcgcacgagcatggacatagactattgggggcaagggaccccggtcacggtctcgagcgcgagcacgaaaggg

SEQ ID NO: 57661 - RNA, 363 nt, synthetic construct
  misc_feature 1..363: note = derived and/or modified sequence opt11 from anti-HIV_Chain
  source 1..363: mol_type = other RNA
gagcccatgttccagcccgggcaatcgggcggggtcgtggtccagagcggggaatcgctccatctctcgtgcgaggcctcgggctttaaatttgcctcgcaaatgatgcattgggtgcgccatgtcccgggcaggggcctggaatgggtcgcgctcataagctgggacgggagcgggaaattgttcgcggactcggtcaggggcaggttcacgatccatcgctggaacgatcgcaatagcttgtacttggacgtgaaaaatgtcaggcccgaggacgcggccatatactattgcacgcgcaatggctttgacgtgtgggggcaagggatcttggtcacggtctcgagcgcgagcacgaaaggg

SEQ ID NO: 57662 - RNA, 366 nt, synthetic construct
  misc_feature 1..366: note = derived and/or modified sequence opt11 from anti-HIV_Chain
  source 1..366: mol_type = other RNA
agccagcacctggtccagagcgggacacaggtcaagaaaccgggcgcgagcgtgcgcataagctgccaagcgagcgggtactcattcacggactacgtcctgcactggtggaggcaagcgcccgggcaagggctcgagtggatgggctggatcaagcccgtgtacggggccaggaactacgccaggcgctttcaagggcgcataaactttgacagggacatatacagggaaatagccttcatggacctctcgggcttgagatcggacgataccgcgctctatttctgtgccagggacgggagcggggacgatacctcgtggcacctagatccctggggccagggcacgctcgtaatcgtgagcgcg

SEQ ID NO: 57663 - RNA, 366 nt, synthetic construct
  misc_feature 1..366: note = derived and/or modified sequence opt11 from anti-HIV_Chain
  source 1..366: mol_type = other RNA
gacatccaaatgacccaatccccctcctccctctccgcctccgtcggcgaccgcgtcaccatcacctgccgcgcctcccaatccatctcccgatacctaaactggtaccaacaaaaacccggcaaagcccccaaactcctcatctacgccgcctcctccctccaaggcggcgtcccctcacgcttctccggctccggctccggcaccgacttcaccctaaccatctcctcactccaacccgaagacttcgccacctactactgccaacaatcctcctccaaacccttcaccttcggcggcggcaccaaagtcgaaatcaaacgcaccgtcgccgccccctccgtcttcatcttccccccctccgac

SEQ ID NO: 57664 - RNA, 366 nt, synthetic construct
  misc_feature 1..366: note = derived and/or modified sequence opt11 from anti-HIV_Chain
  source 1..366: mol_type = other RNA
gaaatcgtcctcacccaatcccccggcaccctctccctttcccccggcgaacgcgccaccctctcctgccgcgcctcccaatccatctcctccaactacctcgcctggtaccaacaaaaacccggccaagccccccgcctcctcatctacggcgcctccacccgcgccaccggcatccccgaccgattctccggctccggctccggcaccgacttcaccctctccatctcccgcctcgaacccgaagacatcgccgtctactactgccaccaatacggctcctcccaacgcttcggccaaggcaccaaagtcgaaatcaaacgcaccgtcgccgccccctcagtcttcatcttccccccctccgac

SEQ ID NO: 57665 - RNA, 366 nt, synthetic construct
  misc_feature 1..366: note = derived and/or modified sequence opt11 from anti-HIV_Chain
  source 1..366: mol_type = other RNA
gaaatcgtcatgacccaatcccccgccaccctctccgtctcccccggcgaccgcgccaccctctcctgccgcgcctcccaatccgtctccaccaacctcgcctggtaccaacaaaaacccggccaagccccccgcctcctcatctacggcgcctccacccgcgccaccggaatccccgccaccttctccggctccggcttcgccaccgaattcaccctcaccatatcctccctccaatccgaagacttcgccgtctactactgccaacaatacaacaactggccccccgccttcggccaaggcaccaaagtcgaaatcaaacgcaccgtcgccgccccctccgtcttcatcttccccccctccgac

SEQ ID NO: 57666 - RNA, 366 nt, synthetic construct
  misc_feature 1..366: note = derived and/or modified sequence opt11 from anti-HIV_Chain
  source 1..366: mol_type = other RNA
gacatccaaatgacccaatcccccgcctccctctccgcctccgtcggcgaccgcgtcaccatcacctgccgcgcctcccaaggcatctcccactacctagcctggtaccaacaaaaacccggcaaagtcccccgcctcctcatctacgccgcctcccgcctccaatccggcgtcacctcccgcttctccggctccggctccggcaccgaattcaccctcacaatctcctccctcctccccgaagacgccgccgtctacttctgccaaaaatacgacaccgaccccatgaccttcggccaaggcacccgcctcgaaatcaaacgcaccgtcgccgccccctccgtcttcatcttccccccctccgac

SEQ ID NO: 57667 - RNA, 366 nt, synthetic construct
  misc_feature 1..366: note = derived and/or modified sequence opt11 from anti-HIV_Chain
  source 1..366: mol_type = other RNA
caatccgccctcacccaacccccctccgcctccggcgcccccggccaacgcgtcaccatctcctgctccggcggcccctccaacgtcggcggcaactacgtctactggtaccgccaattccccggcaccgcccccaacctcctcatcctccgcgacgaccaacgcccctccggagtccccgaccgcttctccgcctccaaatccggcaactccgcctccctcgccatctccggcctccgccccgacgacgaagccttctacttctgcgccacctacgactccgacggctccatccgcctcttcggcggcggcaccacactaaccgtcctctcccaacccaaagccgccccctccgtcacactcttc

SEQ ID NO: 57668 - RNA, 366 nt, synthetic construct
  misc_feature 1..366: note = derived and/or modified sequence opt11 from anti-HIV_Chain
  source 1..366: mol_type = other RNA
gacatccaaatgacccaatccccctcctccctctccgcctccgtcggcgaccgcgtcaccatcaactgccaagccggccaaggcatcggctcctccctcaactggtaccaaaaaaaacccggccgcgcccccaaactcctcgtccacggcgcctccaacctccaacgcggcgtcccctcccgcttctccggctccggcttccacaccaccttcaccctcaccatctcctccctccaacccgacgacgtcgccacctacttctgcgccgtcttccaatggttcggccccggcaccaaagtcgacatcaaacgcaccgtcgccgccccctccgtcttcatcttccccccctccgacgaacaactcaaa

SEQ ID NO: 57669 - RNA, 366 nt, synthetic construct
  misc_feature 1..366: note = derived and/or modified sequence opt11 from anti-HIV_Chain
  source 1..366: mol_type = other RNA
gacatccaaatgacccaatccccctcctccctctccgcatccgtcggcgaccgcgtcaccatcacctgccaagcctcccaaggcatcggctcctccctccaatggtaccaacaaaaacccggccgcgcccccaacctcctcgtccacggcgcctccaaactccaccgcggcgtcccctcccgcttctccggctccggcttccacaccaccttctccctcaccatctccggcctccaacgcgacgacttcgccacctacttctgcgccgtcctcgaattcttcggccccggcaccaaagtcgaaatcaaacgcaccgtcgccgccccctccgtcttcatcttccccccctccgacgaacaactcaaa

SEQ ID NO: 57670 - RNA, 366 nt, synthetic construct
  misc_feature 1..366: note = derived and/or modified sequence opt11 from anti-HIV_Chain
  source 1..366: mol_type = other RNA
caagtccacctcgtacaatcaggcgcagaagtaaaaaaacccggcgcctcagtcaaagtctcctgcaaagtctccggctacaccctaagcgaactctcaatccactgggtacgccaaggcccaggccgcggcctagaatggatggccaacttcgacccagaagacggcgaaaccatatacgcaccccaattccaaggcagggtcacactcacagaagacacctcaaccgacaccgcatacatgcaactaacctcactaagaagcgaagacacagccgtctactactgcgcaaccgaccgctacaccgacaccgggcgctggggcccaggcacactcgtaaccgtcagctcagcctcaaccaaaggc

SEQ ID NO: 57671 - RNA, 366 nt, synthetic construct
  misc_feature 1..366: note = derived and/or modified sequence opt11 from anti-HIV_Chain
  source 1..366: mol_type = other RNA
caggtgcagttggtggagagtgggggggggttgatacagccgggggggagcttgaggttgagctgtgaggcgagtgggtttgcggtgggggatataaattatatgagttgggtgaggcaggcgccagggaaggggttggagtgggtgagtgtgttgtacagtggggggagtagtcagtatgcggatagcgtgaaggggaggtttacgataagcagggataatagtaggaatacgctgtatctgcagatggataatttgagggcggaggatacggcggtatattattgtgcgagggggttgagggtgtattttgatctgtgggggcaggggatattggtgacggtgagtagtgcgagcacgaagggg

SEQ ID NO: 57672 - RNA, 366 nt, synthetic construct
  misc_feature 1..366: note = derived and/or modified sequence opt11 from anti-HIV_Chain
  source 1..366: mol_type = other RNA
caggtccagatggtggcctcgggcgggggcttggtcaagcccgggggctcgctcaggctctcgtgcgaggcctcgggctttacctttagcgattactatatgtcgtgggtgcgacaggcaccgggcaagggcttggaatggatctcgtacataacctcgggcgggaacgcgctctattacgcggactcggtcaagggcaggttcacgatctcgcgcgataacgcgaaaaatagcttgtacttgcaaatgaactcgctcagggccgaggacacggccgtgtactattgcgcgcgcgatctcttgcacgcgcacgatttcgggcgccagggcacgctcgtgaccgtgagctcggcctcaaccaagggc

SEQ ID NO: 57673 - RNA, 366 nt, synthetic construct
  misc_feature 1..366: note = derived and/or modified sequence opt11 from anti-HIV_Chain
  source 1..366: mol_type = other RNA
caactccaactcgtcgaatccggcggcggcgtcgtccaacccggccgctccctccgcctctcctgcgccgcctccggcttcaccttctccacctacaccatgcactgggtccgccaagcccccggcaaaggcctcgaatgggtcgccgtcatctcctacgacggcaccaacaaatactacgccgactcagtcaaaggccgcttcaccatctcccgcgacaactccaaaaacaccctctacctccaaatgaactccctccgcggcgaagacaccgccgtctactactgcgcccgctccccctcctactacttcgactactggggccaaggcaccctcgtcaccgtctccgccgcctccaccaaaggc

SEQ ID NO: 57674 - RNA, 369 nt, synthetic construct
  misc_feature 1..369: note = derived and/or modified sequence opt11 from anti-HIV_Chain
  source 1..369: mol_type = other RNA
caagtgcacctgagccagagcggggccgcggtcacgaaaccgggcgcgagcgtgcgcgtgagctgtgaagcgagcgggtacaagatctcggaccatttcatacactggtggaggcaagcgcccgggcaagggctccagtgggtgggctggatcaatcccaagaccgggcaaccgaacaatcccaggcaatttcaagggcgcgtgagcttgaccaggcaagcgagctgggactttgacacgtactcgttctatatggatctcaaggccgtgcgctcggacgataccgcgatctatttctgtgccaggcaaaggagcgatttctgggactttgacgtgtgggggagcgggacccaggtcacggtctcgagc

SEQ ID NO: 57675 - RNA, 369 nt, synthetic construct
  misc_feature 1..369: note = derived and/or modified sequence opt11 from anti-HIV_Chain
  source 1..369: mol_type = other RNA
caagtccaactcctccaatccggcgccgtcgtcacaaaacccggcgcctcagtccgcgtctcctgcgaagcctcaggctacaaaatccgcgactacttcatccactggtggcgccaagcccccggccaaggcctccaatgggtcggctggatcaacccccaaaccggccaacccaacatcccccgccccttccaaggccgcgtcaccctcacccgccacgcctcctgggacttcgacacattctccttctacatggacctcaaagccctccgctccgacgacaccgccatctacttctgcgcccgccgacgctccgactactgcgacttcgacgtctggggctccggcacccacgtcaccgtctcctcc

SEQ ID NO: 57676 - RNA, 369 nt, synthetic construct
  misc_feature 1..369: note = derived and/or modified sequence opt11 from anti-HIV_Chain
  source 1..369: mol_type = other RNA
caagtccaactcctccaatccggcgccgccgtcaccaaacccggcgcctccgtccgcgtctcctgcgaagcctccggctacaacatccgcgactacttcatccactggtggcgccaagcccccggccaaggcctccaatgggtcggctggatcaaccccaaaaccggccaacccaacaacccccgccaattccaaggccgcgtctcactcacccgccacgcctcctgggacttcgacaccttctccttctacatggacctcaaaggcctccgctccgacgacaccgccatctacttctgcgcccgccaacgctccgactactgggacttcgacgtctggggctccggcacccaagtcaccgtctcatcc

SEQ ID NO: 57677 - RNA, 369 nt, synthetic construct
  misc_feature 1..369: note = derived and/or modified sequence opt11 from anti-HIV_Chain
  source 1..369: mol_type = other RNA
caagtgcaattgctccagagcggggccgcggtcacgaaaccgggcgcgagcgtgcgcgtgagctgtgaagcgagcgggtacaatatcagggactatttcatacactggtggaggcaagcgcccgggcaagggctccagtgggtgggctggatcaatcccaagaccgggcaaccgaacaatcccagactctttcaagggcgagtgagcctgaccaggcacgcgagctgggactttgacacgttctcgttctatatggatctcaaggccgtgcgctcggacgataccgcggtctatttctgtgccaggcaaaggagcgattactgggactttgacgtgtgggggagtgggacccaggtcacggtctcgagc

SEQ ID NO: 57678 - RNA, 369 nt, synthetic construct
  misc_feature 1..369: note = derived and/or modified sequence opt11 from anti-HIV_Chain
  source 1..369: mol_type = other RNA
caagtccgcctcctccaatccggcgccgccgtcaccaaacccggcgcctccgtccgcgtctcctgcgaagcctccggctacgaaatccgcgactacttcatccactggtggcgccaagcccccggccaaggcctccaatgggtcggctggatcaaccccaaaaccggccaacccaacaacccccgccaattccaaggccgcgtctccctcacccgccaagcctcatgggacttcgactcatactccttctacatggacctaaaagccctacgctccgacgacaccggcgtctacttctgcgcccgccaacgctccgactactgggacttcgacgtctggggctccggcacccaagtcaccgtctcctcc

SEQ ID NO: 57679 - RNA, 369 nt, synthetic construct
  misc_feature 1..369: note = derived and/or modified sequence opt11 from anti-HIV_Chain
  source 1..369: mol_type = other RNA
caagtccaactcctccaatccggcgccgccgtcaccaaacccggcgcctccgtccgcgtctcctgcgaagcctccggctacaacatccgcgactacttcatccactggtggcgccaagcccccggccaaggcctacaatgggtcggctggatcaaccccaaaaccggccaacccaacaacccccgccaattccaaggccgcgtctcactcacccgccacgcctcctgggacttcgacaccttctccttctacatggacctcaaagccctccgctccgacgacaccgccgtctacttctgcgcacgccaacgctccgactactgggacttcgacgtctggggctccggcacccaagtcaccgtctcatcc

SEQ ID NO: 57680 - RNA, 369 nt, synthetic construct
  misc_feature 1..369: note = derived and/or modified sequence opt11 from anti-HIV_Chain
  source 1..369: mol_type = other RNA
gaagtgcaattggtcgagagcgggggcgggctcatacaaaggggcgggagcttgcgcttgagctgtgtcgcgagcgggttcccggtctcggacaatcacatgagctgggtcaggcaagcacccgggaaagggctcgagtgggtgagcataatctatagcgatggcgggacctattacgcggactcggtcaagggcaggttcacgatctcgcgcgataactcgaaaaataccgtgtacttgcaaatgaactcgctcagggccacggacacggccgtgtactattgcgcgcgcgatcccgggttccattacgggctcgatgtctggggccagggcacgaccgtgaccgtgagctcggcctcgaccaagggc

SEQ ID NO: 57681 - RNA, 369 nt, synthetic construct
  misc_feature 1..369: note = derived and/or modified sequence opt11 from anti-HIV_Chain
  source 1..369: mol_type = other RNA
caagtgcaattgcaagagagcgggcccgggctcttgcgcccgctcgagaccttgagcttgacctgtagcgtgagcgggggctcgatcaggggctatttctggagctgggtcaggcaaccggccgggcgcgggctcgagtggataggcaggatctatagctcgggcacgaccaggttcaatccctcgctcaagagcagggtcaggctatcgatcgataccgcgaaatcggaagtgagcctgaacataacctcggtcacggccgcggactcggcctcgtacttttgcgcgggcacgagcccggtccatggcgggctcgatctctggggcttgggcttgcgcgtgaccgtaagttcggcctcgaccaagggc

SEQ ID NO: 57682 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcacccggcaccctctccctctcccccggcgaacgcgccaccctctcctgccgcgcctcccaatccgtctcctccaacctcgcctggtacgcccaaaaacccggccaagcaccccgcctcatcatctacggcgcctcctcccgagcctccgccatccccgaccgcttccgcggctcaggctccggcaccgacttcaccctcaccatctcccgcctcgaacccgaagacttcgccgtctactactgccaacaatacgacgacgcccccatcaccttcggccacggcacccgcctcgaaatcaaacgcaccgtcgccgccccctccgtcttcatcttcccaccctccgacgaa

SEQ ID NO: 57683 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccggcaccctctccctctcccccggcgaccgcgccgccctctcctgccgcgcctccgaaaccctctccggcaactccctcgcctggtaccaacaaaaacgaggccaacccccccgcctcctcatcttcgccgcctcctcccgcgccaccggcatccccgaacgcttctccggcggcggctcaggcaccgacttcaccctcaccatcacccgcctcgaacccgaagacttcgccgtctacttctgccaacaatacgtcgacgcacccatcaccttcggccaaggcacccgcctcgaaatcaaacgcaccgtcgccgccccctccgtcttcatcttccccccatccgac

SEQ ID NO: 57684 - RNA, 369 nt, synthetic construct
  misc_feature 1..369: note = derived and/or modified sequence opt11 from anti-HIV_Chain
  source 1..369: mol_type = other RNA
gacatccaaatgacccaatccccctcctccctctccgcctccgtcggcgaccgcgtcaccatcacctgccgcgcctcccaagacatcaccacctacctcgcctggctccaacaaaaacccggcaaagcacccaaatccctcatctactccgcctccaccgtccaatccggcgtcccatcccgcttctccggctccggctccggcaccgaattcaccctcaccatctccggcctccaacccgaagacttcgccacctactactgccaacaatacaactactaccccatcaccttcggcctcggcacccgcctcgaaatcaaacgcaccgtcgccgccccctccgtcttcatcttccccccctccgacgaa

SEQ ID NO: 57685 - RNA, 369 nt, synthetic construct
  misc_feature 1..369: note = derived and/or modified sequence opt11 from anti-HIV_Chain
  source 1..369: mol_type = other RNA
gacatccaaatgacccaatccccctcctccctctccgcctccatcggcgaccgcgtcaccatcacctgccgcgccaaccaacacatccgctccttcctcaactggtaccaacaaacccccggcaaagcccccaaactcctcatctacgccgcctccaccctccaacgcggcgtcccctcccgcttctccggctccggctccggcaccgacttcaccctcaccatcacctccctcgaacgcgaagacctcgccacctactactgccaacaaacctacacctcccccatcaccttcggccaaggcacccgcctcgaaatcaaacgcaccgtcgccgccccctccgtattcatcttccccccctcagacgaa

SEQ ID NO: 57686 - RNA, 369 nt, synthetic construct
  misc_feature 1..369: note = derived and/or modified sequence opt11 from anti-HIV_Chain
  source 1..369: mol_type = other RNA
tcagaaatcgtcctcacccaatcccccgccaccctctcactctcacccggcgaatccgccacactctcctgccgcgcctcccaatccctctcctcctccctcgcctggtaccaacaaaaacccggccaagccccccgcctcctcatctacgacacctccgaccgcgccaccggcatccccgcccgattctccggccgcggctccggcaccgacttcaccctcaccatctcctccctcgaacccgaagacttcgccgtctactactgccaacaacgatccaactgggccatcaccttcggccaaggcacccgcctcgaaatcaaacgcaccgtcgccgccccctccgtcttcatcttccccccctccgac

SEQ ID NO: 57687 - RNA, 369 nt, synthetic construct
  misc_feature 1..369: note = derived and/or modified sequence opt11 from anti-HIV_Chain
  source 1..369: mol_type = other RNA
caagtcctctccgtctccggcacccccggccaacgcgtcatcatctcctgctccggcacatcctccaacgtcggcggcaacctcgtctcctggtaccaacacctccccggcgccgccccccgcctcctaatccaccgagacgaccaacgcccctccggcgtccccgaccgcttctccggatccaaatccggcaactccgcctccctcgtcatctccggcctccgctccgacgacgaagccgactacttctgcgccgcctacgactccaccttctccctccccgtcttcggcggcggcacccgcctaaccgtcctctcccaacccaaagccgccccctccgtcaccctctacgccccctcctccgaagaa

SEQ ID NO: 57688 - RNA, 369 nt, synthetic construct
  misc_feature 1..369: note = derived and/or modified sequence opt11 from anti-HIV_Chain
  source 1..369: mol_type = other RNA
gacatccaaatgacccaatccccctcctccctctccgcctccgtcggcgaccgcgtcaccatcacctgccaagccggccaaggcatcggctcctccctccaatggtaccaacaaaaacccggcaaagcccccaaactcctcgtccacggcgcctccaacctccaccgcggcgtcccctcccgcttctccggctccggcttccacaccaccttctccctcaccatctccggcctccaacgcgacgacttcgccacctacttctgcgccgtcctcgaattcttcggccccggcaccaaagtcgaaatcaaacgcaccgtcgccgccccctccgtcttcatcttccccccctccgacgaacaactcaaatcc

SEQ ID NO: 57689 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccgccaccctatccctctcccccggcgaacgcgccaccctctcctgccgcgcctcccaaggcctcaacttcgtcgtctggtaccaacaaaaacgcggccaagcaccccgcctcctcatccacgccccctccgaccgcgcccccggcgtccccgaccgcttctccgcccgcggctccggcaccgacttctccctcgtcatctcctccgtcgaacccgacgacttcgccatctactactgccaagaatactcctccaccccctacaacttcggccccggcacccgcgtcgaccgaaaacgaaccgtcgccgccccctccgtcttcatcttccccccctccgacgaacaa

SEQ ID NO: 57690 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccaccaccctctccctctcccccggcgaacgcgccaccctctcctgccgcgcctcccaaggcgtcaacctcgtcgtctggtaccaacaaaaacgcggccaagccccccgcctcctcatctacggcccctcagaccgcgcccccggcgtccccgaccgcttctccgcccgcggctccggcaccgaattctccctcgtcatctcctccgtcgaacccgacgacttcgccctctactactgccaagaatactcctccaccccctacaacttcggcaccggcacccgcgtcgaccgcaaacgcaccgtcgccgccccctccgtcttcatcttccccccctcagacgaacaa

SEQ ID NO: 57691 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccgcaaccctctccctatcccccggagaacgcgccaccctctcctgccgcgcctcccaaggcgtcaacttcgtcgtctggtaccaacaaaaacgcggccaagccccccgcctcctcatctacggcccctccaaccgagcccccggcgtccccgaccgcttctcagcccgcggctccggcaccgaattctccctcgtcatctcctccgtcgaacccgacgacttcgccctctactactgccaagaatactcctccaccccctacaacttcggccccggcacccgcgtcgaccgcaaacgaaccgtcgccgccccctccgtattcatcttccccccctccgacgaacaa

SEQ ID NO: 57692 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccgccaccctctccctctcccccggcgaacgcgccaccctctcctgccgcgcctcccaaggcctcaacttcgtcgtctggtaccaacaaaaacgcggccaagccccccgcctcctcatccacggcccctcccaccgagcccccggcgtccccgaccgcttctccgcccgcggatccggaaccgaattctccctcgtcatctcctccgtcgaaccagacgacttcgccatctactactgccaagaatactcctccaccccctacaacttcggccccggcacccgcgtcgaccgcaaacgcaccgtcgccgccccctccgtcttcatcttccccccctccgacgaacaa

SEQ ID NO: 57693 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccgccaccctctccctctcccccggcgaacgcgccaccctctcctgccgcgcctcccaaggcctcaacttcgtcgtctggtaccaacaaaaaggcggccaagccccccgcctcctcatccacggccccaccgaccgcgcccccggcgtccccgaccgcttctccgcacgcggctccggcaccgaattctcactcgtcatctcctccgtcgaaccagacgacttcgccctctactactgccaagaatactcctccaccccctacaacttcggccccggcacccgcgtcgaccgcaaacgcaccgtcgccgccccctccgtcttcatcttccccccctccgacgaacaa

SEQ ID NO: 57694 - RNA, 369 nt, synthetic construct
  misc_feature 1..369: note = derived and/or modified sequence opt11 from anti-HIV_Chain
  source 1..369: mol_type = other RNA
gaaatcgtcctcacccaatcccccgcaaccctctccctctcccccggcgaacgcgccaccctctcctgccgcgcctcccaaggcctcaacttcgtcgtctggtaccaacaaaaacgcggccaagccccccgcctactcatccacgccccctcaggccgcgcccccggcgtccccgaccgcttctccgcccgcggctccggcaccgaattctccctcgtcatctcttcagtcgaacccgacgacttcgccatctactactgccaagaatactcctctaccccctacaacttcggccccggaacccgcgtcgaccgcaaacgcaccgtcgccgccccctcagtcttcatcttccccccctccgacgaacaa

SEQ ID NO: 57695 - RNA, 369 nt, synthetic construct
  misc_feature 1..369: note = derived and/or modified sequence opt11 from anti-HIV_Chain
  source 1..369: mol_type = other RNA
caagtccaactagtccaatccggcgccgaagtcaaaaaacccggctcctccgtcaaagtctcatgcaaaacctccggcggctccttctccaactacgccttctcctgggtccgccaagcccccggcgaaggcctcgaatggatgggccgcatcatccccatcttcggcaccgccaaatacacccaaaaactccaaggccgcgtcaccatcaccgccgacaaattcacctccaccgtctacatggaactctcctcactccgctcagaagacaccgccatctactactgcgcctccctccaccaaggccccatcggctacaccccctggcacccccccccccgcgcccccctcggccaatccgtctgcggc

SEQ ID NO: 57696 - RNA, 369 nt, synthetic construct
  misc_feature 1..369: note = derived and/or modified sequence opt11 from anti-HIV_Chain
  source 1..369: mol_type = other RNA
caagtccaactcgtcgaatccggcggcggcctagtccaacccggcggctccctccgcatctcctgctccgcaaccggcttcaccttctccacccacgccatgcactgggtccgccaagcccccggcaaaggcctcgaatacgtctccgccatcaactccaacggccgctccgccttctacgccgactccgtcaaaggccgcgtcaccatctcccgcgacaactccaaaaacaccctcttcctccaaatgacctccctccgcgccgaagacaccgccgtctactactgcgtcaaaggccccctcctccgctacctcgactcctggggccaaggcaccctcgtcaccgtctcctccgcctccaccaaaggc

SEQ ID NO: 57697 - RNA, 369 nt, synthetic construct
  misc_feature 1..369: note = derived and/or modified sequence opt11 from anti-HIV_Chain
  source 1..369: mol_type = other RNA
gaagtgcaattggtcgagagcgggggcgggctagtgcaaccgggcgggagcttgcgcataagctgtagcgcgaccgggttcacgttctcgacccatgccatgcactgggtcaggcaagcgcccgggaaagggctcgagtacgtgagcgcgatcaatagcaatggcaggagcgcgttctatgccgatagtgtgaaagggcgcgtgaccataagcagggacaatagcaagaacacgctctttctccagatgacgagcttgcgcgcggaagataccgcggtctattactgtgtcaagggcccgctcttgcgctatctagatagctggggccagggcacgctcgtgaccgtgagctcggcctcgaccaagggc

SEQ ID NO: 57698 - RNA, 369 nt, synthetic construct
  misc_feature 1..369: note = derived and/or modified sequence opt11 from anti-HIV_Chain
  source 1..369: mol_type = other RNA
gaagaatccggccccggcctcgtaaaaccctcccaaaccctctccctcacctgctccgtatccggcgactccgtctcatccggcggctatttctggtcctggatccgccaacaccccaccaaaggcctcgaatgcctcggctacgtctactacaccggcaacacctactacaacccctccctcaaatccccccccaccatcgaagtcgccatggccaacaaccaagtctccctcaaactcggctcagtcaccgccgccgacaccgccgtctactactgcgcccgcatcaaacgcttccgcggcggcaactacttcgacacctggggccacggcctactcgtcaccgtctcctccgcctccaccaaaggc

SEQ ID NO: 57699 - RNA, 369 nt, synthetic construct
  misc_feature 1..369: note = derived and/or modified sequence opt11 from anti-HIV_Chain
  source 1..369: mol_type = other RNA
caagtccagctccaggaatcgggctcgggcttggtcaagccctcgggcacgctatcgctaacgtgcgcggtctcaaacgggcccataagctcgggcaattggtggagctgggtcaggcaaacgcccgagaaagggctcgagtggataggcgaggtctatcactcgggctcgaccaatcacaatccctcgctaaagagcagggccacgatcttggtcgataaatcgaaaaatcaattcagcttgaacttgcgctcggtcacggccgcggacacggccgtgtactattgcgcgcgagtgcgcgggagctggaactttgactattgggggcaagggatcctggtcacggtctcgagcgcgagcacgaaaggg

SEQ ID NO: 57700 - RNA, 369 nt, synthetic construct
  misc_feature 1..369: note = derived and/or modified sequence opt11 from anti-HIV_HeavyChain
  source 1..369: mol_type = other RNA
gaagtgcaattgcaacagagcgggaccgtgctcgcgcgcccgggcgcgagcgtgaaaatgagctgtaaagcgagcgggtacacgttcacgagctattggatgcactgggtcaagcaaaggcccgggcaagggctcgagtggataggcgcgatctatcccgggaactcggacacgagctataaccagaaatttaaagggaaagcgaaattgaccgcggtcacgagcgcgagcacggcctatatggagctctcgagcttgaccaatgaagatagcgcggtctattactgtaccaggtggccgcactattacgggggctcgcgctattactttgactattgggggcaagggaccacgctcacggtctcaagc

SEQ ID NO: 57701 - RNA, 372 nt, synthetic construct
  misc_feature 1..372: note = derived and/or modified sequence opt11 from anti-HIV_Chain
  source 1..372: mol_type = other RNA
gtggtccagctcgtggaatcgggcgggggcttggtccagcccgggggatcgctcaggctatcgtgcgcggcctcgggctttgcctttcgctcgtactggatgtcgtgggtgcgccaggccccgggcaggggcttggaatgggtcgcgaacataaaacaggacgggagcgagaaatattacgcggactcggtcaagggcaggttcacgatctcgcgcgataacacgaaaaatagcttgtacttgcaaatgaactcgctcagggccgaggacacggccgtgttctattgcgcgagcaggggcgatcgctatggcccgatcgattactggggccagggcacgctcgtgaccgtgagctcggcctcgaccaagggc

SEQ ID NO: 57702 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccgaaatcaaaaaacccggcgaatcactcaaaatctcctgcaaagcctccggctacaccttcaacgactactggatcggctgggtccgacaaatgcccggcaaaggcctcgaatggatgggcatcttctaccccgacgactccgactcaaactactccccctccttccaaggccgcgtcaccatctccgccgacaaatcaatcaccaccgcctacctccaatggtcaaccctcaaagcctccgactccgccatgtacttctgcgcccgcctcctcggcgactccggcgccttcgacatctggggccaaggcaccatggtcatcgtctcctcagcctccaccaaaggc

SEQ ID NO: 57703 - RNA, 372 nt, synthetic construct
  misc_feature 1..372: note = derived and/or modified sequence opt11 from anti-HIV_Chain
  source 1..372: mol_type = other RNA
caggtccagctcgtgcaatcgggcgggggcttggtcaagcccgggggctcgctcaggctatcgtgcgcggcctcgggctttacctttagctcgtactcgatgaattgggtgcgccaggccccgggcaagggcttggaatgggtctcgagcataagctcgagctcgagctatatctattacgcggactcggtcaagggcaggttcacgatctcgcgcgataacgcgaaaaatagcttgtacttgcaaatgaactcactcagggccgaggacacggccgtgtactattgcgcgcgcgagggctcgtactattacgggatggatgtctggggacagggcacgaccgtgaccgtgagctcggcctcgaccaagggc

SEQ ID NO: 57704 - RNA, 372 nt, synthetic construct
  misc_feature 1..372: note = derived and/or modified sequence opt11 from anti-HIV_Chain
  source 1..372: mol_type = other RNA
gaaatcgtcctcacccaatcccccgccaccctctccgtctcccccggcgaacgagccaccctctcctgccgcgccggccaatccgtctcctccgacctcgcctggtaccaacacaaacccggccaagccccccgcctcctcatctacgacgcctccaaacgcgccaccggcatccccgcccgcttctcaggctccggctcaggcaccgacttcaccctcaccatctcctccctcgaacccgaagacttcgccgtctactactgccaacaccgcacaaactggcccccctccatcaccttcggacaaggcacccgactcgaaatcaaacgcaccgtcgccgccccctccgtcttcatcttccccccctccgac

SEQ ID NO: 57705 - RNA, 372 nt, synthetic construct
  misc_feature 1..372: note = derived and/or modified sequence opt11 from anti-HIV_Chain
  source 1..372: mol_type = other RNA
gaaatcgtcctcacccaatcccccggcaccctctccctctcccccggcgaacgcgccaccctctcctgccgcgcctcccaatccgtctcctcccgctacctcgcctggtaccaacaaaaacccggccaagccccccgcctcatcatctacgacgcctcctcccgcgcctcaggcatccccgaccgcttctccggctccggatccgaaaccgacttcaccctcaccatcacccgcctagaacccgaagacttcgccgtctactactgccaactctacggcacctcccccaaattcaccttcggccaaggcaccaaactcgaaatcaaacgcaccgtcgccgccccctccgtcttcatcttccccccctccgac

SEQ ID NO: 57706 - RNA, 372 nt, synthetic construct
  misc_feature 1..372: note = derived and/or modified sequence opt11 from anti-HIV_Chain
  source 1..372: mol_type = other RNA
gaaatcgtcctcacccaatcccccggcaccctctccctctcccccggcgaacgcgccaccctctcctgccgcgcctcccaatccgtctccaacaactacctcgcctggtaccaacaaaaacccggccaagccccccgcctactcatatacggcgcctcctcccgagccaccggcatccccgaccgcttctcaggctcaggctccggcaccgacttcaccctcaccatctcacgcctcgaacccgaagacttcgccgtctactactgccaacaatacgcaacctcctccctctacaccttcggccaaggcaccaaactagaaatcaaacgcaccgtcgccgccccctccgtcttcatcttccccccctccgac

SEQ ID NO: 57707 - RNA, 372 nt, synthetic construct
  misc_feature 1..372: note = derived and/or modified sequence opt11 from anti-HIV_Chain
  source 1..372: mol_type = other RNA
cccgccaccctcgccgtctcccccggcgaacgcgccaccatctcctgcaaatcctcccaaaacctcctctactccgccaacaaccaacactccctcgcctggtaccaacaacgccccggccaaccccccaaactactcctctactgggcctccacccgcctctccggcgtccccgaccgcttctctggctccggctccggcaccgacttcaccctcaccatctccaacctacaagccgaagacgtcgccgtctactactgccaacaatactactcacccccccccaccttcggccaaggcaccaaagtcgaaatccgccgcaccgtcgccgccccctccgtcttcatattccccccctccgacgaacaactc

SEQ ID NO: 57708 - RNA, 372 nt, synthetic construct
  misc_feature 1..372: note = derived and/or modified sequence opt11 from anti-HIV_Chain
  source 1..372: mol_type = other RNA
caacccgtcctcacccaacccccctccgcctccggcgcccccggccaacgcgtcaccatctcctgctccggcggcccctccaacgtcggcggcaactacgtctactggtaccgccaattccccggcaccgcccccaacctactcatcctccgcgacgaccaacgcccctccggcgtccccgaccgcttctcagcctccaaatccggcaactccgcctcactcgccatcaccggcctccgccccgacgacgaagccttctacttctgcgccacatacgactccgacggctccatccgcctcttcggcggcggcaccgccctcaccgtcctctcccaacccaaagccgccccctccgtcaccctcttccccccc

SEQ ID NO: 57709 - RNA, 372 nt, synthetic construct
  misc_feature 1..372: note = derived and/or modified sequence opt11 from anti-HIV_Chain
  source 1..372: mol_type = other RNA
aacttcatgctcacacaacccccctccgcctccggcgcccccggccaacgcgtcaccatctcctgctccggcggcccctccaacgtcggcggcaactacgtctactggtaccgccaattccccggcaccgcccccaacctcctcatcctccgcgacgaccaacgcccctccggcgtccccgaccgcttctccgcctccaaatccggcaactccgcctccctcgccatctcaggcctccgccccgacgacgaagccttctacttctgcgccacctacgactccgacggctccatccgcctcttcggcggcggcaccaccctcaccgtcctctcccaacccaaagccgccccctccgtcaccctcttccccccc

SEQ ID NO: 57710 - RNA, 372 nt, synthetic construct
  misc_feature 1..372: note = derived and/or modified sequence opt11 from anti-HIV_Chain
  source 1..372: mol_type = other RNA
gacatccaaatgacccaatccccaccctcactatccgcctccgtaggcgaccgcgtcaccatcacctgccaagcctcccaagacatcaacaacttcctcaactggtaccaacaaaaacccggcaaagccccccgcctcctcatctacgacgcctccaacctcgaatccggcgtctcctcccgcttctccggctcccgctccggcaccgacttcaccctcaccatctcctccctcctccccgaagacatcgccacctactcctgccaacaatactccaacctcccctacaccttctcccaaggcaccaaactcgaaatcaaacgcaccgtcgccgccccctcagtcttcatcttccccccctccgacgaacaa

SEQ ID NO: 57711 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcaccgccgtcaaacgccccggcgcctccgtccgcgtctcctgccaagcctccggctacaccttcatcgaccacttcatctactggtggcgccaagcccccggccaaggcctcgaatggctcggctggatcaaccccctcacctcccaaccctcctacccctcccgcttccaaggccgcctcaccctcacccgcgacaccttcgacgaaatgctctacatggacctccgcggcctccgctccgacgacaccggcatctacttctgcgcccgccgccactccgactactgcgacttcgacatctggggctccggcacccaaatcatcgtctcctccgcctccaccaaaggc

SEQ ID NO: 57712 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccgccctcaaaaaacccggcgcctccctccgcatctcctgccaagcctacggctacaaattcaccgaccacctcatctactggtggcgccaagcccccggccaaggcctcgaatggatcggctggatcaaacccgaaaccggccaaccctcctactcctacaaattccaaggacgcgtctccctaacccgcgacaccttccaagaaatcctcttcatggacctccgcggcctccgctccgacgacaccgccatctacttctgcgcccgacgccactccgactactgcgacttcgacgtctggggctccggctcccaagtcatcgtctcctccgcctccaccaaaggc

SEQ ID NO: 57713 - RNA, 372 nt, synthetic construct
  misc_feature 1..372: note = derived and/or modified sequence opt11 from anti-HIV_Chain
  source 1..372: mol_type = other RNA
caagtccaactcgtccaatcaggcgccgccctcaaaaaacccggcgcctcactccgcatctcctgccaaacctacggctacaaattcaccgaccacctcatctactggtggcgccaagcccccggccaaggactcgaatggatgggctggatcaaacccgaaaccggccaaccctcctactcctaccgcttccaaggccgcgtctccctcacccgcgacaccttcgaagaaatcgtcttcatggacctccgcggcctccgatccgacgacaccgccatctacttctgcgcccgccgccactccgactactgcgacttcgacgtctggggctccggctcccaagtcatcgtctcctccgcctccaccaaaggc

SEQ ID NO: 57714 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgcgctcaagaaaccgggagcgagcttgcgcataagctgtcaaacgtacgggtacaagttcacggaccatctcatatactggtggagacaagcgcccgggcaagggctcgagtggataggctggatcaagcccgagaccgggcaaccgagctatagctatcgatttcaagggcgcgtgagcttgaccagggacacgttcgaggaaatagcctttatggatctcaggggcttgcgctcggacgataccgcgatctatttctgtgccaggcgccacaccgactactgtgtctttgacgtgtgggggagcgggagccagatcatagtctcgagcgcgagcacgaaaggg

SEQ ID NO: 57715 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcaccgccgtcaaacgccccggcgcctccgtccgcgtctcctgccaagcctccggctacaccttcaccgactacttcatctactggtggcgccaagcccccggccaaggcctcgaatggctcggctggatcaaccccctaacctcccaaccctcatacccctcccgcttccaaggccgcctcacactcacccgagacaccttcgacgaaatgctctacatggacctccgcggcctccgctccgacgacaccggcatctacttctgcgcccgccgccactccgactactgcgacttcgacatctggggctccggcacccaaatcatagtctcctccgcctccaccaaaggc

SEQ ID NO: 57716 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccgccctcaaaaaaccaggcgcctccgtccgcatctcctgccaagcctacggctacaaattcaccgaccacctcatctactggtggcgccaagcccccggccaaggcctcgaatggatcggctggatcaaacccgaaaccggccaaccctcctacgcctacaaattccaaggccgcgtcaccctcacccgcgacaccttcgaagaaatccacttcatggacctccgcggagtccgcaacgacgacaccgccacctacttctgcgcccgccgccactccgactactgcgacttcgacgtctggggctccggctcccaagtcatcgtctcctccgcctcaaccaaaggc

SEQ ID NO: 57717 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgcgctcaagaaaccgggcgcgagcgtgcgcataagctgtcaaacgtacgggtacaagttcacggaccatctcatatactggtggaggcaagcgcccgggcaagggctcgagtggataggctggatcaagcccgagaccgggcaaccgagctatagctatcgctttcaagggcgcgtgagcttgaccagggacacgttcgaggaaatagtctttatggatctcaggggcttgcgctcggacgataccgcgatctatttctgtgccaggcgccatagcgattactgtgactttgacgtgtgggggagcgggagccaggtcttggtctcgagcgcgagcacgaaaggg

SEQ ID NO: 57718 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccgccctcaaaaaacccggcgcctccctccgcatctcctgccaaacctacggctacaaattcaccgaccacctcatctactggtggcgccaagcccccggccaaggcctcgaatggatcggctggatcaaaccagaaaccggccaaccctcctactcctaccgcttccaaggccgcgtctccctcacccgcgacaccttcgaagaaatcgtcttcatggacctccgcggcctccgctccgacgacaccgccatctacttctgcgcccgccgccactccgactactgcgacttcgacgtctggggctccggctcccaagtcctcgtctcctccgcctcaaccaaaggc

SEQ ID NO: 57719 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgcgctcaagaaaccgggcgcgagcgtgcgcataagctgtcaaacgtacgggtacaagttcacggaccatctcatacactggtggaggcaagcgcccgggcaagggctcgagtggataggctggatcaagcccgataccgggcaaccgagttatagctcgcgctttcaagggcgcgtgagcttgaccagggacacgttcgaggaaatagtctttatggatctcaggggcttgcgctcggacgataccgcaatctatttctgtgccaggcgccatagcgattactgtgactttgacgtgtgggggagcgggagccaggtcttggtctcgagcgcgagcacgaaaggg

SEQ ID NO: 57720 - RNA, 372 nt, synthetic construct
  misc_feature 1..372: note = derived and/or modified sequence opt11 from anti-HIV_Chain
  source 1..372: mol_type = other RNA
caagtccaactcgtccaatccggagccgccctcaaaaaacccggagcctccctacgcatctcctgccaaacctacggctacaaattcaccgaccacctcatctactggtggcgccaagcacccggccaaggcctcgaatggatcggctggatcaaacccgaaaccggccaaccctcctactcctaccgcttccaaggccgcgtctccctcacccgagacaccttcgaagaaatcgtcttcatggacctccgcggcctccgctccgacgacaccgccatctacttctgcgcccgccgccactccgactactgcgacttcgacgtctggggctccggctcccaagtcatcgtctcctccgcctccaccaaaggc

SEQ ID NO: 57721 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgcgctcaagaaaccgggggcgagcttgcgcataagttgtcaaacgtacgggtacaagttcacggaccatctaatatactggtggaggcaagcgcccgggcaagggctcgagtggataggctggatcaagcccgagaccgggcaaccgagctatagctatcgctttcaagggcgagtgagcttgaccagggacacgttcgaggaaatagtctttatggatctcaggggcttgcgctcggacgataccgcgatctatttctgtgccaggcgacatagcgattactgtgactttgacgtgtggggcggcgggagccaggtcatagtctcgagcgcgagcacgaaaggg

SEQ ID NO: 57722 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccgccctcaaaaaacccggcgcctccctacgcatctcctgcctcacctacggctacaaattcaccgaccacctcatctactggtggcgccaagcccccggccaaggcctcgaatggatcggctggatcaaacccgaaaccggccaaccctcctactcctaccgcttccaaggccgcgtctccctcacccgcgacaccttcgaagaaatcgtcttcatggacctccgcggcctccgctccgacgacaccgccatctacttctgcgcccgccgacactccgactactgcgacttcgacgtctggggctccggctcacaagtcatcgtctcctccgcctccaccaaaggc

SEQ ID NO: 57723 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccaccctcaaaaaacccggcgcctccgtccgcatctcctgccaagcctacggctacaaattcaccgaccacctcatccactggtggcgccaagcccccggccaaggcctcgaatggatcggctggatcaaacccgaaaccggccaaccctcctacgcctacaaattccaaggccgcgtctccctcacccgcgacaccttcgaagaaatcctcttcatggacctacgcggcctacgctccgacgacaccgccatctacttctgcgcccgccgccactccgactactgcgacctcgacgtctggggcggcggcacccaactcctcgtctcctccgcctccaccaaaggc

SEQ ID NO: 57724 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgcgctcaagaaaccgggcgcgagcgtgcgcataagctgtcaagcgtacgggtacaagttcacggaccatctcatatactggtggaggcaagcgcccgggcaagggctcgagtggataggctggatcaagcccgagaccgggcaaccgagctatagctataaatttcaagggcgcgtgaccttgaccagggacacgttcgaggaaatacactttatggatctcaggggcttgcgctatgacgataccgcgacctatttctgtgccaggcgccatagcgattactgtgactttgacgtgtgggggagcgggagccaggtctcggtctcgagcgcgagcacgaaaggg

SEQ ID NO: 57725 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcgccgccctcaaaaaacccggcgcctccctccgaatctcctgccaagcctacggctacaaattcacagaccacctcatctactggtggcgacaagcccccggccaaggcctcgaatggatcggctggatcaaacccgaaaccggccaaccctcctactcctacaaattccaaggccgcgtctccctcacccgcgacaccttccaagaaatcctcttcatgaacctccgcggcctccgctccgacgacaccgccatctacttctgcgcccgccgccactccgactactgcgacttcgacgtctggggctccggctcccaaatcctagtctcctcagcctccaccaaaggc

SEQ ID NO: 57726 - RNA, 372 nt, synthetic construct
  misc_feature 1..372: note = derived and/or modified sequence opt11 from anti-HIV_Chain
  source 1..372: mol_type = other RNA
caagtccaactcgtccaatccggcaccgccgtcaaaaaacccggcgcctccgtccgcgtctcctgccaagcctccggctacaccttcaccgactacttcatctactggtggcgccaagcccccggccaaggcctcgaatggctcggctggatcaacccccgcacatcccaaccctcctacccctaccgcttccaaggccgagtcaccctcacccgcgacatcttcgaagaaatgctctacatggacctccgcggcctccgctccgacgacaccggcatctacttctgcgcccgccgccactccgactactgcgacttcgacatctggggctccggcacccaaatcatcgtctcctccgcctccaccaaaggc

SEQ ID NO: 57727 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgcgctcaagaaaccgggggcgagcctgcgcataagctgtcaagcgtacgggtacaagttcacggactatctcatacactggtggaggcaagcgcccgggcaagggctcgagtggataggctggatcaagcccgagaccgggcaaccgagctatagctataaatttcaagggcgcgtgagcttgaccagggacacgttcgaggaaatactctttatggatctcaggggcttgcgatcggacgataccgcgatctatttctgtgccaggcgccatagcgattactgtgactttgacgtgtggggcggcgggagccaggtcttggtctcgagcgcgagcacgaaaggg

SEQ ID NO: 57728 - RNA, 372 nt, synthetic construct
  misc_feature 1..372: note = derived and/or modified sequence opt11 from anti-HIV_Chain
  source 1..372: mol_type = other RNA
gaagtacaactactcgaatccggcggcgccctcgtccaacccggcggctccctccgcctctcctgcgccgcctccggcttcaccttctccacctcctccatgtcatgggtccgccaagcccccggcaaaggcctcgaatgggtctccgccatcggctccggccgcggctccaccttctacgccgactccgtcaaaggccgcttcaccatctcccgcgacaactccaaaaacaccctctccctccaaatgaactccctcaccgccgaagacaccgccacctactactgcaccaaaaccggcggcctactccgcttccccgaagtctggggcaaaggcaccaccgtcaccgtctcctccgcatccaccaaaggc

SEQ ID NO: 57729 - RNA, 372 nt, synthetic construct
  misc_feature 1..372: note = derived and/or modified sequence opt11 from anti-HIV_Chain
  source 1..372: mol_type = other RNA
gaagtccaactcgtcgaatccggcggcggcctcgtcaaacccggcggctccctccgcctctcctgcgccgactccggcttcaccttccgctcctactccatgcactgggtccgccaagcccccggcaaaggcctcgcctgggtctcatccatctcctcaacctccaactacatctactacgccgactccgtcaaaggccgcttcacaatctcccgagacaacgccaaaaactccctctacctccaaatgaactccctccgcgccgaagacaccgccgtctactactgcgcccgcaccttcatcaccgcctcctggttcgactcctggggccaaggcaccctcgtcaccgtctcctccgcctccaccaaaggc

SEQ ID NO: 57730 - RNA, 372 nt, synthetic construct
  misc_feature 1..372: note = derived and/or modified sequence opt11 from anti-HIV_Chain
  source 1..372: mol_type = other RNA
caagtgcaattggtccagagcggggccgaggtcaagaaaccgggcgcgagcgtgaaagtgagctgtaaagcgagcgggtacacgttcacgaactatggcgtgagctgggtcaggcaagcgcccgggcaagggctcgagtggatgggctggatctcgccctatagcgggaacacgaactatgcccagcgcttgcaagatcgcgtgaccatgaccacggacacgagcacgaacacggcctatatggagctcaggagcttgcgctcggacgataccgcggtctattactgtgccgcgcgatcgtactattactatagcatggacgtatgggggcaagggaccacggtcacggtctcgagcgcgagcacgaaaggg

SEQ ID NO: 57731 - RNA, 372 nt, synthetic construct
  misc_feature 1..372: note = derived and/or modified sequence opt11 from anti-HIV_Chain
  source 1..372: mol_type = other RNA
caagtccaactcgtacaatccggcgccgaactcaaaaaacccggctcctccgtcaaagtctcctgcaaagcctccggcggcaccttctccaactacgccatcaactgggtccgccaagcccccggccaaggcttcgaatggatgggcggcatcatccccctattcgccacccccacctacgcccaaaaattccaaggccgcgtccgcatcaccgccgacgactccacctccaccgcctacatggaactctcctcactccgctccgacgacaccgccgtctacttctgcgcccgccccaacgtcgtccgctccgcactcgactactggggccaaggcaccctcgtcaccgtctcctcagcctccaccaaaggc

SEQ ID NO: 57732 - RNA, 372 nt, synthetic construct
  misc_feature 1..372: note = derived and/or modified sequence opt11 from anti-HIV_Chain
  source 1..372: mol_type = other RNA
caggtccagctcgtggaatcgggcgggggcgtggtccagcccgggaaatcgctcaggctctcgtgcgcggcctcgggctttacctttagcacgcacgcgatgcattgggtgcgacaggccccgggcaagggcctggactgggtcgcggtcataagccatgacggggacaatcaatattacgcggacgcggtcaagggcaggttcacgatctcgcgcgatgactcgcgcgataccgtgttcttgcaaatgaactcgctcaggaccgaggacacgggcgtgtactattgcgcggccgatagctcaggctcgaactggttcgattactggggccagggcatactcgtgaccgtgagctcagcctcgaccaagggc

SEQ ID NO: 57733 - RNA, 375 nt, synthetic construct
  misc_feature 1..375: note = derived and/or modified sequence opt11 from anti-HIV_Chain
  source 1..375: mol_type = other RNA
caagtgcgactgagccagagcggaggccagatgaagaaaccgggcgagagcatgcgcttgagctgtcgcgcgagcgggtacgagttcttgaactgtcccataaactggatcaggctcgcgcccgggcgcaggcccgagtggatgggctggctcaagcccaggggcggggccgtgaactatgccaggaaatttcaagggcgagtgaccatgaccagggacgtatactcagacacggcctttctcgagctcaggagcttgacctcggacgataccgcggtctatttctgtaccaggggcaagtactgtaccgcgcgcgattactataactgggactttgaacactgggggcgcggggccccggtcacggtctcgagc

SEQ ID NO: 57734 - RNA, 375 nt, synthetic construct
  misc_feature 1..375: note = derived and/or modified sequence opt11 from anti-HIV_Chain
  source 1..375: mol_type = other RNA
gaagtccaactcgtccaatcaggctccgacgtccgcaaacccggcgccaccgtcaccgtctcctgcaaagccgacgaagacgaagacgacttcaccgcctacaactacttcatgcactgggtccgccaagcccccggccacggcctcgaatggatcggctggatcaacccccgcaccggccaacccaaccacgccaaacaattccaaggccgcgtcacactcacccgcgaacgctccacatcaaccgtcttcatgaaactcaccaacctccgcctcgacgacaccgcagtctacttctgcgccagacccctccgaggcggcgacacctggcactaccactcctggggccgcggcacctccctcaccgtctcatca

SEQ ID NO: 57735 - RNA, 375 nt, synthetic construct
  misc_feature 1..375: note = derived and/or modified sequence opt11 from anti-HIV_Chain
  source 1..375: mol_type = other RNA
caagtccaactcgtccaatccggcggcggcctcgtccaacccggcgaatccctccgcctctcctgcaccgcctccggcttcaccttctcctcctacaacatgaactgggtccgccaagcccccggcaaaggcctcgaatggatctcctacatctccgacaaatccaaaaacaaatactacgccgactccgtccgcggccgcttcaccatctcccgcgacaacgcccaaaactccctcttcctccaaatgtcctcactccgcgacgaagacaccgccgtctactactgcacccgcgaaggcccccaacgctccttctacttcgactactggggccaaggcatccaagtcaccgtctcctccgcctccaccaaaggc

SEQ ID NO: 57736 - RNA, 375 nt, synthetic construct
  misc_feature 1..375: note = derived and/or modified sequence opt11 from anti-HIV_Chain
  source 1..375: mol_type = other RNA
gaagtgcaattggtcgagagcggggccgaggtcaagaaaccgggctcgagcgtgaaagtgagctgtaaagcgagcggaggcacgttctcgagctatagcataagctgggtcaggcaagcgcccgggcaagggctcgagtggatgggcgggatcatacccatattcgcgaccacgcactatggccagaaatttcaagggcgcataaaaataaccgcggacaagagcacgagcacagcctatatggagctctcgcgcttgcgctcggaagataccgcggtctattactgtgccagggacagggaattttacttttacgggatggatgtctggggccagggcacgacagtgaccgtgagctcggcctcgaccaagggc

SEQ ID NO: 57737 - RNA, 375 nt, synthetic construct
  misc_feature 1..375: note = derived and/or modified sequence opt11 from anti-HIV_Chain
  source 1..375: mol_type = other RNA
caattgcaattgcaagagagcgggcccgggctcgtgaaaccgtgggagaccttggtcttgacctgtagcgtgagcgggggctcgatctcgagcggggactattactggggctggatcaggcaatcgcccgggaaagggcccgagtggataggcaatatcttttactcgagtgggaacacgtactataacacgagcttgaaatcgcgcgtgaccataagcgtggacgtgagcaagaacaggttctcgctcaagctcacgagcatgaccgcggccgataccgcggtctattactgtggcaggctctcgaacaagggctggttcgatccctggggccagggcacgctcgtgagcgtgagctcggcctcgaccaagggc

SEQ ID NO: 57738 - RNA, 375 nt, synthetic construct
  misc_feature 1..375: note = derived and/or modified sequence opt11 from anti-HIV_Chain
  source 1..375: mol_type = other RNA
gaaatcgtcctcacccaatcccccgccaccctctccctctcccccggcgaacgcgccaccctctcctgccgagcctcacaatccgtctcctcctacctcgcctggtaccaacaaaaacccggccaagccccccgcctcctcatctacgacgcctccaaccgcgccaccggcatccccgcccgcttctccggctccggctccgacaccgacttcaccctaaccatctcctccctcgaacccgaagacttcgccgtctactactgccaacaacgcggcatctggcccctccaaatcaccttcggccaaggcacccgcctcgaaatcaaacgcaccgtcgccgccccctcagtcttcatcttccccccctcagacgaa

SEQ ID NO: 57739 - RNA, 375 nt, synthetic construct
  misc_feature 1..375: note = derived and/or modified sequence opt11 from anti-HIV_Chain
  source 1..375: mol_type = other RNA
tccgaaatcgtcctcacccaatcccccggcaccctctccctctcccccggcgaacgcgccaccctctcctgccgcgcctcccaatccgtctcctcctcctacctcgcctggtaccaacaaaaacccgtccaagccccccgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggcaccctccacccccgcaccttcggccaaggcaccaaagtcgaaatcaaacgcaccgtcgccgccccctccgtcttcatcttccccccctccgac

SEQ ID NO: 57740 - RNA, 375 nt, synthetic construct
  misc_feature 1..375: note = derived and/or modified sequence opt11 from anti-HIV_Chain
  source 1..375: mol_type = other RNA
tcccaagccgtcgtcacacaacccccctccgtctccggcgcccccggccaacgcgtcaccatctcctgctccggcggcccctccaacgtcggcggcaacctcgtatactggtacaaacaattccccggcaccgcccccaaactcctcatccgccgcgacgaccaacgcccctccggcgtccccgaccgcttctccggctccaaatccggcaactccgcctccctcgccatctccggcctccgacccgacgacgaagccttctacttctgcgccacctacgactcccacggctccatccgcctcttcggcggcggcaccctcctcaccgtcctctcccaacccaaagccgccccctcagtcaccctcttccccccc

SEQ ID NO: 57741 - RNA, 375 nt, synthetic construct
  misc_feature 1..375: note = derived and/or modified sequence opt11 from anti-HIV_Chain
  source 1..375: mol_type = other RNA
gacatccaaatgacccaatccccctccaccctcgccgcctccatcggcggcaccgtccgcgtctcctgccgcgcctcccaatccatcaccggcaactgggtcgcctggtaccaacaacgccccggcaaagccccccgcctcctcatctaccgcggcgccgccctcctcggcggcgtcccctcacgcttctccggctccgccgccggcaccgacttcaccctcaccatcggcaacctccaagccgaagacttcggcaccttctactgccaacaatacgacacctaccccggcaccttcggccaaggcaccaaagtcgaagtcaaacgcaccgtcgccgccccctccgtcttcatcttccccccctccgacgaacaa

SEQ ID NO: 57742 - RNA, 375 nt, synthetic construct
  misc_feature 1..375: note = derived and/or modified sequence opt11 from anti-HIV_Chain
  source 1..375: mol_type = other RNA
gaaatcgtcatgacccaatcccccgacaccctctccgtctcccccggcgaacgcgccaccctctcctgccgcgcctcccaatccgtcaactccaacctagcctggtaccaacaaaaacccggccaagccccccgcctcctcatctacggcgcctccacccgcgccaccgccgtccccgcccgcttctccggctccggctccggcaccgaattcaccctcaccatctcctccctccaatccgaagactccgccgtctactactgccaacaatactaccaatggctctcctacaccttcggccaaggcaccaaactcgaaatcaaacgcaccgtcgccgccccctccgtcttcatcttccccccctccgacgaacaa

SEQ ID NO: 57743 - RNA, 375 nt, synthetic construct
  misc_feature 1..375: note = derived and/or modified sequence opt11 from anti-HIV_Chain
  source 1..375: mol_type = other RNA
cgccaagtccaactcgtccaatccggcgccgccctcaaaaaacccggcgcctccctccgcatctcctgccaagcctacggctacaaattcacagaccacctcatctactggtggcgccaagcccccggccaaggcctcgaatggatcggctggatcaaacccgaaaccggccaaccctcctactcctacaaattccaaggccgcgtctccctcacccgagacaccttccaagaaatcctcttcatggacctccgcggcctccgctccgacgacaccgccatctacttctgcgcccgccgccactccgactactgcgacttcgacgtctggggctccggctcccaaatcctcgtctcctccgcctccaccaaaggc

SEQ ID NO: 57744 - RNA, 375 nt, synthetic construct
  misc_feature 1..375: note = derived and/or modified sequence opt11 from anti-HIV_Chain
  source 1..375: mol_type = other RNA
caagtgcaattggtccagagcggggccgcgctcaagaaaccgggcgcgagcgtgcgcataagctgtcaagcgtacgggtacaagttcacggactatctcatacactggtggaggcaagcgcccgggcaagggctagagtggataggctggatcaagcccgagaccgggcaaccgagctatagttataaatttcaagggcgcgtgaccctgaccagggacacgttcgaggaaatactctttatggatctcaggggcctgcgctcggacgataccgcgatctatttctgtgccaggcgccatagcgattactgtgactttgacgtgtgggggagcgggagccaggtcatagtctcgagcgcgagcacgaaaggggcc

SEQ ID NO: 57745 - RNA, 375 nt, synthetic construct
  misc_feature 1..375: note = derived and/or modified sequence opt11 from anti-HIV_Chain
  source 1..375: mol_type = other RNA
gaagtgcaattggtcgagagcgggggcgggctcgtgaaaccgggcgggagcttgcgcttgagctgtgccgcgagcgggttctcgttctcggaacattacatgagctggatcaggctcgcgcccgggaaagggctcgagtggttgagttatatctcgagctcgaccaggaccacgtactcggccgatagcgtgcgcgggcgctttaccataagcagggacacggccaagcaattgctctttctccatatgtcgagcttgcgagcggaagataccgcggtctattactgtgtcaggctctatggcgggatcaatggctggttcgatcaatggggccagggcacgctagtgagcgtgagctcggcctcgaccaagggc

SEQ ID NO: 57746 - RNA, 375 nt, synthetic construct
  misc_feature 1..375: note = derived and/or modified sequence opt11 from anti-HIV_Chain
  source 1..375: mol_type = other RNA
caagtccaactcgtccaatccggacccggcctcgtcaaaccctccgaaaccctctccctcacctgctccgtctccaacggctccatctcctccggcggctactactggtcctggctccgccaattccccggcaaaggcctcgaatggatcggctccatccactacaccggccgcaccttctacaacccctccctcatgggccgcaccgccctctccatggacacctccaacaaccaattctccctcaaagtatcctccgtcaccgccgccgacaccgccctctactactgcgcccgcgaactccaatggatgttcgtcgtcgacccctggggccaaggcaccctcgtcaccgtctcctccgcctccaccaaaggc

SEQ ID NO: 57747 - RNA, 375 nt, synthetic construct
  misc_feature 1..375: note = derived and/or modified sequence opt11 from anti-HIV_Chain
  source 1..375: mol_type = other RNA
caagtccaactccaagaatccggccccggcctcgtcaaaccctccgaaaccctctccctaacctgctccgtctccaacggctccatctcctccggcggctactactggtcctggctccgccaattccccggcaaaggcctcgaatggatcggctccatccactacaccggccgcaccatgtacaacccctccctcatgggccgccccgccctctccatggacacctccaacaaccaattctccctcaaactccgctcagtcaccgccgccgacaccgccctctacttctgcgcccgcgacctccaatggatcttcgtcgtcgacccctggggccaaggcaccctcgtcaccgtctcctccgcctccaccaaaggc

SEQ ID NO: 57748 - RNA, 375 nt, synthetic construct
  misc_feature 1..375: note = derived and/or modified sequence opt11 from anti-HIV_Chain
  source 1..375: mol_type = other RNA
gaggtgcagttgttggagagtgggggggggctagtgcagccgggggggagtttgaggttgagttgtgcggtgagcgggtttacgtttgggggacatgcggtgagctgggtgaggcaggcgccggggaaggggctggagtggttgagtcagataagtgggacggggagtaggacggattatgcggatgcggtgaaggggaggtttacggtgagcagggataatagtaagaagacggtgtatttgcagatgaatagcttgagggtggaggatacggcgctgttttattgtgcgacgaggagtccggggggggggtatgcgttcgatatatgggggcagggggcgatggtgacggtgagcagtgcgagtacgaagggg

SEQ ID NO: 57749 - RNA, 375 nt, synthetic construct
  misc_feature 1..375: note = derived and/or modified sequence opt11 from anti-HIV_Chain
  source 1..375: mol_type = other RNA
caagtccaactcgtccaatccggcgccgaagtcaaaaaacccggctcctccgtcaaagtctcctgcaaagtctccttcttctccaactacggcatctcctgggtacgccaacgccccggccaaggcctcgaatggatgggccgcatcatccccgccatcgacgacatgacctacgcccaaaccttccgcggccgcgtcaccttctccgccgacaaattcaccaccaccgcctacatggaactcaccggcctcaccttcgaagacaccgccacctacttctgcgcccgcgacccccaagtcaaccgccgcggcaactgcttcgaccactggggccaaggcaccctcgtcaccgtctcctccgcctccaccaaaggc

SEQ ID NO: 57750 - RNA, 375 nt, synthetic construct
  misc_feature 1..375: note = derived and/or modified sequence opt11 from anti-HIV_Chain
  source 1..375: mol_type = other RNA
caagtccaactccaagaatccggccccggcctcgtcaaaccctccgaaaccctctccctcacctgcaccgtctccggcggctccatctcctactactactggtcctggatccgccaaccccccggcaaaggcctcgaatggatcggcgacatctactactccggaaccaccgactacaacccctccctcaaatcccgcgtcaccatctccgtcgacacctccaaaaaccaattctccctcaaactctcctccgtcaccgccgccgacaccgccgtctactactgcgcccgccgccgcggccaacgcctcctcgcctacttcgactactggggccaaggctccctcgtcaccgtctcctccgcctccaccaaaggc

SEQ ID NO: 57751 - RNA, 375 nt, synthetic construct
  misc_feature 1..375: note = derived and/or modified sequence opt11 from anti-HIV_Chain
  source 1..375: mol_type = other RNA
caagtccaactccaagaatccggccccggacccgtcaaaccctccgaaaccctctccctaacctgcaccgtctccggcggctccatgatctcctactactggtcctggatccgccaaccccccggcaaaggcctcgaatggatcggctacatcttcaccaacggccgcaccacctactcaccctccctccgctcccgcgtcaccatctccctcgacacctccaccaaccacttctccctccgcctcaaatcagtcaccgccgccgacaccgccatctactactgcgcccgcctcgacggcgaagccttccgctactaccttgacctctggggccaaggcaacctcgtcaccgtctcctccgcctccaccaaaggc

SEQ ID NO: 57752 - RNA, 375 nt, synthetic construct
  misc_feature 1..375: note = derived and/or modified sequence opt11 from anti-HIV_Chain
  source 1..375: mol_type = other RNA
caagtgcaattggtccagagcggggccgaggtcaagaaaccgggcgcgagcgtgaaagtgagctgtaaaccgagctcgaacacgttcacgagccattacatacactgggtcaggcaagcgcccgggcaagggctcgagtggatgggcatgatcaatcccgggggctcgaccaggtacgcgccaaagttccagggcagggtcacgctcacgcgcgatacctcgaccaggaccgtgtacatggaattaagctcgctaaggagcgaggacacggccgtgtactattgcgcgcgcccgcaatataacttgggcagagacccgctagatgtctggggcttgggcacgatggtgaccgtgagctcagcctcgaccaagggc

SEQ ID NO: 57753 - RNA, 375 nt, synthetic construct
  misc_feature 1..375: note = derived and/or modified sequence opt11 from anti-HIV_Chain
  source 1..375: mol_type = other RNA
caagtccaactccaacaatggggcgccggcctcctcaaaccctccgaaaccctctccctcacctgcgccgtctacggcggctccttctccggctactactggtcctggatccgccaaccccccggcaaaggcctcgaatggatcggcgaaatcaaccactccggctccaccaactacaacccctccctcaaatcccgcgtcaccatctccgtcgacacctcaaaaaaccaattctccctcaaactctcctccgtcaccgccgccgacaccgccgtctactactgcgcccgactccccatcggctccggctggtacggccgcgactactggggccaaggcaccctcgtcaccgtctcctccgcctccaccaaaggc

SEQ ID NO: 57754 - RNA, 375 nt, synthetic construct
  misc_feature 1..375: note = derived and/or modified sequence opt11 from anti-HIV_Chain
  source 1..375: mol_type = other RNA
caagtgcaattggtccagagcggggccgaggtcaagaaaccgggcgcaagcgtgaaagtgagctgtaaagcgagcgggaacacgttcacgagctatggcataacctgggtcaggcaagcgcccgggcaagggctcgagtggatgggctggatctcggcctataacgggaacacgaactatgcccagaaattgcaagatcgcttgaccatgaccacggacacgagcacgagcacggcctatatggagctcaggagcttgcgctcggacgataccgcggtctattactgtgcctttagcaggcactatggctcgggcaattacgattactggggccagggcacgctcgtgaccgtgagctcggcctcgaccaagggc

SEQ ID NO: 57755 - RNA, 375 nt, synthetic construct
  misc_feature 1..375: note = derived and/or modified sequence opt11 from anti-HIV_Chain
  source 1..375: mol_type = other RNA
caatttcgcttggtacagagcgggcccgaggtcaagaacccgggctcgagcgtgaccgtgagctgtaaagcgagcgggggcacgttctcgggcttgggcataaactgggtcaggcaagcgcccgggcaagggctcgagtggttgggcgatatcaagaccatgtacgggaccacaaactatgccccgaaatttcaagggcgcgtgaccataaccgcggacgagagcacgagcacgagctatatggagctctcgggcttgcgctcggaagataccgcggtcttttactgtgtcagggaattgttcgggcaccatcccgcgttcggggtctggggccagggcacgagcgtgatcgtgagctcggcctcgaccaagggc

SEQ ID NO: 57756 - RNA, 375 nt, synthetic construct
  misc_feature 1..375: note = derived and/or modified sequence opt11 from anti-HIV_Chain
  source 1..375: mol_type = other RNA
cgcgtgcaattggtccagagcggggccgaggtcaagaaaccgggctcgagcgtgaccgtgagctgtaaagcgagcgggggctcgttctcgagctatgccataagctgggtcaggcaagcgcccgggcaagggctcgagtgggtgggcggggtcaaggtaatgttcgggaccgtgcactatagccagaaagtgcaagggcgagtaaccataaccgcggacgatagcacgggcacgagctatctcgagctctcgggcttgcgctcggccgataccgcggtctattactgtgccaggaacgcgggcgcgtacttttacccgttcgatatctggggccagggcacgctcataatagtgagctcggcctcgaccaagggc

SEQ ID NO: 57757 - RNA, 375 nt, synthetic construct
  misc_feature 1..375: note = derived and/or modified sequence opt11 from anti-HIV_Chain
  source 1..375: mol_type = other RNA
caagtccaactccaagaatccggccccggcctcgtcaaaccctccgaaaccctctccctcacctgcaccgtctcaggcggctccatctcatcccgctcatactactggggctggatccgccaaccccccggcaaaggcctcgaatgggtcggctccatatactacaccggctccacctactactccccctccctcaaatcacgcgtcaccatctccgtcgacacctcccaaaaccaattctccctcaaactcaactccgtcaccgccgccgacaccgccgtctactactgcgcccgccaaaaaggatccggcacctccctcctctactggggccaaggcaccctagtcaccgtctcctccgcctccaccaaaggc

SEQ ID NO: 57758 - RNA, 375 nt, synthetic construct
  misc_feature 1..375: note = derived and/or modified sequence opt11 from anti-HIV_Chain
  source 1..375: mol_type = other RNA
caggtccagctagtgcaatcgggcacggaagtgaaaaagcccgggagctcggtcaaggtctcgtgcaaggcctcgggcgggacctttagcgatagcgatatcgcgtgggtgcgccaggccccgggccagggcttggaatggatgggcgggataaccccgatgtttgacatggccaagagcgcgcaaaagttcaggggcaggctcataatcacggccgataaatcgaccgggaccgcgtacatggaattgagctcgctcaggtacgaggacgcggccgtgtacttttgcgcgcgctcgagcgggaactttgaatttgcctttgaaatatgggggcaagggaccaagatcatagtctcgctcgcgagcacgaaaggg

SEQ ID NO: 57759 - RNA, 375 nt, synthetic construct
  misc_feature 1..375: note = derived and/or modified sequence opt11 from anti-HIV_Chain
  source 1..375: mol_type = other RNA
gtcgtgcaattggtccagagcgggaccgaggtcaagaaaccgggctcgagcgtgaaagtgagctgtaaagcgagcgggggcacgttctcgggctcggacataagctgggtcaggcaagcgcccgggcaagggctcgagtggatgggcgggatcatacccatgttcgatatcgaggaccatgcccagaaatttcgcgggcgattgaccataaccgcggacaagagcacgggcgcggcctatatggagctctcgagcttgcgctcggaagatgccgcggtctattactgtgccaggagctcgggcaattacgatttcgcgttcgatatctggggccagggcacgcgattgatagtgagctcggcctcgaccaagggc

SEQ ID NO: 57760 - RNA, 375 nt, synthetic construct
  misc_feature 1..375: note = derived and/or modified sequence opt11 from anti-HIV_Chain
  source 1..375: mol_type = other RNA
gtcgtgcaattggtcgagagcgggaccgaggtcaagaaaccgggctcgagcgtgaaagtgagctgtaaagcgagcgggggcacgttctcgggctcggacataagctgggtcaggcaagcacccgggcaagggctcgagtggatgggcgggatcatacccatgttcgatatcgagaaccatgccgagaaatttcgagggcgcttgaccataaccgcggtcaagagcacgggagcggcctatatggagctctcgagcttgcgctcggaagatgcagcggtctattactgtgccaggagctcgggcaattacgatttcgcgtacgatatctggggccagggcacgagagtgatcgtgagctcggcctcgaccaagggc

SEQ ID NO: 57761 - RNA, 378 nt, synthetic construct
  misc_feature 1..378: note = derived and/or modified sequence opt11 from anti-HIV_Chain
  source 1..378: mol_type = other RNA
caggtccagctagtgcaatcgggctcggccatgaaaaagcccggggcctcggtcagggtctcgtgctggacctcggaagatatctttgacacgaccgagctcatacactgggtcaggcaagcgcccgggcaaggactcgagtggataggatgggtcaaggccgtgagcggggccgtgaactatggctcgctagatttcagacacagggtctcgctcacgcgcgatcgcgatctctcgaccgcgcacatggacatacgcgggctaacgcaagatgacacggccacgtacttttgcgcgcgccagaaatttgccaggggcgatcaagggtggtttttcgatctctggggcaggggcacgctcatagtcgtgagctcggcc

SEQ ID NO: 57762 - RNA, 378 nt, synthetic construct
  misc_feature 1..378: note = derived and/or modified sequence opt11 from anti-HIV_Chain
  source 1..378: mol_type = other RNA
caagtccaactccaagaatccggacccggcctcgtcaaaccctccgaaaccctctccctcacctgcaccgtctcaggcggctccatctccaaccactactggtcctggatccgccaaccccccggcaaaggcctcgaatggatcggctacatctaccactccggcaacatcaactacaaatcctccctcaaatcccgcgccaccatctcaatcgacacctccaacaaccaattctccctcaaactctcctccgtcatcgccgccgacaccgccgtctactactgcgcccgcaacttcggccccggctcccccaactacggcatggacgtctggggccaaggcaccaccgtcaccgtctcctccgcctccaccaaaggc

SEQ ID NO: 57763 - RNA, 378 nt, synthetic construct
  misc_feature 1..378: note = derived and/or modified sequence opt11 from anti-HIV_Chain
  source 1..378: mol_type = other RNA
caagtgcaattggtccagagcgggggcggggtcgtgcaaccgggcaggagcttgcgcttgagctgtgccgcgagcgggttcacgttctcgcaccatggaatacactgggtcaggcaagcgcccggggaagggctcgagtgggtggccgtgatctcggaagatggcacgaacatacactatgaagatagcgtgcgcgggcgctttaccataagcagggacaatagcaagaacacggtcgatctacagatgaatagcttgcgcgcggaagataccgcggtctattactgtgcctcgctcataagcatgcgagatggcgatgcctttgacttgtgggggcaagggaccagggtcacggtctcgagcgcgagcacgaaaggg

SEQ ID NO: 57764 - RNA, 378 nt, synthetic construct
  misc_feature 1..378: note = derived and/or modified sequence opt11 from anti-HIV_Chain
  source 1..378: mol_type = other RNA
caagtgcaattggtagagagcgggggagggctagggcaaccgggagggagcttgagattgagctgtgcagcgagcgggttcacgttcaggaactatgcaatgagctgggtaaggcaagcggccgggaaagggctagagtgggtgagcggggtctcgggcgggggagataccacgtactatggcgatagcgtgaaagggcgctttacaataagcagggacaatagcaagaacacgctatatctacagatgaataacttgagagcggaagatacagcggtatattactgtgcaaaggacaagggcgtgtgggggagctcggactttgactattgggggcaagggacattggtaacggtatcgagcgcgagcacgaaaggg

SEQ ID NO: 57765 - RNA, 378 nt, synthetic construct
  misc_feature 1..378: note = derived and/or modified sequence opt11 from anti-HIV_Chain
  source 1..378: mol_type = other RNA
gaagtgcaattggtcgagagcgggggcggggtcgtgcaaccgggaaggagcttgcgcttgagctgtgccgcgagcgggttcacgttctcgcaccatggcatacactgggtcaggcaagcgcccggggaagggctcgagtgggtggccgtgatctcggaagatggcacaaacatacactatgaagatagcgtgcgcgggcgctttaccataagcagggacaatagcaagaacacggtcgatctccagatgaatagcttgcgcgcggaagataccgcggtctattactgtgcctcgctcataagcatgcgcgatggcgatgcctttgacttgtgggggcaagggaccagggtcacggtctcgagcgcgagcacgaaaggg

SEQ ID NO: 57766 - RNA, 378 nt, synthetic construct
  misc_feature 1..378: note = derived and/or modified sequence opt11 from anti-HIV_Chain
  source 1..378: mol_type = other RNA
cgcggccccgtcaccctcgccgtctccctcggcgaacgcgccaccatcacctgcaaatcctcccaatccgtcctcgtccactccaacaacaaaaactacctctcctggtaccaacaaaaacccggccaaccccccaaactcctcatctactgggcatccacccgcgaatccggcgtccccgaacgcttctcaggctccggctccggcaccgacttcaccctctccatctcctccctccaagccgaagacgtcgccgtctactactgccaccaatacttctccaccccccgcaccttcggccaaggcaccaaagtcgaaatcaaaggcaccgtcgccgccccctccgtcttcatcttccccccctccgacgaacaactc

SEQ ID NO: 57767 - RNA, 378 nt, synthetic construct
  misc_feature 1..378: note = derived and/or modified sequence opt11 from anti-HIV_Chain
  source 1..378: mol_type = other RNA
tccgaaatcgtcatgacccaatcccccgccaccctatccatgtcccccggcgaacgcgccacactctcctgccgcgcctccctctccgtcaacaccaacctcgcctggtaccaacaaaaacccggccaagccccccgcctcctcatctacggcgcctccacccgcgccaccggcatccccgcccgcttctccggctccggctccggcaccgaattcaccctcaccatctcctccctccaatccgaagacttcgcactctactactgccaacaatacaaccactggccccaaaccttcggccaaggcaccaaagtcgaaatcaaacgcaccgtcgccgccccctccgtcttcatcttccccccctccgacgaacaaaaa

SEQ ID NO: 57768 - RNA, 378 nt, synthetic construct
  misc_feature 1..378: note = derived and/or modified sequence opt11 from anti-HIV_Chain
  source 1..378: mol_type = other RNA
tcagaaatcgtcctcacccaatcccccgccaccctctccctctcccccggcgaacgcgccaccctctcctgccgcgcctcccaatcaatcaacaactacctcgcctggtaccaacaaaaacccggccaagccccccgcctcctaatctacgacgcctccaaccgcgccaccggcatccccgcccgattctccggcggcggctccggcaccgacttcacccttaccatctcctccctcgaacccgaagacttcgccgtctactactgccaacaacgagccaactggcgcctcctcaccttcggcggcggcaccaaagtcgaaatcaaacgcacagtcgccgccccctccgtcttcatcttccccccctccgacgaacaa

SEQ ID NO: 57769 - RNA, 378 nt, synthetic construct
  misc_feature 1..378: note = derived and/or modified sequence opt11 from anti-HIV_Chain
  source 1..378: mol_type = other RNA
caagtgcaattggtccagagcgggggcgcggtcaagaaaccgggcgcgagcgtgaaagtgagctgtgaaacgtacgggtacacgttcacggaccatttcatgcactggtggaggcaagcgcccgggcaagggctcgagtggatgggctggatcaatccctatagctcggccgtgagctatagcccgcgctatcaagggcgcgtgaccatgaccagggacacgttcttggaaacggtctatatggagctcaggggcttgaaatttgacgataccgcgatctattactgtgccacgcccaagagcgggcgcgattactggagctttgacttgtgggggcaagggaccttggtcacggtctcgagcgcgagcacgaaaggg

SEQ ID NO: 57770 - RNA, 378 nt, synthetic construct
  misc_feature 1..378: note = derived and/or modified sequence opt11 from anti-HIV_Chain
  source 1..378: mol_type = other RNA
tcccaagtccaactcgtcgaatccggccccggcctcgtcaaaccctccgaaaccctctccctcacatgctccgtctccaacggctccatctcctccggcggctactactggtcctggctccgccaattccccggcaaaggcctcgaatggatcggctccatccactacaccggccgcaccatgtacaacccctccctcatgggccgccccgccctctccatggacacctccaacaaccaattctccctcaaactctcctccgtcaccgccgccgacaccgccctctacttctgcgcccgcgacctccaatggatattcgtcgtcgacccctggggccaaggcaccctcgtcaccgtctcctccgcctccaccaaaggc

SEQ ID NO: 57771 - RNA, 378 nt, synthetic construct
  misc_feature 1..378: note = derived and/or modified sequence opt11 from anti-HIV_Chain
  source 1..378: mol_type = other RNA
tcagtcgtgcaactggtcgagagcgggcccgggctcgtgaaaccaagcgagaccctgagcttgacctgtagcgtgagcaatggctcgatctcgagcgggggctattactggagctggctcaggcaatttcccgggaaagggctcgagtggataggctcgatccattacacgggcaggaccatgtacaatccctcgctcatgggcaggcccgcgctctcgatggatacctcgaacaatcaatttagcctgaaattgcgctcggtcacggccgcagacacggccctgtacttttgcgcgcgcgatctccagtggatattcgtggtcgatccctggggccaaggcacgctcgtgaccgtgagctcggcctcgaccaagggc

SEQ ID NO: 57772 - RNA, 378 nt, synthetic construct
  misc_feature 1..378: note = derived and/or modified sequence opt11 from anti-HIV_Chain
  source 1..378: mol_type = other RNA
agcgggggcaggctagtgcaaccgggcgggagcttgcgcttgagctgtagcgcgagcgggttcacgctctcgaactcggccatgagctgggtcaggcaagcgcccgggaaagggctcgagtgggtgagctcgatcttgagctcgggcgtgggcacgttctatgccgatagcgtgaaagggcgctttaccgtgagcagggacaatagcaggaacacgctctatctccagatgaagtcgttgcgcgcggaagataccgcgctctattactgtgccaaggtccagatccagcaactgaactttggcgtgatcacggacgcgggcttggacgtgtgggggaaagggaccacgctcatagtcagcagcgcgagcacgaaaggg

SEQ ID NO: 57773 - RNA, 378 nt, synthetic construct
  misc_feature 1..378: note = derived and/or modified sequence opt11 from anti-HIV_Chain
  source 1..378: mol_type = other RNA
caagtgcaattggtccagagcggggccgcggtcaagaaaccgggcgcgagcgtgaaagtgagctgtgaagcgtacgggtacaagttcacggaccatttcatgcactggtggaggcaagcgcccgggcaagggctcgagtggatgggctggatcaatccctatacctcggccgtgaactatagcccgaaatatcaagggcgcgtgaccatgaccagggacacgttcctggaaacggtctatatggagctcaggggcttgcgcgtggacgataccgcgatctattactgtgccacgcccaagagcgggcgcgattactggagctttgacttgtgggggcaagggaccttggtcacggtctcgagcgcgagcacgaaaggg

SEQ ID NO: 57774 - RNA, 378 nt, synthetic construct
  misc_feature 1..378: note = derived and/or modified sequence opt11 from anti-HIV_Chain
  source 1..378: mol_type = other RNA
caagtgcaattggtccagagcggggccgcggtcaagaaaccgggcgcgagcgtgaaagtgagctgtgaaacgtacgggtacaagttcacggaccatttcatgcactggtggaggcaagcgcccgggcaagggctcgagtggatgggctggatcaatccctatagctcggccgtgagctatagcccgcgctatcaagggcgcgtgaccatgaccagggacacgttcttggaaacggtctatatggagctcaggggcttgcgctttgacgataccgcgatctattactgtgccacgcccaagagcgggcgcgattactggagctttgacttgtgggggcaagggaccttggtcacggtctcgagcgcgagcacgaaaggg

SEQ ID NO: 57775 - RNA, 378 nt, synthetic construct
  misc_feature 1..378: note = derived and/or modified sequence opt11 from anti-HIV_Chain
  source 1..378: mol_type = other RNA
caagtgcaattggtccagagcggggccgcggtcaagaaaccgggcgcgagcgtgaaagtgagctgtgaaacgtacgggtacacgttcacggaccatttcatgcactggtggaggcaagcgcccgggcaagggctcgagtggatgggctggatcaatccctatagctcggccgtgagctatagcccgcgctatcaagggcgcgtgaccatgaccagggacacgttcttggaaacggtctatatggagctcaggggcttgaaatttgacgataccgcgatctattactgtgccacgcccaagagcgggcgcgattactggagctttgacttgtgggggcaagggaccttggtcacggtctcgagcgcgagcacgaaaggg

SEQ ID NO: 57776 - RNA, 378 nt, synthetic construct
  misc_feature 1..378: note = derived and/or modified sequence opt11 from anti-HIV_Chain
  source 1..378: mol_type = other RNA
caagtgcaattagtccagagcggggccgaggtaaagaaaccgggcagcagcgtgaaagtgagctgcaaaacaagcggggtaaggttctcgagcaacgccataagctgggtcaggcaagcgcccgggcaagggctcgagtggatgggaaggacaacaccaatgctaggaggagcgaaccatgcaccgagcttcaaagggcgagtgaccataagcgcggacgagagcacgagaacagtctatatggagatgtcgagcctgcgatacgaagataccgcggtatactactgcgcctcgggcaggcgcgagggactgaactttctcctggactattggggacaagggacactggtcacagtcagcagcgcaagcacgaaagga

SEQ ID NO: 57777 - RNA, 378 nt, synthetic construct
  misc_feature 1..378: note = derived and/or modified sequence opt11 from anti-HIV_Chain
  source 1..378: mol_type = other RNA
caagtccaactccaagaatcaggccccggcctcgtcaaaccctccgaaaccctctccctcacctgcaccgtctccggcggatccatctccacctactactggtcctggatccgccaaccccccggcaaaggcctcgaatggatcggctacatctcctactccggctccaccaactacaacccctccctcaaatcccgcgtcaccatctccgtcgacacctccaaaaaccaattctcactcaaactctcctccgtcaccgccgccgacacagccgtctactactgcgcccgccacaaatccgtcctcctctggttccgcgaactcgactactggggccaaggcaccctcgtcaccgtctcctccgcctccaccaaaggc

SEQ ID NO: 57778 - RNA, 378 nt, synthetic construct
  misc_feature 1..378: note = derived and/or modified sequence opt11 from anti-HIV_Chain
  source 1..378: mol_type = other RNA
caagtccaactcgtccaatccggcgccgaagtcaaaaaacccggcgccgccgtcaaaatctcctgcaaagcatcccgcttcaccttctcctcctactacatccactgggtccgccaagcccccggccaaggcctcgaatggatgggcatcatcaacccctccggcggctccacctccaacgcccaaaaattccaagaccgcgtcaccctcacacgcgacatgtccaccggcaccgtctacatggaactctcccgcctcacctccgaagacaccgccgtctactactgcgccacccccgaaccctcctccatcgtcgcccccctctactactggggccaaggaaccctcgtcaccgtctcctccgcctccaccaaaggc

SEQ ID NO: 57779 - RNA, 378 nt, synthetic construct
  misc_feature 1..378: note = derived and/or modified sequence opt11 from anti-HIV_Chain
  source 1..378: mol_type = other RNA
caagtgcaattggtccagagcggggccgagatgaagaaaccgggcgcgagcgtgaaagtgagctgtaaagcgagcgggcacacgttcacgaactattacatgcactgggtcaggcaagcgccagggcaagggctcgagtggatgggcatgatcaatcccacgggcgatagcacgcgctatgcccagcgctttcaagggcgcgtgaccatgaccagggacacgagcacgcgcacggtctatatggagctctcgagcttgcgctcggacgataccgcggtctattactgtgccagggcacatcacgatttctggcgcgcgcccgtggacgtgtgggggaaagggaccacggtcacggtctcgagcgcgagcacgaaaggg

SEQ ID NO: 57780 - RNA, 378 nt, synthetic construct
  misc_feature 1..378: note = derived and/or modified sequence opt11 from anti-HIV_Chain
  source 1..378: mol_type = other RNA
caagtcgtcctcatccaatccggcgccgaagtcaaacgccccggctcctccgtcaaagtctcctgcaaagcctccggcggctccttccccatcacctgggtccgccaagcccccggccacggcctcgaatggatgggcggcatcaacccattcttcggcaccaccaactacgcccaaaaattccaaggccgcgtctccatcaccgccgacgaatccacctccaccacctacctccacctctccgacctccgctcagaagacaccgccgtctacttctgcgcccgagaaaaccgcgaaaaatggctcgtcctccgctcctggttcgccccctggggccaaggcaccctcgtcaccgtctcctccgcctccaccaaaggc

SEQ ID NO: 57781 - RNA, 378 nt, synthetic construct
  misc_feature 1..378: note = derived and/or modified sequence opt11 from anti-HIV_Chain
  source 1..378: mol_type = other RNA
agccagcaattggtccagagcggggcccaggtcaagaaaccgggcgcgagcgtgcgcgtgagctgtcaagcgagcgggtacacgttcacgaaccatttcttgcactggtggaggcaagcgcccaggcaagggctcgagtggatgggatggatcaatccagtgcacgggggaaggaactatgccaggcgctttcaagggcgcataaactttggcagggacgtgtaccaggaaacggcctatatggagctctcgggcttgagaaatgacgataccgcgacctatttctgtgccaggggcgggggcgatggcaggaactggcacttgcacccgtgggggcaagggaccttggtcatagtctcggccgcgagcacgaaaggg

SEQ ID NO: 57782 - RNA, 378 nt, synthetic construct
  misc_feature 1..378: note = derived and/or modified sequence opt11 from anti-HIV_Chain
  source 1..378: mol_type = other RNA
gaagtgcaagtggtagagagtgggggcgggctcgtgcaaccgggcgggagcttgcgcttgagttgtgtcgcgagcgggttcacgttctcggaatattggatgagctgggtaaggcaagcgccagggaaagggctcgagtgggtggcaacgatcaagagagatggatcggaagagagctatgtagatagcgtgaaagggagatttaccataagcagggacaatgccaagaactcgctctatctccagatgaatagtttgcgcgcggaagatacagcggtctattactgtgccagggtaagggacccgaactataacttgcactttgactcgtgggggcaagggaccttggtcacggtctcgagcgcgagcacgaaaggg

SEQ ID NO: 57783 - RNA, 378 nt, synthetic construct
  misc_feature 1..378: note = derived and/or modified sequence opt11 from anti-HIV_Chain
  source 1..378: mol_type = other RNA
ttggtccagctcgtggaatcgggcgggggcgtggtccagcccgggaaatcgctcaggctctcgtgcgcgacctcgggctttacctttagcacgtacgggatgcattgggtgcgccaggccccgggcaagggcttggaatgggtcgcggtcatatggtatgacgggagctataaatattacgcggactcggtcaagggcaggttcacgatctcgcgcgataactcgaaaaataccttgttcctgcaaatgaactcgctcagggccgaggacacggccatgtactattgcgggcgcgagatggcggtcgggggcacgaaagcgctcgatcactggggccagggcacgctcgtgaccgtgagctcggcctcgaccaagggc

SEQ ID NO: 57784 - RNA, 378 nt, synthetic construct
  misc_feature 1..378: note = derived and/or modified sequence opt11 from anti-HIV_Chain
  source 1..378: mol_type = other RNA
gagttccagctcgtgcaatcgggcgggggcttggtcaagcccgggggctcactaaggctctcgtgcacgggctcgacctttagctttagctcggacgatatgaattgggtgcgccaggccccaggcaagggcttggaatgggtctcgagcatgagcgatagcgggagccatatctattacgcggactttgtcaagggcaggttcacgatctcgcgcgataacgcgaaaaagagcttgtacttgcaaatgaactcgctcagggccgaggacacggccgtgtactattgcgcgcaatcgcgcccgccccagcgcttgtacgggatggatgtctggggccagggcacgaccgtgaccgtgagctcggcctcgaccaagggc

SEQ ID NO: 57785 - RNA, 381 nt, synthetic construct
  misc_feature 1..381: note = derived and/or modified sequence opt11 from anti-HIV_Chain
  source 1..381: mol_type = other RNA
gaagtgcaactggtcgagagcgggggcggggtcgtgcaaccgggcgggagcttgcgattgagctgtgccgcgagcgggttcatgttcaagaactatgccatgcactgggtcaggcaaccgcccgggaaagggctcgagtgggtggcagtgatctggtacgggggcagggaccagaactatgccgatagcgtgaaagggcgctttaccataagcagagacgatagcgataacacgctctatctacagatgaatagcttgcgcgcgggcgataccgcggtctatttctgtgccaggaactcgcaagtgggcaggctcatgcccgcggccggggtctggggccagggcacgctcgtgacagtgagctcggcctcgaccaagggc

SEQ ID NO: 57786 - RNA, 381 nt, synthetic construct
  misc_feature 1..381: note = derived and/or modified sequence opt11 from anti-HIV_Chain
  source 1..381: mol_type = other RNA
caagggcacttggtccagagcgggggcggggtcaagaaactgggcacgagcgtgaccataagctgtctcgcgagcgagtacacgttcaatgaatttgtcatacactggatcaggcaagcgcccgggcaagggcccttgtggctgggcctgatcaagcgctcgggcaggctcatgacctcgtaccagttccaggacaggctctcgctcagacgcgatcgctcgaccgggaccgtgttcatggaattgcgcgggctcagggtcgatgacacggccgtgtactattgcgcgcgcgatggcttgggcgaggtcgcgcccgcgtacttgtacgggatcgatgcctggggccagggcacgaccgtgatcgtgacctcggcctcgacc

SEQ ID NO: 57787 - RNA, 381 nt, synthetic construct
  misc_feature 1..381: note = derived and/or modified sequence opt11 from anti-HIV_Chain
  source 1..381: mol_type = other RNA
caagtccaactcctcgaatccggcggcggcctcgtccaacgcggcggctccctccgcctctcctgcaccgcctccggcttcgtattcaacaactactggatgacctgggtccgacaagcccccggcaacggcctcgaatgggtcgccaacatcgaccaagacggctccgaaaaacactacctcgactccgtcaaaggccgcttcaccatctcccgcgacaacgccaaaaactccctctacctccaaatgaactccctccgcgccgaagacaccgccatctactactgcgcccgcgtccgcttcaaagtcaccgcctggcaccgattcgactcctggggccaaggcgacctcgtcaccgtctcctccacctcaaccaaaggc

SEQ ID NO: 57788 - RNA, 381 nt, synthetic construct
  misc_feature 1..381: note = derived and/or modified sequence opt11 from anti-HIV_Chain
  source 1..381: mol_type = other RNA
caatccgccctcacccaacccccctccgcctccggcacccccggccaacgcgtcaccatctcctgctccggctcctaccacaacatcggctccaacgccgtcaactggtaccaacaactccccggcaccgcccccaaactcctcatctactccaacgaccaacgcccctccggcgtccccgaccgcttctccggctccaaatcaggcacctccgcctccctcgccatctccggcctccaatctgaagacgaagccgactactactgcgccgcctgggacgactccctccacgtcttcggcaccggcaccaaagtcaccgtcctcggccaacccaaagccaaccccaccgtcaccctcttccccccctcatccgaagaactc

SEQ ID NO: 57789 - RNA, 381 nt, synthetic construct
  misc_feature 1..381: note = derived and/or modified sequence opt11 from anti-HIV_Chain
  source 1..381: mol_type = other RNA
caatccgtcctcacccaagtcctctccgtctccggcacccccggccaacgcgtcatcatctcctgctccggcacctcctccaacgtcggcggcaacctcgtctcctggtaccaacacctccccggcgccgccccccgcctcctcatccaccgagacgaccaacgaccctccggcgtccccgaccgcttctccggctccaaatccggcaactccgcctccctcgtcatctccggcctccgctccgacgacgaagccgactacttctgcgccgcctacgactccaccttctcactccccgtcttcggcggcggcacccgcctcaccgtcctctcccaacccaaagccgccccatccgtcaccctcttccccccctcctccgaa

SEQ ID NO: 57790 - RNA, 381 nt, synthetic construct
  misc_feature 1..381: note = derived and/or modified sequence opt11 from anti-HIV_Chain
  source 1..381: mol_type = other RNA
caagtccaactcctccaatccggcgccgccgtcaccaaacccggcgcctccgtccgcgtctcctgcgaagcctccggctacaacatccgcgactacttcatccactggtggcgccaagcccccggccaaggcctccaatgggtcggctggatcaaccccaaaaccggccaacccaacaacccctgccaattccaaggccgcgtctccctcacccgccacgcctcatgggacttcgacacattctccttctacatggacctcaaagccctccgctcagacgacaccgccgtctacttctgcgcccgccaacgctccgactactgggacttcgacgtctggggctccggcacccaagtaaccgtctcctccgcctccaccaaa

SEQ ID NO: 57791 - RNA, 381 nt, synthetic construct
  misc_feature 1..381: note = derived and/or modified sequence opt11 from anti-HIV_Chain
  source 1..381: mol_type = other RNA
caagtccaactcgtccaaagcggcggcgaagtccgcaaacccggctcctcagtcaaagtcccctgcaaaatctccggcaacgccttctccaactacggagtcaactgggtcagacaagcccccggccaaggcctagaatgggtcggccgcatcatccccgtcatcggcgtcgcccaacacgcccccaaattccaaggccgcgtcaccatcaccgccgacaaatccaccaccaccgcctacctcgaactctcctccctacgctcagacgacaccgcagtctacttctgcgccaaagaccacggcgacccccgcaccggctactacttcgactactggggccaaggcgccctcgtcaccgtctcctcagcctcaaccaaaggc

SEQ ID NO: 57792 - RNA, 381 nt, synthetic construct
  misc_feature 1..381: note = derived and/or modified sequence opt11 from anti-HIV_Chain
  source 1..381: mol_type = other RNA
caagtccaactcggccaatccggcaccgaagtcaaaaaacccggcttctcagtcaaagtctcctgcaaagcctccggcggctcctccaccgcctacggctactcctgggtccgccaagcccccggccaaggcttcgaatggatgggccgcatcatccccttctacggcatcatcacctacgcacccaaattccaaggccgcgtcaccatcaccgccgaccgctcaacctccaccgtctacatggaactcacctccctcaccttcgccgacaccgccctcttcttctgcgcccgcgacttcggcgacccccgcaacggctactacttcgactcctgggaccaaggcctctggctcaccgtctcctccgcctcaaccaaaggc

SEQ ID NO: 57793 - RNA, 381 nt, synthetic construct
  misc_feature 1..381: note = derived and/or modified sequence opt11 from anti-HIV_Chain
  source 1..381: mol_type = other RNA
caagtccaactcgtccaatccggcgccgaagtcaaaaaacccggctccagcgtcaaagtctcctgcaaagcctccggcggcaccttctccaactacgccatctcctgggtccgccaagcccccggccaaggcctcgaatggatgggcggcatcatccccatcttcgaagccgcctcctacgcccaaaaattccaagaccgcctcaccatcaccaccgacgaatcaaccaccaccgcctacatggacctctcctccctccgctccgaagacaccgccatctactactgcgcccgcgcccaaggcgacatactcaccgaaggctacttcgactactggggccaaggcaccctcgtcaccgtctcctccgcctccaccaaaggc

SEQ ID NO: 57794 - RNA, 381 nt, synthetic construct
  misc_feature 1..381: note = derived and/or modified sequence opt11 from anti-HIV_Chain
  source 1..381: mol_type = other RNA
caagtccaactccaagaatccggccccggactcgtcaaaccctccgaaaccctttccctcacctgcaccgtctccggcggctccatctcatccgccggctactactggtcctggatccgccaacaccccgaaaaaggcctcgaattcatcggctacatctactacctcggcaccacctactacaacccctccctcaaatcccgcgtctccatctccatcgacacctccaacaaccaattctccctcgaactctcctcagtctccgccgccgacaccgcaatctactactgcgcccgcgactacaccgcctccggccgccacttcttcgactactggggccaaggcaccctcgtcaccgtctcctcagcctccaccaaaggc

SEQ ID NO: 57795 - RNA, 381 nt, synthetic construct
  misc_feature 1..381: note = derived and/or modified sequence opt11 from anti-HIV_Chain
  source 1..381: mol_type = other RNA
caagtgcaactggtacagagcggagccgaagtcaaaaaaccgggagcaagcgtaaaagtaagctgcaaagcaccaggatacacattcataggacactacatgcactggataagacaagcacccggacaaggactggaatggatgggatggataaacccaaacagcggagacacaaactacgcccagacattccaaggaagagtgacaatgacgagagacacaagcataagcacagcatacatggaactaacaagactaagaagcgacgacacagcagtctactactgcgcaagagacctaagaccaatgagaggcaactgggcaatgcacgtatggggagaaggcacgacagtgacagtaagcagcgccagcacaaaagga

SEQ ID NO: 57796 - RNA, 381 nt, synthetic construct
  misc_feature 1..381: note = derived and/or modified sequence opt11 from anti-HIV_Chain
  source 1..381: mol_type = other RNA
caagtccaactccaagaatccggccccggcctcgtaaaaccctccgaaaccctctcactaacctgcaccgtcttcggcgcctccatccgctccttctactggcactggatccgccaatcccccggcaaaggcctcgaatggctcggctccgtcttcgacaacggcctcaccacctacaacccctccctcaaaaaccgcctctcaatctcagaagacccctcccgcaaccaaatctccctcaacctccgctcaatgaccgccgccgacaccgccgtctactactgcgcccgcgccgactacgacctcctcacctcctcctaccacttcgactcctggggccaaggcaccctcgtcaccgtctcctccgcctccaccaaaggc

SEQ ID NO: 57797 - RNA, 381 nt, synthetic construct
  misc_feature 1..381: note = derived and/or modified sequence opt11 from anti-HIV_Chain
  source 1..381: mol_type = other RNA
tcgcaacagctcgtgcaatcgggcacgcaagtgaaaaagcccggggcctcggtcagggtctcgtgccaggcctcgggctatacctttaccgattacgtgctccattggtggcgccaggccccgggccagggcttggaatggatggggtggataaaaccggtctatggcgcgcgcaattacgcgcacaggttccagggcaggatcaatttcgatcgcgatgtctatcgcgagatcgcgtacatggacttgagcgggctcaggagcgatgacacggccgtgtacttttgcgcgcgcgatggctcgggcgatgccacgagctggcacttgcacccgtgggggcaagggaccctggtcatagtctcgagcgcgagcacgaaaggg

SEQ ID NO: 57798 - RNA, 381 nt, synthetic construct
  misc_feature 1..381: note = derived and/or modified sequence opt11 from anti-HIV_Chain
  source 1..381: mol_type = other RNA
tcccaacaactcgtccaatccggcacccaagtcaaaaaacccggcgcctccgtccgcgtctcctgccaagcctccggctacaccttcaccaactacatcctccactggtggcgccaagcacccggccgcggcctcgaatggatgggcctcatcaaacccgtctacggcgccgtcaactacgcccgccaattccaaggccgaatccaactcacccgcgacatctaccgcgaaatcgccttcctcgacctctccggcctccgccccgacgacaccgccgtctactactgcgcccgcgacgaatccggctacgacctcaactggcacctcgactcctggggccaaggcacccaagtcatcgtctcccccgcctccaccaaaggc

SEQ ID NO: 57799 - RNA, 381 nt, synthetic construct
  misc_feature 1..381: note = derived and/or modified sequence opt11 from anti-HIV_Chain
  source 1..381: mol_type = other RNA
agccaacaactagtccaaagcggagcccaagtcaaaaaaccaggcgccagcctacgcgtaagctgccaagccagcggatacacattcatgaactacctcctacactggtggagacaagcccccggacaaggactagaatggatgggctggatcaaccccgtctacggagccgtaaactacgcccaccgcttccaaggccgcctaaccttcagcagagacgtatacagagaaatagcctacatggacctcaacggcctacgctcagacgacaccgcagtctacttctgcgccagagacggcagcggagacgaccgcaactggcacctagacccctggggccaaggcacactcgtaatagtaagctcagcctcaaccaaaggc

SEQ ID NO: 57800 - RNA, 381 nt, synthetic construct
  misc_feature 1..381: note = derived and/or modified sequence opt11 from anti-HIV_Chain
  source 1..381: mol_type = other RNA
tcccaacaactcgtccaatccggcacccaagtcaaaaaacccggcgcctcagtccgcatctcctgccaagcctcaggctacaccttcaccgactacgtcctccactggtggcgccaagcccccggccaaggcctcgaatggatgggctggatcaaacccgtctacggcgcacgcaactacgcccgccgcttccaaggccgcatcaacttcgaccgcgacatctaccgcgaaatcgccttcctcgacctctccggcctccgctccgacgacacagcccgctacttctgcgcccgcgacggctccggcgacgacacctcctggcacctccacccctggggccaaggcaccctcgtcatcgtctccgccgcctccaccaaaggc

SEQ ID NO: 57801 - RNA, 381 nt, synthetic construct
  misc_feature 1..381: note = derived and/or modified sequence opt11 from anti-HIV_Chain
  source 1..381: mol_type = other RNA
tcgcaacagctagtgcaatcgggcacgcaagtgaaaaagaccggggcctcggtcagggtctcgtgccaggcctcgggctatgactttaccaagtacttgatccattggtggcgccaggccccgggacagggcttggaatggatggggtggatgaaaccggtctatggcgcgaccaattacgcgcacaggttccagggcaggatctcgttcacgcgcgatatctatcgcgagatcgcgttcatggacttgaacgggctcaggagcgatgacacggccgtgtacttttgcgcgcgcgacggcgggggcgatgacaggacctggctcctggacgcgtgggggcaagggaccttggtcatagtctcgagcgcgagcacgaaaggg

SEQ ID NO: 57802 - RNA, 381 nt, synthetic construct
  misc_feature 1..381: note = derived and/or modified sequence opt11 from anti-HIV_Chain
  source 1..381: mol_type = other RNA
agccagcaattggtccagagcgggacccaggtcaagaaaccgggcgcaagcgtgcgcgtgagctgtcaagcgagcggatacacgttcatgaactacatcatacactggtggaggcaagcgcccgggcaaaggctcgagtggatgggctggatcaatcccgtgttcggggccaggaactacgcccaccgctttcaagggcgcataaactttgacagggacataaacagggaaacgttccagatggacctcacaggcctacgctcggacgataccgcagtctactactgtgccagggacgggagcggggacgcgcgcgactggcatctccacccctggggccagggcacgctcgtaatcgtgagctcggcctcgacaaagggc

SEQ ID NO: 57803 - RNA, 381 nt, synthetic construct
  misc_feature 1..381: note = derived and/or modified sequence opt11 from anti-HIV_Chain
  source 1..381: mol_type = other RNA
tcccaacacctcgtccaatccggcacccaagtcaaaaaacccggcgcctcagtccgcgtctcctgccaagcctccggctacaccttcaccaactacatcctccactggtggcgccaagcccccggccaaggcctcgaatggatgggcctcatcaaacccgtcttcggcgccgtcaactacgcccgccaattccaaggccgcatccaactcacccgcgacatcaaccgcgaaatcgccttcctagacctctccggcctccgctccgacgacaccgccgtctactactgcgcccgcgacgaatccggcgacgacctcaaatggcacctccacccctggggccaaggaacccaagtcatcgtctcccccgcctccaccaaaggc

SEQ ID NO: 57804 - RNA, 381 nt, synthetic construct
  misc_feature 1..381: note = derived and/or modified sequence opt11 from anti-HIV_Chain
  source 1..381: mol_type = other RNA
agccagcaactggtccagagcgggacccaggtcaagaaaccgggcgcgagcgtgcgcgtgagctgccaagcgagcgggtacacgttcatgaactatatcatacactggtggaggcaagcgcccgggcaaaggctagagtggatgggctggatcaatcccgtgttcggggccaggaactatgcccatcgcttccaagggcgcataaacttcgacagggacataaacagggaaacattccagatggagctcacgggcctgcgatcggacgataccgcagtctattactgcgccagggacgggagcggagacgcgcgcgactggcatctcgacccctggggccagggcacgctcgtaatcgtgagctcagcctcgaccaagggc

SEQ ID NO: 57805 - RNA, 381 nt, synthetic construct
  misc_feature 1..381: note = derived and/or modified sequence opt11 from anti-HIV_Chain
  source 1..381: mol_type = other RNA
tcgcaacagctagtgcaatcgggcacgcaagtgaaaaagccaggggcctcggtcaggatctcgtgccaggcctcgggatatacctttaccgattacgtgctccattggtggcgacaggccccgggccagggcttggaatggatggggtggataaaaccggtctatggcgcgcgcaattacgcgcgcaggttccagggcaggatcaatttcgatcgcgatatctatcgcgagatcgcgtacatggacttgagcgggctcaggagcgatgacacggccaggtacttttgcgcgcgcgatggctcgggcgatgacacgagctggcacttgcacccgtgggggcaagggaccttggtcatagtctcggccgcgagcacgaaaggg

SEQ ID NO: 57806 - RNA, 381 nt, synthetic construct
  misc_feature 1..381: note = derived and/or modified sequence opt11 from anti-HIV_Chain
  source 1..381: mol_type = other RNA
tcccaacaactcgtccaatccggcacccaagtcaaaaaacccggcgcctccgtccgcatctcctgccaagcctccggctactccttcaccgactacgtcctccactggtaccgccaagcccccggccaaggcctagaatggatgggctggatcaaacccgtctacggcgcccgcaactacgcacgccgcttccaaggccgcatcaacttcgaccgcgacatctaccgagaaatcgccttcatggacctctcaggcctccgctccgacgacaccgccctctacttctgcgcccgcgacggatccggcgacgacacctcctggtacctcgacccctggggccaaggcaccctcgtcatcgtctccgcagcctccaccaaaggc

SEQ ID NO: 57807 - RNA, 381 nt, synthetic construct
  misc_feature 1..381: note = derived and/or modified sequence opt11 from anti-HIV_Chain
  source 1..381: mol_type = other RNA
tcgcaacagctcgtgcaatcgggcacgcaagtgaaaaagcccggggcatcggtcaggatctcgtgccaggcctcgggctatagctttaccgattacgtgctccattggtggcgccaggccccgggccagggcctggaatggatggggtggataaaaccggtctatggcgcgcgcaattacgcgcgcaggttccagggcaggatcaatttcgatcgcgatatctatcgcgagatcgcgttcatggacttgagcgggctcaggagcgatgacacggccttgtacttttgcgcgcgcgatggctcgggcgatgacacgagctggcacttggacccgtgggggcaagggaccctggtcatagtctcggcagcgagcacgaaaggg

SEQ ID NO: 57808 - RNA, 381 nt, synthetic construct
  misc_feature 1..381: note = derived and/or modified sequence opt11 from anti-HIV_Chain
  source 1..381: mol_type = other RNA
tcccaacacctcgtccaatccggcacccaagtcaaaaaacccggcgcctccgtccgcgtctcctgccaagcctccggctacaccttcacaaactacatcctccactggtggcgacaagcccccggccaaggcctcgaatggatgggcctcatcaaacccgtcttcggcgccgtcaactacgcccgacaattccaaggccgcatccaactcacacgcgacatctaccgcgaaatcgccttcctcgacctctccggcctccgctccgacgacaccgccgtctactactgcgcccgcgacgaatccggcgacgacctcaaatggcacctccacccctggggccaaggcacccaagtcatcgtctcacccgcctccaccaaaggc

SEQ ID NO: 57809 - RNA, 381 nt, synthetic construct
  misc_feature 1..381: note = derived and/or modified sequence opt11 from anti-HIV_Chain
  source 1..381: mol_type = other RNA
caagtccaactcgtcgaatccggcggcggcgtcgtccaacccggcaaatccctccgcctctcatgcgccatctccggcttcctcttcaacaactacggcggccaatgggtccgccaagcccccggcaaaggcctcgaatgggtcgcagccatctcctacgacggaaacaaccgctactacgccgactccgccaaaggccgcttcctcatctcccgcgacacccccaaaaacatcctctacctccaaatctactccctccgcctcgacgacacagccgtctactactgcgcccgcgactccgtctccaaatcctactccgccccccccgaattctggggccaaggcaccgtcgtcaccgtctcctccgcctccaccaaaggc

SEQ ID NO: 57810 - RNA, 381 nt, synthetic construct
  misc_feature 1..381: note = derived and/or modified sequence opt11 from anti-HIV_Chain
  source 1..381: mol_type = other RNA
caagtccacctcgaagaatccggccccggcctcgtaaaaacctcccaaaccctctccctaacctgctccgtctcctcctactccatctcccgctccggatacttctggacctggatccgacaacgccccggcaaaggcctcgaatggatcggctacatctacttcaacggccgcaccacctacaacccctccctcaaatcccgcatcaccatctcccgcgacacctcccactcccaattctccctcaccctcaactccctctccgccgccgacaccgccgtctactactgcggccgctgccaagacggcctcgcctcccgccccatcgacttctggggccaaggcaccctcgtcaccgtctcctccgcctccaccaaaggc

SEQ ID NO: 57811 - RNA, 381 nt, synthetic construct
  misc_feature 1..381: note = derived and/or modified sequence opt11 from anti-HIV_Chain
  source 1..381: mol_type = other RNA
caagtgcaattggtagagagcgggggcggggtcgtgcaaccgggcaggagcttgcgcttgagctgtgccacgagcgggttcacgagcaagaactatggcgtgcactgggtcaggcaagcgcccgggaaagggctcgagtgggtggccgtgatctggtacgatggctcgaacaagttctatgccgatagcgtgaaagggcgctttaccataagcagagacaggagcaagaacatggtctatctccagatgaatagcctgcgagtggaagataccgcgatctattactgtgccagggactcggtcgcgttcgtgctcgagggcccgatcgattactggggccagggaacgctcgtgaccgtgagctcagcctcgaccaagggc

SEQ ID NO: 57812 - RNA, 384 nt, synthetic construct
  misc_feature 1..384: note = derived and/or modified sequence opt11 from anti-HIV_Chain
  source 1..384: mol_type = other RNA
caagtgcaattggtccagagcgggggcggggtaaagaaaccgggcacgagcgcgagctttagctgtcgcacgagcgatgacatatacgataacgagttctttgactcggcatttatgcattgggtgcgcttgatcccgggccagcgcccggaatggatggggtggatgaacccgcgctcgggcgcggtcaattacgcgcgccagctccagcccagggtctcgatgtatcgcgatcgcgatctctcgaccgcgtacatggaatttaaatcgctcacgagcgcagacacgggcacgtacttttgcgcgcgcaagaaaaggggcgatggctttaacttgtactttgacttgtgggggcgcgggagccaggtcatagtctcgagcgcg

SEQ ID NO: 57813 - RNA, 384 nt, synthetic construct
  misc_feature 1..384: note = derived and/or modified sequence opt11 from anti-HIV_Chain
  source 1..384: mol_type = other RNA
caaggccacctcgtccaatccggcggcggcgtcaaaaaactcggcacctccgtcaccatctcctgcctcgcctccgaagacacattcaacgaattcgtcatccactggatccgccaagcccccggccaaggccccctatggctcggcctcatcaaacgctccggccgcctcatgacctcataccaattccaagaccgactctccctccgccgcgaccgctccaccggcaccgtcttcatggaactccgcggcctccgcgtcgacgacaccgccgtctactactgcgcccgcgacggcctcggcgaagtagcccccgcctacctctacggcatcgacgcctggggccaaggcaccaccgtcatcgtcacctccgcctccacctcc

SEQ ID NO: 57814 - RNA, 384 nt, synthetic construct
  misc_feature 1..384: note = derived and/or modified sequence opt11 from anti-HIV_Chain
  source 1..384: mol_type = other RNA
caatccgccctcacccaacccccctccgtctccggcgcccccggccaacgcgtcaccatctcctgctccggcggcccctccaacgtcggcggcaactacgtctactggtaccgccaattccccggcaccgcccccaaactcctcatactccgcgacgaccaacgaccctccggcgtccccgaccgcttctccgcctccaaatcaggcaactcagcctccctcgccatctcaggcctacgacccgacgacgaagccttctacttctgcgccacctacgactcccaaggctccttccgcgtcttcggcggcggcaccgccctcaccgtcctctcccaacccaaagccgccccctccgtcaccctctaccccccatcctccgaagaa

SEQ ID NO: 57815 - RNA, 384 nt, synthetic construct
  misc_feature 1..384: note = derived and/or modified sequence opt11 from anti-HIV_Chain
  source 1..384: mol_type = other RNA
aacttcatgctcacccaacccccctccgcctccggcacccccggccaacgcgtcaccatctcctgctccggcggcggctccaacatcggcggcaacctcgtctcctggtaccaacacttccccggcgccgcccccaaactcctcatctaccgcaacgaccaacgcccctccggcgtccccgaccgcttctccggctccaaatccggcacctccgcctccctcgccatctccggactccgctccgacgacaaagccacctacttctgcgccgcctacgactccaccctctccctccgcctattcggcggcggcaccaccctcaccgtcctctcccaacccaaagccgccccctccgtcaccctcttccccccctcctccgaagaa

SEQ ID NO: 57816 - RNA, 384 nt, synthetic construct
  misc_feature 1..384: note = derived and/or modified sequence opt11 from anti-HIV_Chain
  source 1..384: mol_type = other RNA
aacttcatgctcacccaacccccctccgtctccgccacccccggccaaaccgtcaccatctcctgctccggctccggctccaacgtcggcggcaaccacgtctactggtaccgccaactccccggcgccgcccccaccctcgtcatctccaaaaccgaccaccgcccctcccgcgtccccgaccgcttctccggctccaaatccggcaactccgcctccctagccatctccggcctccgccccgacgacgaagccgtctacttctgcgccacctacgacaccggcctctccctccgcctcttcggcggcggcacccgcctcaccgtcctctcccaacccaaagccgccccctccgtcacccaattccccccctcctccgaagaa

SEQ ID NO: 57817 - RNA, 384 nt, synthetic construct
  misc_feature 1..384: note = derived and/or modified sequence opt11 from anti-HIV_Chain
  source 1..384: mol_type = other RNA
caatccgccctcacccaaccaccctccgcctccggcgcccccggccaacgcgtcaccatctcctgctccggcggcccctccaacgtcggcggcaactacgtctactggtaccgccaattccccggcaccgcccccaaactcctcatcctccgcgacgaccaacgcccctccggcgtccccgaccgcttctccgcctccaaatccggcaactccgcctccctcgccatctccggcctccgacccgacgacgaagccctctacttctgcgccacctacgactccgacggctccatccgcctcttcggcggcggcaccgccctcaccgtcctctcccaaccaaaagccgccccctccgtcaccctattcccacccggctgggaagaa

SEQ ID NO: 57818 - RNA, 384 nt, synthetic construct
  misc_feature 1..384: note = derived and/or modified sequence opt11 from anti-HIV_Chain
  source 1..384: mol_type = other RNA
caagtccaactcctccaatccggcgccgccgtcaccaaacccggcgcctccgtccgcgtctcctgcgaagcctcaggctacaacatccgcgactacttcatccactggtggcgccaagcccccggccaaggcctacaatgggtcggctggatcaacccaaaaaccggccaacccaacaacccccgcctcttccaaggccgcgtctccctcacccgccacgcctcctgggacttcgacaccttctccttctacatggacctcaaagccgtccgctccgacgacacagccgtctacttctgcgcccgccaacgctccgactactgggacttcgacgtctggggctccggcacccaagtcaccgtctcctcagcctccaccaaaggc

SEQ ID NO: 57819 - RNA, 384 nt, synthetic construct
  misc_feature 1..384: note = derived and/or modified sequence opt11 from anti-HIV_Chain
  source 1..384: mol_type = other RNA
caagtccaactcctccaatcaggcgccgtcgtcaccaaacccggcgcctccgtccgcgtctcctgcgaagcctccggctacaaaatccgcgactacttcatccactggtggcgccaagcccccggccaaggcctccaatgggtcggctggatcaacccccaaaccggccaacccaacatcccccgccccttccaaggccgcgtcaccctcacccgccacgcctcctgggacttcgacaccttctccttctacatggacctcaaagccctccgctccgacgacaccgccatctacttctgcgcccgccgccgctccgactactgcgacttcgacgtctggggctccggcacccacgtcaccgtctcctccgcctccaccaaaggc

SEQ ID NO: 57820 - RNA, 384 nt, synthetic construct
  misc_feature 1..384: note = derived and/or modified sequence opt11 from anti-HIV_Chain
  source 1..384: mol_type = other RNA
caagtgcaattgctccagagcggggccgcagtcacgaaaccgggcgcgagcgtgcgcgtgagctgtgaagcgagcgggtacaatatcagggactacttcatacactggtggaggcaagcgcccgggcaagggctccagtgggtgggatggatcaatcccaagaccgggcaaccgaacaatcccaggcaatttcaagggcgcgtgagcttgaccaggcaagcgagctgggactttgacacgatctcgttctatatggatctcaaggccttgcgcttggacgataccgcggtctatttctgtgccagacaaaggagcgattactgggactttgacgtgtgggggagcgggacccaggtcacggtctcgagcgcgagcacgaaaggg

SEQ ID NO: 57821 - RNA, 384 nt, synthetic construct
  misc_feature 1..384: note = derived and/or modified sequence opt11 from anti-HIV_Chain
  source 1..384: mol_type = other RNA
caagtccaactcctccaatccggcgccgccgtcaccaaacccggcgcctccgtccgcgtctcctgcgaagcctcaggctacaacatccgcgactacttcatccactggtggcgccaagcccccggccaaggcctccaatgggtcggctggatcaaccccaaaaccggccaacccaacaacccacgccaattccaaggccgcgtctccctcacccgccacgcctcctgggacttcgacaccttctcattctacatggacctcaaagccctccgctccgacgacaccgccgtctacttctgcgcccgccaacgctccgactactgggacttcgacgtctggggctccggcacacaagtcaccgtctactccgcctccaccaaaggc

SEQ ID NO: 57822 - RNA, 384 nt, synthetic construct
  misc_feature 1..384: note = derived and/or modified sequence opt11 from anti-HIV_Chain
  source 1..384: mol_type = other RNA
caagtgcaattgctcccgttcgggggcgcggtcacgaaaccgggcgcgagcgtgcgcgtgagctgtgaagcgagcgggtacaatatcagggactatttcatacactggtggaggcaagcgcccgggcaagggctacagtgggtgggctggatcaatcccaagaccgggcaaccgaacaatccatgtcaatttcaagggcgcgtgagcttgaccaggcccgcgagctgggactttgacacgatctcgttctatatggatctcaaggccttgcgcttggacgataccgcggtctatttctgtgccaggcaaaggagcgattactgggactttgacgtgtgggggagcgggacacaggtcacggtctcgagcgcgagcacgaaaggg

SEQ ID NO: 57823 - RNA, 384 nt, synthetic construct
  misc_feature 1..384: note = derived and/or modified sequence opt11 from anti-HIV_Chain
  source 1..384: mol_type = other RNA
caagtccacctatcccaatccggcgccgccgtcaccaaacccggcgcctccgtccgcgtctcctgcgaagcctccggctacaaaatctccgaccacttcatccactggtggcgccaagcccccggccaaggcctccaatgggtcggctggatcaaccccaaaaccggccaacccaacaacccccgccaattccaaggccgcgtctccctcacccgccaagcctcctgggacttcgacacctactcattctacatggacctcaaagccctccgctccgacgacaccgccatctacttctgcgcccgccaacgctccgacttctgggacttcgacgtctggggctccggcacacaagtcaccgtctcctcagcctccaccaaaggc

SEQ ID NO: 57824 - RNA, 384 nt, synthetic construct
  misc_feature 1..384: note = derived and/or modified sequence opt11 from anti-HIV_Chain
  source 1..384: mol_type = other RNA
caagtccacctctcccaatccggcgccgccgtcaccaaacccggcgcctcagtccgcgtctcctgcgaagcctccggctacaaaatctccgaccacttcatccactggtggcgccaagcccccggccaaggcctccaatgggtcggctggatcaaccccaaaaccggccaaccaaacaacccccgccaattccaaggccgcgtctccctcacccgccaagcctcctgggacttcgacacctactccttctacatggacctcaaagccgtccgctccgacgacaccgccatctacttctgcgcccgacaacgctccgacttctgggacttcgacgtctggggctccggcacccaagtcaccgtatcctccgcctccaccaaaggc

SEQ ID NO: 57825 - RNA, 384 nt, synthetic construct
  misc_feature 1..384: note = derived and/or modified sequence opt11 from anti-HIV_Chain
  source 1..384: mol_type = other RNA
caagtccaactcctccaatccggcgccgccgtcaccaaacccggcgcctccgtccgcgtctcctgcgaagcctccggctacaaaatctccgaccacttcatccactggtggcgccaagcccccggccaaggcctccaatgggtcggctggatcaaccccaaaaccggccaacccaacaacccccgccaattccaaggccgcatctccctcacccgccaagcatcctgggatttcgacaccttctccttctacatggacctcaaagccctccgctccgacgacaccgccgtctacttctgcgcccgccaacgctccgactactgggacttcgacgtctggggctccggcacccaagtcaccgtctcctccgcctccaccaaagga

SEQ ID NO: 57826 - RNA, 384 nt, synthetic construct
  misc_feature 1..384: note = derived and/or modified sequence opt11 from anti-HIV_Chain
  source 1..384: mol_type = other RNA
caagtccaactcctccaatccggcgccgccgtcaccaaacccggcgcctccgtccgcgtctcctgcgaagcctccggctacaacatccgcgactacttcatccactggtggcgccaagcccccggccaaggcctccaatgggtcggctggatcaaccccaaaaccggccaacccaacaacccccgccaattccaaggccgcgtctccctcacccgccacgcctcctgggacttcgacaccttctccttctacatggacctcaaaggcctccgctccgacgacaccgccatctacttctgcgcccgccaacgctccgactactgggacttcgacgtctggggctccggcacccaagtcaccgtctcctccgcctccaccaaaggc

SEQ ID NO: 57827 - RNA, 384 nt, synthetic construct
  misc_feature 1..384: note = derived and/or modified sequence opt11 from anti-HIV_Chain
  source 1..384: mol_type = other RNA
caagtccaactcctccaatccggcgccgccgtcaccaaacccggcgcctccgtccgcgtctcctgcgaagcctccggatacaacatccgcgactacttcatccactggtggcgccaagcccccggccaaggcctccaatgggtcggctggatcaaccccaaaaccggccaacccaacaacccccgccaattccaaggccgagtctccctcacccgccacgcctcctgggacttcgacaccttctccttctacatggacctcaaagccctccgctccgacgacaccgccgtctacttctgcgcccgccaacgctccgactactgggacttcgacgtctggggctccggcacccaagtcaccgtctcctcagcctccaccaaaggc

SEQ ID NO: 57828 - RNA, 384 nt, synthetic construct
  misc_feature 1..384: note = derived and/or modified sequence opt11 from anti-HIV_Chain
  source 1..384: mol_type = other RNA
cacgtccaactcctccaatccggcgccgccgtcacaaaacccggcgcctccgtccgcgtctcctgcgaagcctccggctacaacatccgcgactacttcatccactggtggcgccaagcccccggccaaggcctccaatgggtcggctggatcaaccccaaaaccggccaacccaacaacccccgccaattccaaggccgagtctccctcacccgccaagcctcctgggacttcgacaccttctccttctacatggacctcaaagccctccgcctcgacgacaccgccatctacttctgcgcccgccaaagatccgactactgggacttcgacgtctggggctccggcacccaagtcaccgtctcctccgcctccaccaaaggc

SEQ ID NO: 57829 - RNA, 384 nt, synthetic construct
  misc_feature 1..384: note = derived and/or modified sequence opt11 from anti-HIV_Chain
  source 1..384: mol_type = other RNA
caagtccacctctcccactccggcgccgccgtcaccaaacccggcgcctccgtccgcgtatcctgcgaagcctccggctacaaaatctccgaccacttcatccactggtggcgccaagcccccggccaaggcctccaatgggtcggctggatcaacccaaaaaccggccaacccaacaacccccgccaattccaaggccgcatctccctcacccgccaagcctcctgggacttcgacaccttctccttctacatggacctcaaagccctccgctccgacgacaccgccgtctacttctgcgcccgccaacgctccgactactgggacttcgacgtctggggctccggcacccaagtcaccgtctcctcagcctccaccaaaggc

SEQ ID NO: 57830 - RNA, 384 nt, synthetic construct
  misc_feature 1..384: note = derived and/or modified sequence opt11 from anti-HIV_Chain
  source 1..384: mol_type = other RNA
caagtccacctctcccaatccggcgccgtcgtaaccaaacccggcgcctccgtccgcgtctcctgcgaagcctccggatacaaaatctccgaccacttcatccactggtggcgccaagcccccggccaaggcctccaatgggtcggctggatcaaccccaaaaccggccaacccaacaacccccgccaattccaaggccgcatctccctcacccgccaagcctcctgggacttcgacaccttctccttctacatggacctcaaagccctccgatccgacgacaccgccgtctacttctgcgcccgccaacgctccgactactgggacttcgacgtctggggctcaggcacccaagtcaccgtctcctccgcctccaccaaaggc

SEQ ID NO: 57831 - RNA, 384 nt, synthetic construct
  misc_feature 1..384: note = derived and/or modified sequence opt11 from anti-HIV_Chain
  source 1..384: mol_type = other RNA
caagtccacctctcacaatccggcgccgtcgtcaccaaacccggcgcctccgtccgcgtctcctgcgaagcctccggctacaaaatctccgaccacttcatccactggtggcgccaagccccaggccaaggcctccaatgggtcggctggatcaaccccaaaaccggccaacccaacaacccccgccaattccaaggccgcatctccctaacccgccaagcctcctgggacatcgacacattctccttctacatggacctcaaagcactccgctccgacgacaccgccgtctacttctgcgcccgccaccgctccgactactgggacttcgacgtctggggctccggcacccaagtcaccgtctcctccgcctccaccaaaggc

SEQ ID NO: 57832 - RNA, 384 nt, synthetic construct
  misc_feature 1..384: note = derived and/or modified sequence opt11 from anti-HIV_Chain
  source 1..384: mol_type = other RNA
caagtccacctctcccaatccggcgccgtcgtcaccaaacccggcgcctcagtccgcgtctcctgcgaagcctccggctacaaaatctccgaccacttcatccactggtggcgccaagcccccggccaaggcctccaatgggtcggctggatcaaccccaaaaccggccaacccaacatcccccgccaattccaaggccgcatctccctcacacgccaagcctccggcgacttcgacaccttctcattctacatggacctcaaagccctccgctccgacgacaccgccgtctacttctgcgcccgccaacgctccgactactgggacttcggcgtctggggctccggcacccaagtcaccgtatcctccgcctccaccaaaggc

SEQ ID NO: 57833 - RNA, 384 nt, synthetic construct
  misc_feature 1..384: note = derived and/or modified sequence opt11 from anti-HIV_Chain
  source 1..384: mol_type = other RNA
caagtgcacttgagccagagcggggccgtggtcacgaaaccgggcgcaagtgtgcgcgtgagctgtgaagcgagcgggtacaagatatcgggccatttcatacactggtggaggcaagcgcccgggcaagggctccagtgggtgggctggatcaatcccaagacagggcaaccgaacaatcccaggcaatttcaagggcgcatcagcttgaccaggcaagcgagctgggactttgacacgttctcgttctatatggatctcaaggccttgcgctcggacgataccgcggtctatttctgtgccaggcacaggagcgattactgggactttgacgtgtgggggagcgggacccaggtcacggtctcgagcgcgagcacgaaaggg

SEQ ID NO: 57834 - RNA, 384 nt, synthetic construct
  misc_feature 1..384: note = derived and/or modified sequence opt11 from anti-HIV_Chain
  source 1..384: mol_type = other RNA
caagtccacctatcccaatccggcgcagccgtcaccaaacccggcgcctcagtccgcgtctcctgcgaagcctccggctacaaaatctcagaccacttcatccactggtggcgccaagccccaggccaaggcctccaatgggtcggctggatcaaccccaaaacaggccaacccaacaacccccgccaattccaaggccgcatctccctcacacgccaagcctcctgggacttcgacaccttctccttctacatggacctcaaagccctccgctccgacgacaccgccgtctacttctgcgcccgccaccgctccgactactgggacttcgacgtctggggctccggcacccaagtcaccgtctcctccgcctccaccaaaggc

SEQ ID NO: 57835 - RNA, 384 nt, synthetic construct
  misc_feature 1..384: note = derived and/or modified sequence opt11 from anti-HIV_Chain
  source 1..384: mol_type = other RNA
caagtccacctctcacaatccggcgccgccgtcaccaaacccggcgcctcagtccgcgtctcctgcgaagcctccggctacaaaatctccgaccacttcatccactggtggcgccaagcccccggccaaggcctccaatgggtcggctggatcaaccccaaaaccggccaacccaacaaccccagacaattccaaggccgcgtctccctcacccgacaagcctcctgggacttcgacacctactccttctacatgggcctcaaagccgtccgctccgacgacacagccatctacttctgcgcccgccaacgctccgacttctgggacttcgacgtctggggctccggcacccaagtcaccgtctcctccgcctccaccaaaggc

SEQ ID NO: 57836 - RNA, 384 nt, synthetic construct
  misc_feature 1..384: note = derived and/or modified sequence opt11 from anti-HIV_Chain
  source 1..384: mol_type = other RNA
caagtccacctctcccaatccggcgccgtcgtaaccaaacccggcgcctccgtccgcgtctcctgcgaagcctccggctacaaaatctccgaccacttcatccactggtggcgccaagcccccggccaaggcctccaatgggtcggctggatcaaccccaaaaccggccaacccaacaacccccgccaattccaaggccgcatctccctcacccgccaagcctcctgggacttcgacaccttctccttctacatggacctaaaagccctccgctccgacgacaccgccgtctacttctgcgcccgccaccgctccgactactgggacttcgacgtatggggctcaggcacccaagtaaccgtctcctccgcctcaaccaaaggc

SEQ ID NO: 57837 - RNA, 384 nt, synthetic construct
  misc_feature 1..384: note = derived and/or modified sequence opt11 from anti-HIV_Chain
  source 1..384: mol_type = other RNA
caagtgcacttgagccagagcggggccgtggtcacgaaaccgggcgcgagcgtgcgagtgagctgtgaagcgagcgggtacaagatatcggaccatttcatacactggtggaggcaagcgcccgggcaagggctccagtgggtaggctggatcaatcccaagaccgggcaaccgaacaatcccaggcaatttcaagggcgcatcagcttgaccaggcaagcgagctgggactttgacacgttctcgttctatatggatctcgaggccttgcgctcggacgataccgcggtctatttctgtgccaggcaaaggagcgattactgggactttgacgtgtgggggagcgggacccaggtcacggtctcgagcgcgagcacgaaaggg

SEQ ID NO: 57838 - RNA, 384 nt, synthetic construct
  misc_feature 1..384: note = derived and/or modified sequence opt11 from anti-HIV_Chain
  source 1..384: mol_type = other RNA
caagtccacctctcccaatccggcgccgccgtcaccaaacccggagcctccgtacgcgtctcctgcgaagcatccggctacaaaatccgcgactactccatccactggtggcgccaagcccccggccaaggcctccaatgggtcggctggataaacccccaaaccggccaacccaacatcccccgccccttccaaggccgcatctccctcacccgccaagcctcctgggacttcgacaccttctccttctacatggacctcgaagccctccgctccgacgacaccgcagtctacttctgcgcccgccaacgctcagactactgggacttcgacgtctggggctccggcacccaagtcaccgtctcctccgcctccaccaaaggc

SEQ ID NO: 57839 - RNA, 384 nt, synthetic construct
  misc_feature 1..384: note = derived and/or modified sequence opt11 from anti-HIV_Chain
  source 1..384: mol_type = other RNA
caagtccacctctcccaatcaggcgccgccgtcaccaaacccggcgcatccgtccgcgtctcctgcgaagcctccggctacaaaatctccgaccacttcatccactggtggcgccaagcccccggccaaggcctccaatgggtcggctggatcaaccccaaaaccggccaacccaacaacccccgccaattccaaggacgcatctccctcacccgccaagcctcatgggacttcgacaccttctccttctacatggacctcaaagccctccgctccgacgacaccgccgtctacttctgcgcccgccaacgctccgactaccgcgacttcgacgtctggggctccggcacccaagtcaccgtctcctccgcctccaccaaaggc

SEQ ID NO: 57840 - RNA, 384 nt, synthetic construct
  misc_feature 1..384: note = derived and/or modified sequence opt11 from anti-HIV_Chain
  source 1..384: mol_type = other RNA
caagtccacctctcccaatccggcgccgtcgtcaccaaacccggcgcctccgtccgcgtctcctgcgaagcctcaggctacaaaatctccgaccacttcatccactggtggcgccaagcccccggccaaggaccccaatgggtcggctggatcaaccccaaaaccggccaacccaacaacccccgccaattccaaggccgcatctccctcacccgccaagcctcctgggacttcgacaccttctccttctacatggacctaaaagccctccgctcagacgacaccgccgtctacttctgcgcccgccaccgctccgactactgggacttcgacgtctggggctccggcacccaagtcaccgtctcctcagcctccaccaaaggc

SEQ ID NO: 57841 - RNA, 384 nt, synthetic construct
  misc_feature 1..384: note = derived and/or modified sequence opt11 from anti-HIV_Chain
  source 1..384: mol_type = other RNA
caagtgcgattgctccagagcggggccgcggtcacgaaaccgggcgcgagcgtgcgcgtgagctgtgaagcgagcgggtacgagatcagggactatttcatacactggtggaggcaagcgcccgggcaagggctccagtgggtgggctggatcaatcccaagaccgggcaaccgaacaatcccaggcaatttcaagggcgagtgagcttgaccaggcaagcgagctgggactttgactcgtactcgttctatatggatctcaaggccttgcgctcggacgataccgcggtctatttctgtgccaggcaaaggagcgattactgggactttgacgtgtgggggagcgggacccaggtcacggtctcgagcgcaagcacgaaaggg

SEQ ID NO: 57842 - RNA, 384 nt, synthetic construct
  misc_feature 1..384: note = derived and/or modified sequence opt11 from anti-HIV_Chain
  source 1..384: mol_type = other RNA
caagtgcgcttgctacagagcggggccgcggtcacgaaaccgggcgcgagcgtgcgcgtgagctgtgaagcgagcgggtacgagatcagggactatttcatacactggtggaggcaagcgcccgggcaagggctccagtgggtgggctggatcaatcccaagaccggacaaccgaacaatcccaggcaatttcaagggcgcgtgagcttgacaagacaagcgagctgggactttgactcgtactcgttctatatggatctcaaggccttgcgctcggacgataccggggtctatttctgtgccaggcaaaggagcgattactgggactttgacgtgtgggggagcgggacccaggtcacggtctcgagcgcgagcacgaaaggg

SEQ ID NO: 57843 - RNA, 384 nt, synthetic construct
  misc_feature 1..384: note = derived and/or modified sequence opt11 from anti-HIV_Chain
  source 1..384: mol_type = other RNA
caagtccgcctcctccaatccggagccgccgtcaccaaacccggcgcctccgtccgcgtctcctgcgaagcctccggctacgaaatccgcgactacttcatccactggtggcgccaagcccccggccaaggcctacaatgggtcggctggatcaaccccaaaaccggccaacccaacaacccccgccaattccaaggccgcgtctccctcacccgccaagcctcctgggacttcgactcctactccttctacatggacctcaaagccctccgctccgacgacaccgccgtctacttctgcgcccgccaacgctccgactactgggacttcgacgtctggggctccggctcccaagtcaccgtctcctccgcctccaccaaaggc

SEQ ID NO: 57844 - RNA, 384 nt, synthetic construct
  misc_feature 1..384: note = derived and/or modified sequence opt11 from anti-HIV_Chain
  source 1..384: mol_type = other RNA
caagtccaactcctccaatccggcgccgccgtcaccaaacccggcgcctcagtccgagtctcctgcgaagcctccggctacaacatccgcgactacttcatccactggtggcgccaagcccccggccaaggcctacaatgggtcggctggatcaaccccaaaaccggccaacccaacaacccctgccaattccaaggccgagtctccctcacccgccaagcctcctgggacttcgacaccatctccttctacatggacctcaaagccctccgcctcgacgacaccgccgtctacttctgcgcccgccaacgctccgactactgggacttcgacgtctggggctccggcacccaagtcaccgtctcctccgcctccaccaaaggc

SEQ ID NO: 57845 - RNA, 384 nt, synthetic construct
  misc_feature 1..384: note = derived and/or modified sequence opt11 from anti-HIV_Chain
  source 1..384: mol_type = other RNA
caagtgcaattgctccagagcggggccgcggtcacgaaaccgggcgcaagcgtgcgcgtgagctgtgaagcgagcgggtacaatatcagggactatttcatacactggtggaggcaagcgcccgggcaagggctccagtgggtgggctggatcaatcccaagaccgggcaaccgaacaatcccaggcaatttcaagggcgagtgagcctgaccaggcacgcgagctgggactttgacacgttctcgttctatatggatctcaaggccttgcgctcggacgatacagcggtctatttctgtgccaggcaaaggagtgattactgggactttgacgtatgggggagcgggacccaggtcatagtctcgagcgcgagcacgaaaggg

SEQ ID NO: 57846 - RNA, 384 nt, synthetic construct
  misc_feature 1..384: note = derived and/or modified sequence opt11 from anti-HIV_Chain
  source 1..384: mol_type = other RNA
caggtccagctcgtgcaatcgggcgcggacgtgaaaaagcccggggccacggtcacggtctcgtgcaagaccgatgaagatgaagatgactttcgcgcgcacttgatgcagtggatgcgccaggccccgggccagcgcctggaatgggtcgggtggataaaaccgcaaacgggccagccctcgtacgggcaaaagttccagggcagggtcacgctcacgcgcgaggtctcgacctcgaccgtgttcctgcaattgcgcaatctcaggagcgatgacacggccgtgtactattgcgcgcgaccgcgcgggggcagggacaattggtcgttccatgtctggggcaggggcacgctcgtgaccgtgagctcggcctcaaccaagggc

SEQ ID NO: 57847 - RNA, 384 nt, synthetic construct
  misc_feature 1..384: note = derived and/or modified sequence opt11 from anti-HIV_Chain
  source 1..384: mol_type = other RNA
gaagtgcaattggtcgagagcggggccgaggtcaagaaaccgggcgcgagcgtgaaagtgagctgtaaagtgagcgggaactcgctcacggaatttagcatacactgggtcaggcaagcgcccgggaaagggctcgagtggatgggcgggttcgatccagaggaaggggaaacggtcccggcccagaaatttaaagggcgcttgaccatgaccgaggacacgagcacgaacacggcctatatggagctctcgagcttgcgatcggaagataccgcggtctattactgtagcacggaaccgcgagagatggggaccctgaccgcgggatttgaatattgggggcaagggaccctggtcacggtctcgagcgcgagcacgaaaggg

SEQ ID NO: 57848 - RNA, 384 nt, synthetic construct
  misc_feature 1..384: note = derived and/or modified sequence opt11 from anti-HIV_Chain
  source 1..384: mol_type = other RNA
cgagtgcaattgggccagagcggggcagaggtcaagaaaccgggcgcgagcgtgaaagtgagctgtaaagtgagcgggaactcgctcacggaatttagcatacactgggtcaggcaagcgccagggaaagggctcgagtggatgggcgggttcgatcccgaggaaggggaaacggtcccggcccagaaatttaaagggcgcgtgaccatgaccgaggacacgagcacgaacacggcctatatggagctatcgagcttgcgctcggaagataccgcggtctattactgtagcacggaaccgcgagagatggggaccttgaccgcgggctttgaatattgggggcaagggaccttggtcatagtctcgagcgcgagcacgaaaggg

SEQ ID NO: 57849 - RNA, 384 nt, synthetic construct
  misc_feature 1..384: note = derived and/or modified sequence opt11 from anti-HIV_Chain
  source 1..384: mol_type = other RNA
caagtgcaattggtccagagcggggccgatgtcaagaaaccgggcgcgagcgtgaccgtgagctgtaaaacggacgaggacgaggacgatttcagggcccatctcgtgcaatggatgaggcaagcgcccgggcaaaggctcgagtgggtgggctggatcaagccccagaccgggcaaccgagctatgcccagaaatttcaagggcgcgtgaccttgaccagagaagtgagcacgagcacggtctttctccagctcaggaacttgcgctcggacgataccgcggtctattactgtgccaggcccaggggcgggcgcgataactggagctttcacgtgtgggggcgcgggaccttggtcacggtctcgagcgcgagcacgaaaggg

SEQ ID NO: 57850 - RNA, 384 nt, synthetic construct
  misc_feature 1..384: note = derived and/or modified sequence opt11 from anti-HIV_Chain
  source 1..384: mol_type = other RNA
caagtccaactccaagaatccggccccggcctcgtcaaaccctccgaaaccctctccctcacttgctccgtctccggcgcctccatctccaacttctactggacctggatacgccaacccgccggaaaaggcctcgaatgggtcggccgcctctactcctccgaccgcaccaactacaacccctccctcaacggccgcgtcaccatgtccctcgacacctccaaaaaccaattctcactccgcctcacctccatgaccgacgccgacaccgccatctacttctgcgcccgcgaaaaaggccaatggctcaccgtccccccctactacttcgactcctggggccaaggcatcctcgtcaccgtctcctccgcctccaccaaaggc

SEQ ID NO: 57851 - RNA, 384 nt, synthetic construct
  misc_feature 1..384: note = derived and/or modified sequence opt11 from anti-HIV_Chain
  source 1..384: mol_type = other RNA
caagtccaactcgtccaatccggcgccgaagtccgcaaacccggcgcctccgtcaaagtctcatgcaaaacctccggctacaccttcaccaactcctacatccactgggtacgccaagcccccggccaaggcctcgaatggatgggcatcatcaacccccccggcggcaacacctactacgcccaaaaattccacggccgcgtcacactcacccgcgacacctccacctccaccgtctacatggaactcaactccctccgctccgaagacaccgccgtctacttctgcgcccgcccccactcccccaccaacatcccctcccgccccctcgactactggggccaaggcaccctcgtcaccgtctcctccgcctccaccaaaggc

SEQ ID NO: 57852 - RNA, 384 nt, synthetic construct
  misc_feature 1..384: note = derived and/or modified sequence opt11 from anti-HIV_Chain
  source 1..384: mol_type = other RNA
caagtccaactccaagaatccggccccggcctcgtcaaaccctccggcaccctctccctcacatgcaacgtctacggcggctcaatgatctcctactactggtcatggatccgccaaccacccggcaaaggcctcgaatggatcggccacgtctacaactccggcaacaccaaatactccccctccctcaaaaaccgcgtcaccatatccatggacacctcccgcaacctcttctccctcaaagtcacctccgtcacccccgccgacaccgccgtctactactgcgcccgcgccgactacgacaacatctgggactcccgcggcggcttcgacctctggggacaaggcaccctcgtcaccgtctcctccgcctcaaccaaaggc

SEQ ID NO: 57853 - RNA, 384 nt, synthetic construct
  misc_feature 1..384: note = derived and/or modified sequence opt11 from anti-HIV_Chain
  source 1..384: mol_type = other RNA
caagtgcaattggtccagagcggggccgaggtcaagaaaccgggctcgagcgtgaaagtgagctgtaaagcgagcgggggcacgctctcgagctataccataagctgggtcaggcaagcgcccgggcaagggctcgagtggatgggcaggctcatacccttggtcgatatcacgacctatgcccagaaatttcaagggcgcgtgaccataaccgcggacacgagcacgaacacggcctatatggagctctcgaacttgcgctcggaagataccgcgatctatcactgtgccacgagcacgatgatagccgcggtcataaacgatgcctttgacttgtgggggcaagggaccacggtcacggtctcgagcgcgagcacgaaaggg

SEQ ID NO: 57854 - RNA, 384 nt, synthetic construct
  misc_feature 1..384: note = derived and/or modified sequence opt11 from anti-HIV_Chain
  source 1..384: mol_type = other RNA
caagtgcaattggtccagagcggggccgaggtcaagaaaccgggcgcgagcgtgaaaataagctgtaaagcgagcgggtactcgttcaggaactatgccgtgcactgggtcaggcaagcgccagggcaagggctcgagtggatgggcgagatcaatggcgggaacgggaacacggaatatagccagaaatcgcaagggcgcctgaccataaccagggacataagcgcgaccacggcctatatggagctctcgagcttgcgctcggacgataccgcggtctattactgtgccagggtcgcgtacgtgcacgtggtcacgaccaggagcttggacaattgggggcaagggaccttggtcacggtctcgagcgcgagcacgaaaggg

SEQ ID NO: 57855 - RNA, 384 nt, synthetic construct
  misc_feature 1..384: note = derived and/or modified sequence opt11 from anti-HIV_Chain
  source 1..384: mol_type = other RNA
caagtccgcctctcacaatccggcgccgccgtcatgaaaaccggcgcctccgtcaccatctcctgcgaaaccgaaggcttcaacttcgtcaactacatcatccactgggtccgccgcccccccggccgcggcttcgaatggctcggcatgatcgacccccgcaacggccacccctggttcgcccaaaccgtccgcggccgcctctcactccgccgcgacaccttcaacgaaatcgtctacatgaccctctccggcctcaccaccgacgacaccggcctctacttctgcgcccgcaacgaaccccaataccactccctccccggcatgttcgactactggggacaaggcacccccgtcaccgtctcatccgcctccaccaaaggc

SEQ ID NO: 57856 - RNA, 384 nt, synthetic construct
  misc_feature 1..384: note = derived and/or modified sequence opt11 from anti-HIV_Chain
  source 1..384: mol_type = other RNA
caagtgcgcttgagccagagcggggccgcggtcgtgaaaacgggcgcgagcgtgaccataagctgtgaaacggaagggtacaatttcgtgaactatatcatacactgggtcaggcgcccgcccgggcgcgggttcgagtggttgggcatgatcgatcccaggaacgggcacccgtggtttgcccagaccgtgcgcgggcgcttgagcttgcgcagagacacgttcaaggaaacggtctatatgacgctctcgggcttgacatcggacgataccggggtctatttctgtgccaggaacgagccccagtaccatagcttgcccgggatgtttgactattgggggcacgggaccccggtcacggtctcgagcgcgagcacgaaaggg

SEQ ID NO: 57857 - RNA, 384 nt, synthetic construct
  misc_feature 1..384: note = derived and/or modified sequence opt11 from anti-HIV_Chain
  source 1..384: mol_type = other RNA
caagggcaattggtccagagcgggggcggggtcaagaaattgggcacgagcgtgaccataagctgtctcgcgagcgagtacacgttcaatgaatttgtcatacactggatcaggcaagcgcccgggcaagggcccttgtggctgggcttgatcaagagatcgggcaggctcatgacctcgtaccagttccaggacaggctctcgctcaggcgcgatcgctcgaccgggaccgtgttcatggaattgcgcgggctcagggtcgatgacacggccgtgtactattgcgcgcgcgatggcttgggcgaggtcgcgccagcgtacttgtacgggatcgatgcctggggccagggcacgaccgtgatcgtgacctcagcctcgacctca

SEQ ID NO: 57858 - RNA, 384 nt, synthetic construct
  misc_feature 1..384: note = derived and/or modified sequence opt11 from anti-HIV_Chain
  source 1..384: mol_type = other RNA
caagtgcaattggtccagagcggggccgaggtcaagaaaccgggcgcgagcgtgaaagtgagctgtaaagcgagcgggtacacgttcacgagctatgacataaactgggtcaggcaagcgaccgggcaagggctcgagtggatgggctggatgaatcccaatagcgggaacacgggctatgcacagacctttcaagggcgcgtgaccatgaccaggaacacgagcataagcacggcctatatggagctctcgagcttgcgctcggaagataccgcggtctattactgtgccagggacaggtggttgccccagtactattactatggcatggacgtgtgggggcaagggaccacggtcacggtctcgagcgcgagcacgaaaggg

SEQ ID NO: 57859 - RNA, 384 nt, synthetic construct
  misc_feature 1..384: note = derived and/or modified sequence opt11 from anti-HIV_Chain
  source 1..384: mol_type = other RNA
caggtccagctcgtgcaatcgggcgcggaagtgaaaaagcccgggagctcgatgaaggtctcgtgcaagagctcgggcgggacctttagcaatcacgcaatctcgtgggtgcgccaggccccgggcaagggcttggaatggatgggcgggataatcccgatgtcgggcacgaccaattacttgcaaaagttccagggcagggtcacgatcacggccgatgaatttgccacgaccgcgtacatggaattgagctcgctaacgagcgaggacacggccgtgtactattgcgcgcgcgcacgcgcggactcgcacacgcccatagacgcgttcgatatctggggcccgggcacgcgcgtgatcgtgagctcggcctcgaccaagggc

SEQ ID NO: 57860 - RNA, 384 nt, synthetic construct
  misc_feature 1..384: note = derived and/or modified sequence opt11 from anti-HIV_Chain
  source 1..384: mol_type = other RNA
caagtgcaattggtccagagcggggccgaggtcaagaaaccgggcgcgagcgtgaaagtgagctgtaaagtgagcgggtacacgctcacggaattgagcatacactgggtcaggcaagcgcccgggaaaaggctagagtggatgggcgggttcgatcccgaggacggggaaaggatctatgcccagaaatttcaagggcgcgtgaccatgaccgaggacacgagcacggacacggcctatatggagctaaatagcttgcgctcggacgataccgcggtctattactgtgccacgggcgggctctattgctcgagcataagctgtatcatggacgtgtgggggcaagggaccacggtcacggtctcgagcgcgagcacgaaaggg

SEQ ID NO: 57861 - RNA, 384 nt, synthetic construct
  misc_feature 1..384: note = derived and/or modified sequence opt11 from anti-HIV_Chain
  source 1..384: mol_type = other RNA
caagtgcaattggtccagagcggggccgaggtcaagatgccgggcgcgagcgtgaaagtgagctgtaaagtgagcgggtactcgctcacggaactgagcatacactgggtcaggcaagcgcccgggaaaaggctcgagtggatgggcgggttcgatcccgaggacgatgaaaggatctatgcccagaaatttcaagatcgcgtgaccatgaccgaggacacgagcacggacacggcctatatggatctcaatagcctgcgctcggaagataccgcggtctattactgtaccacgggcgggctctattgctcgagcataagctgtatcatggacgtgtgggggcaagggaccacggtcatagtctcgagcgcgagcacgaaaggg

SEQ ID NO: 57862 - RNA, 387 nt, synthetic construct
  misc_feature 1..387: note = derived and/or modified sequence opt11 from anti-HIV_Chain
  source 1..387: mol_type = other RNA
gaagtgcaattgagcgagagcgggggcgggttcgtgaaaccgggcgggagcttgcgcttgagctgtgaagcgagcgggttcacgttcaataactatgcaatgagctgggtaaggcaagcgcccgggaaagggctcgagtgggtgagcgtgacctcggcccatggtgggagcgcgtactatggcgagttcgtgaaagggcgctttacaatgagcagggaccatttcatagacacggtctatctcgagatgaatggcttgaccgtggaagataccgcggtctattactgtgtcagggtcacgttctatcacgagggctcgggctattactatcgcgcgggcaattactttgactcgtgggggaaagggaccagggtagtggtctcggcc

SEQ ID NO: 57863 - RNA, 387 nt, synthetic construct
  misc_feature 1..387: note = derived and/or modified sequence opt11 from anti-HIV_Chain
  source 1..387: mol_type = other RNA
gaagtgcaattgagcgagagcgggggcgggttcgtgaaaccgggcgggagcttgcgcttgagctgtgaagcgagcgggttcacgttcaataactatgccatgagctgggtaaggcaagcgcccgggaaagggctcgagtgggtgagcgtgacctcggcccatggcgggagcgcgtactatggcgagttcgtgaaagggcgctttaccatgagcagggaccatttcatagacacggtctatctcgagatgaatcgcttgaccgtggaagataccgcggtctattactgtgtcagggtcacgttctatcacgagggctcgggctattactatcgcgcgggcaattactttgactcgtgggggaaagggaccagggtcgtggtctcggcc

SEQ ID NO: 57864 - RNA, 387 nt, synthetic construct
  misc_feature 1..387: note = derived and/or modified sequence opt11 from anti-HIV_Chain
  source 1..387: mol_type = other RNA
gaagtccaactctccgaatccggcggcggcgtcgtcaaacccggcggctccctccgactctcctgcgaagcctccggcttcaccttctccaactacgcaatgtcctgggtccgacaagcccccggcaaaggcctcgaatgggtctcagtcaccggcggccacggcacctacggctactacggcgaattcgtcaaaggccgattcaccatctcccgcgaccactccatggacaccgtctacctccaaatgaaccgcctccgcgtcgaagacaccgccgtctactactgcgtccgcaccccctactaccacgaatcctccggctactactaccgcgccggcaactacttcgacttctggggcaaaggcaccctagtcatcgtctccgcc

SEQ ID NO: 57865 - RNA, 387 nt, synthetic construct
  misc_feature 1..387: note = derived and/or modified sequence opt11 from anti-HIV_Chain
  source 1..387: mol_type = other RNA
gaagtgcaattgagcgagagcgggggcgggttcgtgaaaccgggcgggagcctgcgcttgagctgtgaagcgagcgggttcacgttcaataactatgccatgggctgggtcaggcaagcgcccgggaaagggctcgagtgggtgagcgtgacctcggcccatggagggagcgcgtactttggcgagttcgtgaaagggcgatttaccatgagcagggaccatttcatagacacggtctatctcgagatgaatcgcttgaccgtggaagataccgcggtctattactgtgtaagggtcacgttctatcacgagggctcgggctattactatcgagcgggcaattactttgactcgtgggggcaagggaccttggtcatagtctcggcc

SEQ ID NO: 57866 - RNA, 387 nt, synthetic construct
  misc_feature 1..387: note = derived and/or modified sequence opt11 from anti-HIV_Chain
  source 1..387: mol_type = other RNA
caagtgcaattggtcgagagcgggggagggctcgtgcaaccgggcgggagcttgcgattgagctgtgccgcgagcgggttcacgttctcgacccattggatgcactgggtcaggcaagcgccagggaaagggctcgtgtgggtgagcaggatccatagcgatggcaggagcacgagctatgccgatagcgtgaaagggcgatttaccataagcagggacaatgccaagaacacgctctatctacagatgaatagcttgcgcgcggaagataccgcggtctattactgtgccaggggcgcggccgtgttcggggtcgtgatcataggcgggatggatctctggggacagggcacgaccgtgaccgtgagctcggcctcgaccaagggc

SEQ ID NO: 57867 - RNA, 387 nt, synthetic construct
  misc_feature 1..387: note = derived and/or modified sequence opt11 from anti-HIV_Chain
  source 1..387: mol_type = other RNA
caagtgcaattggtcgagagcgggggcgcgctcgtgcaaccgggcgggagcttgcgcttgagctgtgccgcgagcgggttctcgttctcgagctatgccatgagctgggtcaggcaagcacccgggaaagggctcgagtgggtgagcgcgatctcgcgctcgggcgggagcacgtactatgccgatagcgtgaaagggcgctttaccataagcatagacaatagcaataacacgctatatctccagatgaatagcttgcgcgtggaagataccgcggtctattactgtgccaagcgcgaggccttttactatggcgcgggcgggtacgggatggatgtctggggccagggcacgaccgtgaccgtgagctcggcctcgaccaagggc

SEQ ID NO: 57868 - RNA, 387 nt, synthetic construct
  misc_feature 1..387: note = derived and/or modified sequence opt11 from anti-HIV_Chain
  source 1..387: mol_type = other RNA
ttccaaggccacctcgtccaatccggcggcggcgtcaaaaaacccggcacctccgtcaccctctcctgcctcgcctccgaatacaccttcaccgaattcaccatccactggatccgccaagcccccggccaaggccccctctggctcggcctcatcaaacgctcaggccgcctaatgacctcctaccgcttccaagaccgcctctccctccgccgcgaccgctccaccggcaccgtcttcatggaactccgctccctccgaaccgacgacaccgccgtatactactgcgcccgcgacggcctcggcgaactcgcccccgcctaccactacggcatcgacgcctggggccaaggcaccacagtcatcgtcacctccgcctccacctca

SEQ ID NO: 57869 - RNA, 387 nt, synthetic construct
  misc_feature 1..387: note = derived and/or modified sequence opt11 from anti-HIV_Chain
  source 1..387: mol_type = other RNA
caagggctcttggtccagagcgggggcggggtcaagaaattgggcacgagcgtgaccataagctgtctcgcgagcgagtacacgttcaatgagttcgtcatacactggatcaggcaagcgcccgggcaagggcccttgtggttgggcttgatcaagcgctcgggcaggctcatgacctcgtaccagttccaggacaggctctcgctcaggcgcgatcgctcgaccgggaccgtgttcatggaattgcgcgggctcagggtagatgacacggccgtgtactattgcgcgcgcgatggcttgggcgaagtcgcgcccgcgtacttgtacgggatcgatgcctggggccagggcacgaccgtgatcgtgacctcggcctcgaccaagggc

SEQ ID NO: 57870 - RNA, 387 nt, synthetic construct
  misc_feature 1..387: note = derived and/or modified sequence opt11 from anti-HIV_Chain
  source 1..387: mol_type = other RNA
aacttcatgctcacccaacccgcctccgtctccggctcccccggccaatccatcaccatctcctgctcaggcaccggctccgacatcggcgtctacaactacgtctcctggtaccaacaacaccccggcaaagccccccgcctcatgatctacgacgtcaccaaccgcccctccggcgtctccaaccgcttctccggctccaaatccggcttcaccgcctccctcaccatctccggcctccaaggcgacgacgaagccgactactactgctcctcctactcctccaccaacacctacgtcttcggcaccggcacccacgtcaccgtactcggccaacccaaagccaaccccaccgtcaccctcttccccccctcctccgaagaactc

SEQ ID NO: 57871 - RNA, 387 nt, synthetic construct
  misc_feature 1..387: note = derived and/or modified sequence opt11 from anti-HIV_Chain
  source 1..387: mol_type = other RNA
caatccgccctcacccaaccccgctccgtctccggctcccccggccaatccgtcaccatctcatgcaccggcacctcatccgacgtcggcgcctacaactacgtctcctggtaccgccaacaccccggcaaagcccccaaactcatgatcaacgacgtctccaaacgcccctccggcgtccccgaccgcttctccggctccaaatccggcaacaccgcctccctcaccatctccggcctccaagccgaagacgaagccgactactactgctgctcctacgccggcacctactcctacgtcttcggcaccggcaccaaagtcaccgtcctcggccaacccaaagccaaccccaccgtcaccctcttcccaccctcatccgaagaactc

SEQ ID NO: 57872 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcgggctcaagaaaccgggcacgagcgtgaccataagctgtctcgcgagcgagtacacgttcaatgaatttgtcatacactggatcaggcaagcgcccgggcaagggcccttgtggttgggattgatcaagcgctcgggcaggctaatgacagcgtacaatttccaggacaggctctcgctcaggcgcgatcgctcgaccgggaccgtgttcatggaattgcgcgggctcaggcccgatgacacggccgtgtactattgcgcgcgcgatggcttgggcgaggtcgcgcccgattacaggtacgggatcgatgtctggggccagggctcgaccgtgatcgtgacagcggcctcgaccaagggc

SEQ ID NO: 57873 - RNA, 387 nt, synthetic construct
  misc_feature 1..387: note = derived and/or modified sequence opt11 from anti-HIV_Chain
  source 1..387: mol_type = other RNA
aacttcatgctcacccaacccccctccgcctccggcgcccccggccaacgcgtcaccatctcctgctccggcggcccctccaacgtcggcggcaactacgtctactggtaccgccaattccccggcacagcccccaacctcctcatcctccgcgacgaccaacgcccctccggcgtccccgaccgcttctccgcctccaaatccggcaactccgcctccctcgccatctccggcctccgacccgacgacgaagccttctacttctgcgccacctacgactccgacggctccatccgcctcttcggcggcggcaccaccctcaccgtcctctcccaacccaaagccgccccctccgtcaccctcttccccccctcctccgaagaactc

SEQ ID NO: 57874 - RNA, 387 nt, synthetic construct
  misc_feature 1..387: note = derived and/or modified sequence opt11 from anti-HIV_Chain
  source 1..387: mol_type = other RNA
caactcgtcctcacccaacccccatccgtctccggcgcccccggccaacgcgtcaccatctcctgctccggcggcccctccaacgtcggaggcaacctagtctactggtacaaacaattccccggcaccgcccccaaactcctcatccgccgagacgaccaacgcccatccggcgtccccgaccgcttctccggctccaaatccggcaactccgcctccctcaccatctccggcctccgccccgacgacgaagccttctacttctgcgccacctacgactcccaaggctccacccgcctattcggcggcggcaccgtcctcaccgtcctctcccaacccaaagccgccccctccgtcaccctcttcccaccctcctccgaagaacta

SEQ ID NO: 57875 - RNA, 387 nt, synthetic construct
  misc_feature 1..387: note = derived and/or modified sequence opt11 from anti-HIV_Chain
  source 1..387: mol_type = other RNA
aacttcatgctcacccaacccccctccgtctccggcgcccccggccaacgtgtcaccatctcctgctccggcggcccctccaacgtcggcggcaacctcgtctactggtacaaacaattccccggcaccgcccccaaactcctcatccgccgcgacgaccaacgcccctccggcgtccccgaccgcttctccggctccaaatccggcaactccgcctccctcgccatctccggcctccgccccgacgacgaagccttctacttctgcgccacctacgactcccacggctccatccgcctcttcggcggcggcaccctcctcaccgtcctctcccaacccaaagccgccccctcagtcaccctcttccccccctcctccgaagaactc

SEQ ID NO: 57876 - RNA, 387 nt, synthetic construct
  misc_feature 1..387: note = derived and/or modified sequence opt11 from anti-HIV_Chain
  source 1..387: mol_type = other RNA
caatccgccctcacccgcaccccctccgtctcaggcgcccccggccaacgagtcaccatctcctgctccggcggcccctccaacgtcggcggcaactacgtctactggtaccaacaattccccggcgccgcccccaaactcctaatccgccgcgacgaccaacgcccatccggcgtccccgaccgcttctccggctccaaatccggcaactccgcctcactcgccatctccggcctccgcctcgacgacgaagcctactacttctgcgccacctacgactccggctggtccatccgcctcttcggcggcggcacccgcctcaccgtcctctcccaacccaaagccgccccctccgtcaccctattcccaccctcatccgaagaactc

SEQ ID NO: 57877 - RNA, 387 nt, synthetic construct
  misc_feature 1..387: note = derived and/or modified sequence opt11 from anti-HIV_Chain
  source 1..387: mol_type = other RNA
caatccgccctcacccaacccccctccgtctccgccacccccggccaaaccgtcaccatctcctgctccggctccggctccaacgtcggcggcaaccacgtctactggtaccgccaactccccggcgccgccccaaccctccttatctccaaaaccgaccaccgcccctcccgcgtccccgaccgcttctccgcatccaaatccggcaactccgcctccctcgccatctccggcctccgccccgacgacgaagccatctacttctgcgccacctacgacacaggcctctccctccgcctcttcggcggcggcacacgcctcaccgtcctctcccaacccaaagccgccccctccgtcaccctcttccccccctcctccgaagaactc

SEQ ID NO: 57878 - RNA, 387 nt, synthetic construct
  misc_feature 1..387: note = derived and/or modified sequence opt11 from anti-HIV_Chain
  source 1..387: mol_type = other RNA
caggtccagctcttggaatcgggcccgggcttggtcacgccctcgggcacgctatcgctcgcgtgcgcggtctcgggcgcgagcataagctcgagccattggtggacctgggtaaggcaatcgcccggaaaagggctcgagtggataggcgagatcgatcgcaggggcacgaccaattacaatccctcgctcaggagcagggtcacgatcttgctcgataactcgaaaaatcaatttagcttgagcttgcgctcggtcacggccgcggacacggccgtgtactattgcacgaaagtgtacgcgggcttgttcaatgaaaggacctatggaatggacgtgtgggggcacgggaccacggtcctggtctcgagcgcgagcacgaaaggg

SEQ ID NO: 57879 - RNA, 387 nt, synthetic construct
  misc_feature 1..387: note = derived and/or modified sequence opt11 from anti-HIV_Chain
  source 1..387: mol_type = other RNA
caagccgtcgtcacccaaccaccctccgtctccgctacccccggccaaaccgtcaccatctcctgctccggctcaggctccaacgtcggcggcaaccacgtctactggtaccgacaactccccggcgccgcccccaccctcctcatctcaaaaaccaaccgccgcccctcccaagtccccgaccgcttctccggctccaaatcaggcaactccgcctccctcgccatctccggcctccgccccgacgacgaagccgactacttctgcgccacctacgacaccgacctctccctccgcctcttcggcggcggcacccgcctcaccgtcctctcccaacccaaagccgccccctccgtcaccctcttccccccctcatccgaagaactc

SEQ ID NO: 57880 - RNA, 387 nt, synthetic construct
  misc_feature 1..387: note = derived and/or modified sequence opt11 from anti-HIV_Chain
  source 1..387: mol_type = other RNA
caatccgccctcacccaacccccctccgtctccggcacccccggccaaaacgtcaccatctcctgctccggcggcggctccgacgtcggcggcaacctcgtctcctggtaccaacacttcccaggcgccgcccccaaactcctcatccaccgcgacaaccaacgcccctccggcgtccccgaccgcttctccgccctcaaatccggcaactccgcctccctcgccatctccggcctccgctccgacgacgaagccttctacttctgcgccgtctacgactcctccctctccctcggcctcttcggcggcggcaccaaactcaccgtcctctcccaacccaaagccgccccctccgtcaccctcttccccccctcctccgaagaactc

SEQ ID NO: 57881 - RNA, 387 nt, synthetic construct
  misc_feature 1..387: note = derived and/or modified sequence opt11 from anti-HIV_Chain
  source 1..387: mol_type = other RNA
caatccgccctcacccaacccccctccgcctccggcacccccggccaacgcgtcaccatctcctgctccggcggcggctccaacatcggcggcaacctcgtctcctggtaccaacacttccccggcaccgcccccaaactcctcatctaccgcaacgaccaacgcccctccggcgtccccgaccgcttctccggctccaaatccggcacctccgcctccctcaccatctccggcctccgatccgacgacgaagccacctacttctgcgccgcctacgactcctcactctccctccgcctcttcggcggcggcaccaccctcaacgtcctctcacaacccaaagccgccccctccgtcaccctcttccccccctcctccgaagaactc

SEQ ID NO: 57882 - RNA, 387 nt, synthetic construct
  misc_feature 1..387: note = derived and/or modified sequence opt11 from anti-HIV_Chain
  source 1..387: mol_type = other RNA
caatccgccctcacccaacccccctccgtctccgccacccccggccaaaccgtcaccatctcctgctccggctccggctccaacgtcggcggcaaccacgtctactggtaccgccaactcccaggcgccgcccccaccctcctcatctccaaaaccaaccaccgcccctcccaagtccccgaccgcttctccgcctccaaatccggcaactccgcctccctcgccatctccggcctacgccccgacgacgaagccgactacttctgcggcacctacgacacctccctctccctccgcctcttcggcggcggcacccgcctcaccgtcctctcccaacccaaagccgccccctccgtcaccctcttccccccctcctccgaagaactc

SEQ ID NO: 57883 - RNA, 387 nt, synthetic construct
  misc_feature 1..387: note = derived and/or modified sequence opt11 from anti-HIV_Chain
  source 1..387: mol_type = other RNA
caatccgtactcacccaagtcctctccgtctccggcacccccggccaacgcgtcatcatctcatgctccggcacctcctccaacgtcggcggcaacctcgtctcatggtaccaacacctccccggcgccgccccccgcctactcatccaccgcgacgaccaacgcccctccggcgtccccgaccgcttctccggctccaaatccggcaactcagcctccctagtcatctccggcctccgctccgacgacgaagccgactacttctgcggcgcctacgactccaccttctccctccccgtattcggcggcggcacccgcctcaccgtcctctcccaacccaaagccgccccctccgtcaccctcttccccccctcctccgaagaactc

SEQ ID NO: 57884 - RNA, 387 nt, synthetic construct
  misc_feature 1..387: note = derived and/or modified sequence opt11 from anti-HIV_Chain
  source 1..387: mol_type = other RNA
caatccgccctcacccaaccccccgccacctcaggcacccccggccaacgcgtcaccatctcctgctccggcggaggctcaaacgtcggcggcaacctcgtctcctggtaccaacaattccccggcgccgcccccaaactaatcctccaccgcgacggccaacgcccctccggcgtccccgaccgcttctccgcctccaaatccggcacctccgcctccctcaccatctccggcctccgatccgacgacgaagccacctacttctgcgccgccttcgactccgccctctccctccccctcttcggcggcggcaccaaactcaccgtcctctcccaacccaaagccgccccctccgtcaccctcttccccccctcctccgaagaactc

SEQ ID NO: 57885 - RNA, 387 nt, synthetic construct
  misc_feature 1..387: note = derived and/or modified sequence opt11 from anti-HIV_Chain
  source 1..387: mol_type = other RNA
caactcgtcctcacccaacccccctccgtctccgccactcccggccaaaccgtcaccatctcctgctccggctccggctccaacgtcggcggcaaccacgtctactggtaccgccaactccccggcgccgcccccaccctcgtcatctccaaaaccgaccaccgcccctcccgcgtccccgaccgcttctccggctccaaatccggcaactccgcctccctcgccatctccggcctccgccccgacgacgaagccgcctacttctgcgccacctacgacaccggcctctccctccgcctattcggcggcggcacccgcctcgccgtactctcccaacccaaagccgccccctccgtcaccctcttccccccctcctccgaagaactc

SEQ ID NO: 57886 - RNA, 387 nt, synthetic construct
  misc_feature 1..387: note = derived and/or modified sequence opt11 from anti-HIV_Chain
  source 1..387: mol_type = other RNA
caatccgccctcacccaaccaccctctgtctccggcacccccggccaaaacgtcaccatctcctgctccggcggcggctccaacgtaggcggcaacctcgtctcctggtaccaacacttccccggcgccgcccccaaactcctcatccaccgcgacaaccaacgaccctccggcgtacccgaccgcttctccgtcctcaaatccggcaactccgcatccctcgccatctccggcccccgctccgacgacgaagccttctacttctgcgccgtctacgactcctccctctccctcggcctcttcggcggcggcaccaaactcaccgtcctctcccaacccaaagccgccccctccgtcaccctcttcccaccctcctccgaagaactc

SEQ ID NO: 57887 - RNA, 387 nt, synthetic construct
  misc_feature 1..387: note = derived and/or modified sequence opt11 from anti-HIV_Chain
  source 1..387: mol_type = other RNA
caaaccgtcgtcacccaacccccctccgcctccggcacccccggccaacgcgtcaccatctcctgctccggcggcggctccaacataggcggcaacctcgtctcctggtaccaacacttccccggcgccgcccccaaactcctcatctaccgcaacgaccaacgcccctccggcgtccccgaccgcttctcaggctccaaatccggcacctccgcctccctcaccatctccggcctccgatccgacgacgaagccacatacttctgcgccgcctacgactgcaccctctccctccgcctcttcggcggcggcaccaccctcaacgtcctctcccaacccaaagccgccccctccgtcaccctcttccccccctcctccgaagaacta

SEQ ID NO: 57888 - RNA, 387 nt, synthetic construct
  misc_feature 1..387: note = derived and/or modified sequence opt11 from anti-HIV_Chain
  source 1..387: mol_type = other RNA
caatccgccctcacccaaaccccctccgtatccggcgcccccggccaacgcgtcaccatctcctgctctggcggcccctccaacgtcggcggcaactacgtctactggtaccaacaattccccggcgccgcccccaaactcctcatccgccgcgacgaccaacgcccctccggcgtccccgaccgcttctccggctccaaatccggcaactccgcctccctcgccatctcaggcctccgactcgacgacgaagcctactacttctgcgccacctacgactccggctggtccatccgcctcttcggcggcggcacccgcctcaccgtcctctcccaacccaaagccgccccctccgtcaccctcttccccccctcctccgaagaactc

SEQ ID NO: 57889 - RNA, 387 nt, synthetic construct
  misc_feature 1..387: note = derived and/or modified sequence opt11 from anti-HIV_Chain
  source 1..387: mol_type = other RNA
caatccgtcctaacccaacccccctccgcctccggcgcccccggccaacgcgtcacaatctcctgctcaggcggcccctccaacgtcggcggcaactacgtctactggtaccgacaattccccggcaccgcccccaacctcctcatcctccgcgacgaccaacgcccctccggcgtccccgaccgcttctccgcctccaaatccggcaactccgcctccctcgccatctccggcctccgccccgacgacgaagccttctacttctgcgccacctacgactccgacggctccgtccgcctcttcggcggcggcaccaccctcaccgtcctctcccaacccaaagccgccccctccgtcaccctcttccccccctccaacggcggccgt

SEQ ID NO: 57890 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcggggtcaagaaaccgggcacgagcgtgaccataagctgtctcgcgagcgagtacacgttcaatgaatttgtcatacactggatcaggcaagcgcccgggcaagggcccttgtggttgggcttgatcaagcgctcaggcaggctcatgacctcgtacaagttccaggacaggctcaatctcaggcgcgatcgctcgaccgggaccgtgttcatggaattgcgcgggctcaggcccgatgacacggccgtgtactattgcgcgcgcgatggcttgggcgaggtcgcgcccgattacaggtacgggatcgatgtctggggccagggctcgaccgtgatcgtgaccgcggcctcgaccaagggc

SEQ ID NO: 57891 - RNA, 387 nt, synthetic construct
  misc_feature 1..387: note = derived and/or modified sequence opt11 from anti-HIV_Chain
  source 1..387: mol_type = other RNA
gaggtccagctcgtggaatcgggcgcggaagtgaaaaagcccggggcctcggtcaaggtcgcgtgcaaggtctcgggcaagaaattgagcgatctctcgatccattgggtgcgccaggccccgggcaagggcttggaatggatgggagggtttgacgaggaagatggcaagatctcgtacgagcgcaagttccagggcagggtcacgatgacggaagataccgcgcgagatacagcgttcatggaaatgagctcgctaaggagcgatgacacggccgtgtacttttgcgcggccgcgcccaggctcgatctcggggaattgagctcgggctttcacttttgggggctcgggactttggtatcggtatcgagcgcgagcacgaaaggg

SEQ ID NO: 57892 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcgggggcaagaaattgggcacgagcgtgaccataagctgtctcgcgagcgagtacacgttcaatgaatttgtcatacactggatcaggcaagcgcccgggcaagggcccttgtggttgggcttgatcaagcgctcgggcaggctcatgacctcgtaccagttccaggacagactctcgctcaggcgcgatcgctcgaccgggaccgtgttcatggaattgcgcgggctcagggtcgatgacacggccgtgtactattgcgcgcgcgatggcttgggcgaggtcgcgcccgcgtacttgtacgggatcgatgcctggggccagggcacgacagtgatcgtgagctcggcctcgaccaagggc

SEQ ID NO: 57893 - RNA, 387 nt, synthetic construct
  misc_feature 1..387: note = derived and/or modified sequence opt11 from anti-HIV_Chain
  source 1..387: mol_type = other RNA
gaagtgcaattggtcgagagcggggccgaggtcaagaaaccgggcgcgagcgtgaaagtgagctgtaaagtgagcgggtacacgctctcggacttgagcatgcactgggtcaggcaagcgcccgggaaagggctcgagtggatgggcgggttcgatgaagaggacggggaaataacctatgcccagaaatttcaagggcgcgtgagcatgaccgaggacacgagcagggacacggcctatatggagctctcgagcttgcgctcggaagataccgcggtctattactgtgccacggccccgcgcttggaattgggcgagctctcgagcgggttccattactggggcttgggcacgctcgtgacagtgagctcggcctcgaccaagggc

SEQ ID NO: 57894 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcggggtcaagaaaacgggaacgagcgtgaccataagctgtctcgcgagcgagtacacgttcacggaatttaccatacactggatcaggcaagcgcccgggcaagggccattgtggttgggcttgatcaagcgctcgggcaggctcatgaccgcgaacaggttccaggacaggctatcgctcaggcgcgatcgctcgaccgggacagtgttcatggaattgcgctcgctcaggatcgatgacacggccgtgtactattgcgcgcgcgatggcttgggcgagctcgcgcccgcgtaccattacgggatcgacgtctggggccagggcacgaccataatcgtgacctcggcctcgaccaagggc

SEQ ID NO: 57895 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcggggtcaagaaattgggcacgagcgtgaccataagctgtctcgcgagcgagtacacgttcaatgaatttgtcatacactggatcaggcaagcgcccgggcaagggcccttgtggttgggcttgatcaagcgctcgggcaggctcatgacctcgtaccagttccaggacaggctctcgctcagacgcgatcgctcgaccgggaccgtgttcatggaattgcgcgggctcagggtcgatgacacggccgtgtactattgcgcgcgcgatggcttgggagaggtcgcgcccgcgtacttgtacgggatcgatgcctggggccagggcacgaccgtgatcgtgacctcggcctcgaccaagggc

SEQ ID NO: 57896 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcggggtcaagaaactgggcacgagcgtgaccataccctgcctcgcgagcgagtacacgttcaatgaatttgtcatacactggatcaggcaagcgcccgggcaagggcccctgtggttgggcctgatcaagcgctcgggcaggctcatgacctcgtaccagttccaggacaggctctcgctcaggcgcgatcgctcgaccgggaccgtgttcatggaactgcgcgggctcagggtcgatgacacggccgtgtactattgcgcgcgcgatggcttgggcgaggtcgcgcccgcgtacttgtacgggatcgatgcctggggccagggcacgaccgtgatcgtgacctcagcctcgaccaagggc

SEQ ID NO: 57897 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcggggtcaagaaaccgggcacgagcgtgaccataagctgtctcgcgagcgagtacacgttcaatgaatttgtcatacactggatcaggcaagcgcccgggcaagggcccgtgtggttgggcttgatcaagcgctcgggcaggctcatgacctcgtacaagttccaggacaggctctcgctcaggcgcgatcgctcgaccgggaccgtgttcatggaattgcgcgggctcaggctcgatgacacggcagtgtactattgcgcgcgcgatggcctgggcgaggtcgcgcccgcgtacttgtacgggatcgatgcctggggccagggctcaaaagtgatcgtgaccccggcctcgaccaagggc

SEQ ID NO: 57898 - RNA, 387 nt, synthetic construct
  misc_feature 1..387: note = derived and/or modified sequence opt11 from anti-HIV_Chain
  source 1..387: mol_type = other RNA
caagcccgcctcgaccaatggggcaccggcctcctcaaaccatccgaaaccctctccctaaaatgcgccgtcttcggcgtcctcttcaccgactacaactggacctgggtccgccaatcccccggcaaagaactcgaatggatcggccacctcgaccaccgaggcggcggcaactacaacccctccctcgaatcccgagtcaccatctccctcgactactccaaagcccaattctccctccacctcaaatccgtcaccgtcgccgacaccgcccgctactactgcgccggagccgtcaaaggcttctggttcgacgacccctacacctggttcggcccctggtcccaaggcaccctcgtcaccgtcgcctccgcctccaccaaagga

SEQ ID NO: 57899 - RNA, 387 nt, synthetic construct
  misc_feature 1..387: note = derived and/or modified sequence opt11 from anti-HIV_Chain
  source 1..387: mol_type = other RNA
caagcacgcctcgaccaatggggcaccggcctcctcaaaccctcagaaaccctctccctcaaatgcgccgtcttcggcgtcctcttcaccgactacaactggacctgggtacgccaatcccccggcaaaggcctcgaatggatcggccacctcgaccaccgcggcggcggctcctacaacccctccctagaatcccgcgtctccatctccctcgactactccaaagcccaattctccctccacctcaaatccgtcaccgtcgccgacaccgccctctactactgcgccggcgccgtcaaaggcttctggttcgacgaaccctccacctggttcggcccctggtcccaaggcaccatggtcaccgtcgcctccgcctcaaccaaaggc

SEQ ID NO: 57900 - RNA, 387 nt, synthetic construct
  misc_feature 1..387: note = derived and/or modified sequence opt11 from anti-HIV_Chain
  source 1..387: mol_type = other RNA
caagggcacttggtccagagcgggggcggggtcaagaaattgggcacgagcgtgaccataagctgtctcgcgagcgaggacacgttcaatgaatttgtcatacactggatcaggcaagcgccagggcaagggccattgtggttgggcttgatcaagcgctcgggcaggctcatgacctcgtaccagttccaggacaggctatcgctaaggcgcgatcgctcgaccgggaccgtgttcatggaactgcgcgggctcagggtcgatgacacggccgtgtactattgcgcgcgcgatggcctgggcgaggtcgcgcccgcgtacttgtacgggatcgatgcctggggccagggcacgaccgtgatcgtgacctcggcctcgacaaagggc

SEQ ID NO: 57901 - RNA, 387 nt, synthetic construct
  misc_feature 1..387: note = derived and/or modified sequence opt11 from anti-HIV_Chain
  source 1..387: mol_type = other RNA
caggtccagctcgtgcaatcggaagcggaagtgaaaaagcccgggagctcggtcaaggtctcgtgcaaggcctcgggcgggacctttcgcgggtacacgatctcgtgggtgcgccaggccccgggccagggcttggaatggatggggcgcataatcccgatcttgggcaaggccatatacgcgccctcgttccagggcagggtcacgctcacggccgataaatcgaccgggacagcgtacatggaattgagcaggctcaggagcgatgacacggccgtgtactattgcgcgaaagtgaaaatgcgcgggagctcgggctattactatctctttgacgattgggggcaagggaccttggtcacggtctcgagcgcgagcacgaaaggg

SEQ ID NO: 57902 - RNA, 387 nt, synthetic construct
  misc_feature 1..387: note = derived and/or modified sequence opt11 from anti-HIV_Chain
  source 1..387: mol_type = other RNA
caagcccgcctcgaccaatggggcaccggcctcctcaaaccctccgaaaccctctccctcaaatgcgccgtcttcggcgtcctcttcaccgactacaactggacctgggtccgccaatcccccggcaaaggcctcgaatggatcggccacctcgaccaccgcggcggcggcaactacaacccctccctcgaatcccgcgtcaccatctccctcgactactccaaagcccaattctccctccacctcaaatccgtcaccgtcgccgacaccgccctctactactgcgccggcgccgtcaaaggcttctggttcgacgaagtctacaactggttcggcccctggtcccaaggcaccctcgtcaccgtcgcctccgcctccaccaaaggc

SEQ ID NO: 57903 - RNA, 387 nt, synthetic construct
  misc_feature 1..387: note = derived and/or modified sequence opt11 from anti-HIV_Chain
  source 1..387: mol_type = other RNA
caaggacaattggtccagagcgggggcggggtcaagaaaccgggcacgagcgtgaccataagctgtctcgcgagcgagtacacgttcacggaatttaccatacactggatcaggcaagcgccagggcaagggcccctgtggttgggcctgatcaagcgctcgggcaggctaatgaccgcgtacaggttccaggacaggctatcgctcaggcgcgatcgctcgaccgggaccgtgttcatggaactgcgcaatctcaggatggatgacacggccgtgtactattgcgcgcgcgatggcttgggcgagctcgcgcccgcgtaccagtacgggatcgatgtctggggccagggcacgaccgtgatcgtgagctcggcctcgaccaagggc

SEQ ID NO: 57904 - RNA, 387 nt, synthetic construct
  misc_feature 1..387: note = derived and/or modified sequence opt11 from anti-HIV_Chain
  source 1..387: mol_type = other RNA
caagtccgcctcgtccaatccggcccccaagtcaaacgccccggcgcctccatccgactctcctgcgaatcctccggctaccgcttccaagactacatcgtcgcctggatccgccaaacccgaggccaaggcttcgaattcgtcggcatggtcaacccccgaggcggacgcccctggccctcctcccgcttccgagaccgcgtcaccctcacacgcgacatcgaatccgaaaccttctacctcggcctcaacgacctcacctccgacgacaccgccacctacttctgcgcccgcctcgaagccgacggctccgactactcccccaaaatgttcgacttctggggccaaggaacaaaaatcgtcgtctcccccgcctccaccaaaggc

SEQ ID NO: 57905 - RNA, 387 nt, synthetic construct
  misc_feature 1..387: note = derived and/or modified sequence opt11 from anti-HIV_Chain
  source 1..387: mol_type = other RNA
caagtccgcctcgtccaatccggcccacaagtcaaaacccccggcgcctccatgcgcgtctcatgcgaagcatccggctaccgcttcctcgactacatcatcgtctggatccgccaaacccacggccaacacttcgaatacgtcggcatgatcaacccacgaggcggaaccccctggccctcctccaaattccgcgaccgcctatccctcacccgcgacatccacaccgacaccttctacctcggcctcaacaacctcggctccgacgacaccgccatctacttctgcgcccgcctagaagccgacggcgacgactactcccccaaaatgttcgaccactggggccaaggcacccgcatcatcgtctccgccgcctcaaccaaaggc

SEQ ID NO: 57906 - RNA, 387 nt, synthetic construct
  misc_feature 1..387: note = derived and/or modified sequence opt11 from anti-HIV_Chain
  source 1..387: mol_type = other RNA
caagtccgcctcgtccaatccggcccccaagtcaaaaccccaggcgcctccatccgcctctcctgcgaagcctccggctaccgcttcctagactacttcatcgtctgggtccgccaaacccccggccaaggcttcgaatacgtcggcatgatcaacccccgcggcggccgcccctggtcctcctggaaattccgcgaccgcctctccctcacccgcgaaatcgacaccgacaccttctacctcggcctctccaacctccgctccgacgacaccgccatctacttctgcgcccgcctcgaagccgacggcgacgactactcccccaaaatggtcgactactggggccaaggcaccaaaatcatcgtctcagccgcctcaaccaaaggc

SEQ ID NO: 57907 - RNA, 387 nt, synthetic construct
  misc_feature 1..387: note = derived and/or modified sequence opt11 from anti-HIV_Chain
  source 1..387: mol_type = other RNA
caggtcaggctcgtgcaatcgggcccgcaagtgaaaaggcccggggcctcgatcaggctctcgtgcgagacctcgggctatcgatttcaagattacatagtcgcgtggatacgccagaccaggggccagcgctttgaatttgtcgggatggtgaacccgcgcgggggcaggccctggccctcgagcaagttcagggacagggtcacgctcacgcgcgatatcgagagcgagacctttcacttgggcttgaacgatctcacgagcgatgacacggccacgtacttttgcgcgcgcttggaagcggacggggccgattactcgcccaagatgtttgacttttgggggcaagggaccaagatcgtggtctcgcccgcgagcacgaaaggg

SEQ ID NO: 57908 - RNA, 387 nt, synthetic construct
  misc_feature 1..387: note = derived and/or modified sequence opt11 from anti-HIV_Chain
  source 1..387: mol_type = other RNA
caagtccgcctcgtccaatccggcccccaagtcaaaacccccggcgcctccatgcgcatctcctgcgaagcctccggctaccgcttccaagactacatcatcgtctggatccgccaaacccacggccaaggcttcgaatacgtcggcatgatcaacccccgcggcggcaccccctggtcctcatccaaattccgcgaccgcctctccctcacccgcgacatctacaccgacaccttctacctaggcctcaacaacctcggctccgacgacaccgccatctacttctgcgcccgactcgaagccgacggcggcgactactcccccaaaatgttcgactactggggccaaggcacccgcatcatcgtatcagccgcctccaccaaaggc

SEQ ID NO: 57909 - RNA, 387 nt, synthetic construct
  misc_feature 1..387: note = derived and/or modified sequence opt11 from anti-HIV_Chain
  source 1..387: mol_type = other RNA
caagggcaactggtacagagcgggggcggggtcaagaaaccgggcgcgagcgtgaccataagctgtctagcgagcgagtacacgttcaatgaatttgtcatacactggatcaggcaagcgcccgggcaagggcccctgtggctgggcttgatcaagcgctcgggcagactaatgaccgcgtacaagttccaggacaggctctcgctcaggcgcgatcgctcgaccgggaccgtgttcatggaattgcgcgggctcaggcccgaggacacggccgtgtactattgcgcgagagatggcttgggcgaggtcgcgcccgattacaggtacgggatcgatgtctggggccagggctcgaccgtgatcgtgagcgcggcctcgaccaagggc

SEQ ID NO: 57910 - RNA, 387 nt, synthetic construct
  misc_feature 1..387: note = derived and/or modified sequence opt11 from anti-HIV_Chain
  source 1..387: mol_type = other RNA
caagtccgcctcgtccaatccggcccccaaatgaaaacccccggcgcctccctccgcctctcctgcgaagtctccggctaccgcttcctagactacttcatcgtctgggtccgccaaaccggcggccaaggcttcgaatacgtcggcatgatcaacccccgcggcggccgcccctggtcctcctggaaattccgcgaccgcctctccctcacccgcgacatcgaaaccgacaccttctacctcggcctaaacaacctccgatccgacgacaccgccatctacttctgcgcccgcctcgaagccgacggcgacaactactcccccaaaatggtcgactactggggccaaggcaccaaaatcatcgtctcccccgcctccaccaaaggc

SEQ ID NO: 57911 - RNA, 387 nt, synthetic construct
  misc_feature 1..387: note = derived and/or modified sequence opt11 from anti-HIV_Chain
  source 1..387: mol_type = other RNA
caagtgagcctggtccagagcgggccccaggtcaagaccccgggcgcgagcatgcgcgtgagctgtgaaacgagcgggtacaggttcttggactatatcatagtctggatcaggcaaacacacgggcaacatttcgagtacgtgggcatgatcaatcccagaggcgggaccccgtggccgagctcgaaatttcgcgatcgcctgaccatgaccagggacatacacacggacacgttctatctcgggctcaataacctgcgctcggacgacaccgcgatctatttctgtgccaggctcgaggccgatggcgatgactatagcccgaaaatgttcgattactggggccagggcacgcgcataatcgtgagcgcggcctcgaccaagggc

SEQ ID NO: 57912 - RNA, 387 nt, synthetic construct
  misc_feature 1..387: note = derived and/or modified sequence opt11 from anti-HIV_Chain
  source 1..387: mol_type = other RNA
caagtgcgcttggtccagagcgggccccaggtcaagaccgcgggcgcgagcatgcgcgtaagctgcgaagcgagcgggtacaggttcctggactatatcatagtctggatcaggcaaacgcacgggcaacatttcgagtacgtgggcatgatcaatcccaggggcgggaccccgtggccgagctcaaaatttcgcgaccgcctgaccttgaccagggacatatacacggacacgttctatctcgggctcaataacttgggctcgggcgataccgcgatctatttctgtgccaggctcgaggccgatggcgatgactacagcccgaaaatgttcgattactggggccagggcacgcgcataatcgtgagcgcggcctcgaccaaaggc

SEQ ID NO: 57913 - RNA, 387 nt, synthetic construct
  misc_feature 1..387: note = derived and/or modified sequence opt11 from anti-HIV_Chain
  source 1..387: mol_type = other RNA
caagggcaattggtccagagcgggggcggggtcaagaaaccgggcacgagcgtgaccataagctgtctcgcgagcgagtacacgttcaatgaatttgtcatacactggatcaggcaagcgcccgggcaagggcccgtgtggttgggcttgatcaagcgctcgggcaggctcatgacctcgtacaagttccaggacaggctctcgctcaggcgcgatcgctcgaccgggaccgtgttcatggaattgcgcgggctcaggctcgatgacacggccgtgtactattgcgcgcgcgacggcttgggcgaggtcgcgcccgcgtacttgtacgggatcgatgcctggggccagggctcgaccgtgatcgtgacctcggcctcgaccaagggc

SEQ ID NO: 57914 - RNA, 387 nt, synthetic construct
  misc_feature 1..387: note = derived and/or modified sequence opt11 from anti-HIV_Chain
  source 1..387: mol_type = other RNA
caagggcaattagtccagagcgggggcgggctaaagaaaccgggcacgagcgtgaccataagctgtctcgcgagcgagtacacgttcaatgaatttgtcatacactggatcaggcaagcgcccgggcaagggcccttgtggttgggcttgatcaagcgctcgggcaggctcatgaccgcgtacaatttccaggacaggctcaggctcaggcgcgatcgctcgaccgggaccgtgttcatggaattgcgcgggctcaggcccgatgacacggccgtgtactattgcgcgcgagatggcttgggcgaggtcgcgcccgattacaggtacgggatcgatgtctggggccagggctcgacagtgatagtgaccgcggcctcgaccaagggc

SEQ ID NO: 57915 - RNA, 387 nt, synthetic construct
  misc_feature 1..387: note = derived and/or modified sequence opt11 from anti-HIV_Chain
  source 1..387: mol_type = other RNA
caagggcacttggtccagagcgggggcggggtcaagaaactgggcacgagcgtgaccataagctgtctcgtgagcgagtacacgttcaatgaatttgtcatacactggatcaggcaagcgcccgggcaagggcccttgtggttgggcctaatcaagcgctcgggcaggctcatgacctcataccagttccaggacaggctctcgctcaggcgcgatcgctcgaccggaaccgtgttcatggaattgcgcgggctcagggtcgatgacacggccgtgtactattgcgcgcgagatggcctgggcgaggtcgcgcccgcgtacctgtacgggatcgatgcctggggccagggcacgaccgtaatcgtgacctcggcctcgaccaagggc

SEQ ID NO: 57916 - RNA, 387 nt, synthetic construct
  misc_feature 1..387: note = derived and/or modified sequence opt11 from anti-HIV_Chain
  source 1..387: mol_type = other RNA
caagggcaactggtccagagcgggggcggggtcaagaaattgggaacgagcgtgaccataagctgtctcgcgagcgagtacacgttcaatgaatttgtcatacactggatcaggcaagcgcccgggcaagggcccttgtggttgggcttgatcaagcgatcgggcaggctcatgacctcgtaccagttccaggacagactctcactcaggcgcgatcgctcgacagggaccgtgttcatggaattgcgagggctcagggtcgatgacacggccgtgtactattgcgcgcgcgatggcttgggcgaggtcgcgcccgcgtacttgtacgggatcgatgcctggggccagggcacgaccgtgatagtgagctcggcctcgaccaagggc

SEQ ID NO: 57917 - RNA, 387 nt, synthetic construct
  misc_feature 1..387: note = derived and/or modified sequence opt11 from anti-HIV_Chain
  source 1..387: mol_type = other RNA
caagggcacttggtccagagcgggggcggggtcaagaaattgggcacgagcgtgaccataagctgtctagcgagcgagtacacgttcaatgaatttgtcatacactggatcaggcaagcgcccgggcaagggcccctgtggttgggcttgatcaagcgatcgggcaggctcatgacctcgtaccagttccaggacaggctctcgctcaggcgcgatcgctcgaccgggaccgtgttcatggaattgcgcgggctcagggtcgatgacacggccgtgtactattgcgcgcgcgatggcttgggagaggtcgcgcccgcgtacttgtacgggatcgatgcctggggccagggcacgaccgtgatcgtgacctcggcctcgaccaagggc

SEQ ID NO: 57918 - RNA, 387 nt, synthetic construct
  misc_feature 1..387: note = derived and/or modified sequence opt11 from anti-HIV_Chain
  source 1..387: mol_type = other RNA
caagtccaactcgtccaatccggctccgaactcaaaaaacccggcgcctccgtcaaagtctcctgcaaagcctccggctacaccttcacctcatacgccatcaactgggtccgccaagcccccggccaaggcctcgaatggatgggctggatcaacaccaacaccggcaaccccacctacgcccaaggcttcaccggccgcttcgtcttctccctcgaaacctccgtatccacagcctacctccaaatcaactccctcaaagccgaagacaccgccgtctactactgcgcccgcgacctcctcgaatcccgcacctactacaacgacatccgcgactgctggggccaaggcaccctcgtcaccgtctcctccgcctccaccaaaggc

SEQ ID NO: 57919 - RNA, 387 nt, synthetic construct
  misc_feature 1..387: note = derived and/or modified sequence opt11 from anti-HIV_Chain
  source 1..387: mol_type = other RNA
caagtccaactagtccaatccggcgccgaagtcaaaaaacccggcgcctccgtcaaagtctcctgcaaagcctccggctacaccttcaccgactactacatccactgggtccgccaagcccccggccaaggcctcgaatggatgggctggatcaacccctcaaccggcggcaccaacttcgtccaaaaattcctcggccgcgtcaccatgacctccgacacctccatcaacaccgcctacatggaactccgccgcctcaaaaacgacgacgccgccatctactactgcgccacctactccacccgccaattcttccactactactacgtcaccgacgtctggggccaaggcaccaccgtcaccgtctcctccgcctccaccaaaggc

SEQ ID NO: 57920 - RNA, 387 nt, synthetic construct
  misc_feature 1..387: note = derived and/or modified sequence opt11 from anti-HIV_Chain
  source 1..387: mol_type = other RNA
ttccaaggacaattggtccagagcgggggcggggtcaagaaaccgggctcgagcgtgaccataagctgtctcgcgagcgagtacacgttcacggaatttaccatacactggatcaggcaagcgcccgggcaagggcccttgtggttgggattgatcaagcgctcgggcaggctcatgacctcgtacgggttccaggacaggctctcagtcaggcgcgatcgctcgaccggaaccgtgttcatggaactgcgctcgctaaggaccgatgacacggccgtgtactattgcgcgcgcgatggcttgggcgagctcgcgcccgcgtaccattacgggatcgatgtctggggccagggcacgaccgtgatcgtgacctcggcctcgacctcg

SEQ ID NO: 57921 - RNA, 387 nt, synthetic construct
  misc_feature 1..387: note = derived and/or modified sequence opt11 from anti-HIV_Chain
  source 1..387: mol_type = other RNA
caagtgcaattggtcgagagcgggggcggggtcgtgcaaccgggcaggagcttgcgcttgagctgtgccgcgagcgggttcacgttctcgagctatgcaatgcactgggtcaggcaagcgcccgggaaagggctcgagtgggtggccgtgatctcgtacgatggctcgaacaagtactatgccgatagcgtgaaagggcgctttaccataagcagggacgatagcaagagcacggtctatctccagatcaatagcttgcgcgcggccgatacagcggtctatttctgtgccagggaagggggcttgcgctttctcgagtggttgttctggggccagggcacgctcgtgaccgtgagctcgggagagagctcggcatcgaccaagggc

SEQ ID NO: 57922 - RNA, 390 nt, synthetic construct
  misc_feature 1..390: note = derived and/or modified sequence opt11 from anti-HIV_Chain
  source 1..390: mol_type = other RNA
caagtccaactcgtccaatccggcgccgtcgtcaaatcccccggctcctcagccaaactctcctgccgcctcctcggcgacgaattcggcacctacttcatctcctggatccgccaagcccccggccgcggcctcgaatgggtcggcggcatcgtcccccactcccaactccaatcctcagcccaaaaattccacggccgattcttcatcaccggaggcgtcaccccccccatcatcttcctccaactcaccaacgtcaccttcgaagacaccggcacctacttctgcgcccgcgaacgcggccgccaccgcgaccccaaaaccggcaaatccctccgaggccgctacttcgacttctggggccgcggcacaggcgtcaccgtctccccc

SEQ ID NO: 57923 - RNA, 390 nt, synthetic construct
  misc_feature 1..390: note = derived and/or modified sequence opt11 from anti-HIV_Chain
  source 1..390: mol_type = other RNA
caaatagaattgcgccagagcggagccgcaatgaaaagcccgggctcgagcgtgaagctgagctgtaccgtgctcggggaaaacttcgggacctatttcataagctggatcaggcaagcacccgggcaaggactcgagtgggtgggcgggatcgtgccccacagccagctccagagctcggcccagaaattccacgggcgcataaaaataagcgggggcgggaccccgcccgtagtctcgctcgagctcacgaacgtgaccttcgacgataccgggacctatttctgcgccagagaaagaggcagacacgtggaaccgaaaacgggcgaccgcttggccgggcgctacttcgatatctggggcaggggcacgggcctacgcgtgagcccg

SEQ ID NO: 57924 - RNA, 390 nt, synthetic construct
  misc_feature 1..390: note = derived and/or modified sequence opt11 from anti-HIV_Chain
  source 1..390: mol_type = other RNA
gaagtgcaattggtagagagcgggggcgggctcgtgaaaccgggcgggagcttgcgcttgagctgtgaagcgagcgggttcacgttcacgaacgcgtggatgaactgggtcaggcaagcgcccgggaaagggctagagtgggtgggcaggatcaagagccagacccatggcgggaccacgcgctatgccgcgcccgtgaaagggcgctttaccataagcagggacgatagcaagcacacactctatctccagatggatcgcctgaccacggaagataccgcggtctattactgtaccgggaccataaccgggagcacgttctattactatggcatggacgtgtgggggcaagggaccacggtcacggtctcgcccgcgagcacgaaaggg

SEQ ID NO: 57925 - RNA, 390 nt, synthetic construct
  misc_feature 1..390: note = derived and/or modified sequence opt11 from anti-HIV_Chain
  source 1..390: mol_type = other RNA
gtcgtccaactcgtccaatccggccccggcctcgtcaaaccatcccaaaccctctccctcacctgcaccgtctccggcggctccatctcctccggcgacttctactggtcctggatccgccaaccccccggcaaaggcctcgaatggatcggctacatctactactccggctccacctactacaacccctccctcaaatcacgcctcaccatctccgtagacacctccaaaaaccaattctccctccgcctctcctccgtcaccgccgccgacaccgccgtctactactgcgcccgcgacctcaactcacgcatcgtcggcgccctcgacgccttcgacatctggggccaaggcaccatggtcaccgtctcctccgcctccaccaaaggc

SEQ ID NO: 57926 - RNA, 390 nt, synthetic construct
  misc_feature 1..390: note = derived and/or modified sequence opt11 from anti-HIV_Chain
  source 1..390: mol_type = other RNA
gaggtccagctagtgcaatcgggcgggggcctggtccagcccgggcgctcgctcaggctctcgtgcgcggcctcgggctttacctttgacgattacgcgatgcattgggtgcgccaggccccgggcaagggcttggaatgggtctcgggcataagctggaactcgggcacgatcgggtacgcggactcggtcaggggcaggttcacgatctcgcgcgatgacgcgaaaagctcattgtacctgcaaatgaactcgctcaggaccgaggacacggccttgtactattgcgcgaaagatggctgggtcgggagcgggagctcgaccttgcgcgggagcgattactggggacagggcacgctcgtgacagtgagctcggcatcgaccaaggga

SEQ ID NO: 57927 - RNA, 390 nt, synthetic construct
  misc_feature 1..390: note = derived and/or modified sequence opt11 from anti-HIV_Chain
  source 1..390: mol_type = other RNA
caatccgtcctcacccaacccccctccgcctccggatcccccggccaatccatcaccatctcctgcaccggcacctcctccgacgtcggcggctacaactacgtctcatggtaccaacaaccccccggcaaagcccccaaagtcatcatctacgaagtctccaaacgcccctccggcgtccccgaccgcttctccggctcaaaatccggcaacaccgcctccctcaccgtctccggcctccaagccgaagacgaagccgactactactgctcctcctacgccggctccaacaacttcgtcttcggaaccggcaccgaagtcaccgtcgtcggccaacccaaagccaaccccaccgtcaccctcttccccccctcctccgaagaacttctc

SEQ ID NO: 57928 - RNA, 390 nt, synthetic construct
  misc_feature 1..390: note = derived and/or modified sequence opt11 from anti-HIV_Chain
  source 1..390: mol_type = other RNA
caagccgtcgtcacccaagaaccctcactcaccgtctcccccggcggcaccgtcaccctcacctgcgcctcctccaccggcgccgtcacctcaggcttctacccccactggttccaacaaaaacccggccaagccccccgcgccctcatctactccacctccaaccgctactcctggacccccgcccgcttctccggctccctcctaggcggcaaagccgccctcaccctctccggcgtccaacccgaagacgaagccgaatactactgcctcctcctcccctactacggcggcccctggatcttcggcggcggcaccaaactcaccgtcctcggccaacccaaagccgccccctccgtcaccctcttccccccctcctccgaagaactc

SEQ ID NO: 57929 - RNA, 390 nt, synthetic construct
  misc_feature 1..390: note = derived and/or modified sequence opt11 from anti-HIV_Chain
  source 1..390: mol_type = other RNA
caatccgccctcacccaacccccctccgcctccggcgcccccggccaacgcgtcaccatctcctgctccggcggcccctccaacgtcggcggcaactacgtctactggtaccgccaattccccggcaccgcccccaccctcctaatcctccgcgacgaccaacgcccctccggcgtccccgaccgcttctccgcctcaaaatccggcaactccgcctccctcgccatctccggcctccgccccgacgacgaaggcttctacttctgcgccacctacgactccgacggctccatccgcctattcggaggaggcaccgcactcaccgtcctctcccaacccaaagccgcaccctccgtcaccctcttccccccctcctccgaagaactcaaa

SEQ ID NO: 57930 - RNA, 390 nt, synthetic construct
  misc_feature 1..390: note = derived and/or modified sequence opt11 from anti-HIV_Chain
  source 1..390: mol_type = other RNA
caagtccaactcgtcgaatcaggctccgacgtccgcaaacccggcgccaccgtcaccgtctcctgcaaagccgacgaagacgaagacgacttcaccgcctacaactacttcatgcactgggtccgccaagcccccggccacggcctcgaatggatcggctggatcaacccccgcaccggccaacccaaccacgccaaacaattccaaggccgcgtcaccctcacccgcgaacgctccacctccaccgtcttcatgaaactcaccaacctccgcctcgacgacaccgccgtctacttctgcgcacgccccctccgaggcggcgacacctggcactaccactcctggggccgcggcacctccctcaccgtctcctccgcctcaaccaaaggc

SEQ ID NO: 57931 - RNA, 390 nt, synthetic construct
  misc_feature 1..390: note = derived and/or modified sequence opt11 from anti-HIV_Chain
  source 1..390: mol_type = other RNA
gaagtccaactcgtcgaatccggctccgacgtccgcaaacccggcgccaccgtcaccgtctcctgcaaagcagacgaagacgaagacgacttcaccgcctacaactacttcatgcactgggtccgccaagcacccggccacggcctcgaatggatcggctggatcaacccccgcaccggccaaccaaaccacgccaaacaattccaaggccgagtcaccctcacccgcgaacgctccacctccaccgtcttcatgaaactcaccaacctccgcctcgacgacaccgccgtctacttctgcgcccgccccctccgcggcggcgacacctggcactaccactcctggggccgcggcacctccctaaccgtatcctccgcctccaccaaaggc

SEQ ID NO: 57932 - RNA, 390 nt, synthetic construct
  misc_feature 1..390: note = derived and/or modified sequence opt11 from anti-HIV_Chain
  source 1..390: mol_type = other RNA
gaagtccaactcgtccaatcaggctccgacgtccgcaaacccggcgccaccgtcaccgtctcctgcaaagccgacgaagacgaagacgacttcaccgcatacgactacttcatgcactgggtccgccaagcccccggccacggcctcgaatggatcggctggatcaacccacgcaccggccaaccaaaccacgccaaacaattccaaggccgcgtcaccctcacccgcgaacgctccacctccaccgtcttcatgaaactcaccaacctccgactcgacgacaccgccgtctacttctgcgcccgccccctccgcggcggagacacctggcactaccacagctggggccgcggcacctccctcaccgtctcctcagcatccaccaaaggc

SEQ ID NO: 57933 - RNA, 390 nt, synthetic construct
  misc_feature 1..390: note = derived and/or modified sequence opt11 from anti-HIV_Chain
  source 1..390: mol_type = other RNA
caagtccaactcgtccaatccggctccgacgtccgcaaacccggcgccaccgtcaccgtctcatgcaaagccgacgaagacgaagacgacttcaccgcctacaactacttcatgcactgggtccgccaagcccccggacacggcctcgaatggatcggctggatcaacccccgcaccggccaacccaaccacgccaaacaattccaaggccgagtcaccctcacccgcgaacgctccacctccaccgtcttcatgaaactcaccaacctccgcctcgacgacaccgccgtctacttctgcgcccgccccctccgcggcggcgacacctggcactaccactcctggggccgcggcacctccctcaccgtctcctccgcctccaccaaaggc

SEQ ID NO: 57934 - RNA, 390 nt, synthetic construct
  misc_feature 1..390: note = derived and/or modified sequence opt11 from anti-HIV_Chain
  source 1..390: mol_type = other RNA
caagtccaactcgtccaatccggctccgacgtccgcaaacccggcgccaccgtcaccgtctcatgcaaagccgacgaagacgaagacgacttcaccgcctacaactacttcatgcactgggtccgccaagcccccggccacggcctcgaatggatcggctggatcaacccccgcaccggccaacccaaccacgccaaacaattccaaggccgcgtcaccctcacccgcgaacgctccacctccaccgtcttcatgaaactcaccaacctccgcctcgacgacaccgccgtctacttctgcgcccgccccctccgcggcggcgacacctggcactaccactcccgcggccgcggcacctccctcaccgtctcctccgcctccaccaaaggc

SEQ ID NO: 57935 - RNA, 390 nt, synthetic construct
  misc_feature 1..390: note = derived and/or modified sequence opt11 from anti-HIV_Chain
  source 1..390: mol_type = other RNA
gaagtccaactcgtcgaatccggctccgacgtccgcaaacccggcgccaccgtcaccgtctcctgcaaagccgacgaagacgaagacgacttcacagcctacaactacttcatgcactgggtccgccaagccccaggccaaggcctagaatggatcggctggatcaacccccgaaccggccaacccaaccacgccaaacaattccaaggccgcgtcaccctcacccgcgaacgatccacctccacagtcttcatgaaactaaccaacctccgcctcgacgacaccgccgtctacttctgcgcccgccccctccgcggcggcgacacctggcactaccactcatggggccgcggcacctccctcaccgtctcctccgcctccaccaaagga

SEQ ID NO: 57936 - RNA, 390 nt, synthetic construct
  misc_feature 1..390: note = derived and/or modified sequence opt11 from anti-HIV_Chain
  source 1..390: mol_type = other RNA
gtcgtccaactcgtccaatcaggctccgacgtccgcaaacccggcgccaccgtcaccgtctcctgcaaagccgacgaagacgaagacgacttcaccgcatacaactacttcatgcactgggtccgccaagcccccggccacggcctcgaatggatcggatggatcaacccccgcaccggccaacccaaccacgccaaacaattccaaggccgcgtcaccctaacccgcgaacgctcaacctccaccgtcttcatgaaactcaccaacctccgactcgacgacaccgccgtctacttctgcgcccgccccctccgcggcggcgacacctggcactaccactcctggggccgcggcacctccctcaccgtatcatccgcctcaaccaaaggc

SEQ ID NO: 57937 - RNA, 390 nt, synthetic construct
  misc_feature 1..390: note = derived and/or modified sequence opt11 from anti-HIV_Chain
  source 1..390: mol_type = other RNA
gaagtccaactcgtccaatccggctccgacgtccgcaaacccggcgccaccgtaaccgtctcctgcaaagccgacgaagacgaagacgacttcaccgcctacaactacttcatgcactgggtccgccaagcccccggccacggcctcgaatggatcggctggatcaacccccgcaccggccaacccaaccacgccaaacaattccaaggccgcgtcaccctcacccgcgaacgctccacctccaccgtcttcatgaaactaaccaacctacgcctcgacgacaccgccgtctacttctgcgcccgaccactacgcggcggcgacacatggcactaccactcatggggccgcggcacctcactcaccgtctcctccgcctccaccaaaggc

SEQ ID NO: 57938 - RNA, 390 nt, synthetic construct
  misc_feature 1..390: note = derived and/or modified sequence opt11 from anti-HIV_Chain
  source 1..390: mol_type = other RNA
gaagtccaactcgtacaatccggctccgacgtcaaaaaacccggcaccaccgtcaccatctcctgcaaagccgacgaagacgaagacgacttcaccgcctacaactacttcatgcactgggtccgccaagcccccggccaaggcctcgaatggatcggctggatcaacccccgaaccggccaaccaaaccacgcaaaacaactccaaggccgcgtcaccctcacccgcgaacgatccacctccaccgtcttcatgaaactaaccaacctccgcctcgacgacaccgccgtctacttctgcgcccgaccactccgcggcggcgacacctggcactaccactcctggggccgaggcacctccctcatcgtctcctccgcctcaaccaaaggc

SEQ ID NO: 57939 - RNA, 390 nt, synthetic construct
  misc_feature 1..390: note = derived and/or modified sequence opt11 from anti-HIV_Chain
  source 1..390: mol_type = other RNA
caagtgcaattggtcgagagcgggggcgggctcgtgaaaccgggcgggagcttgcgcctgagctgtgccgcgagcgggttctcgttcaatgaatattacatgagctggatcaggcaagcgcccgggcaagggctcgagtgggtggccaatatcgggagctcggacgcgtacacgatctatgccgatagcgtgaaagggcgctttaccataagcagggacaatgccgagaacacggtctatctccagatgaatagcttgcgcggggaagataccgcggtctattactgtgccaggatcgagggctattgctcgaactcgcgctgtagcaattactttgacccgtggggacaaggggcattggtcacggtctcgagcgcgagcacgaaaggg

SEQ ID NO: 57940 - RNA, 390 nt, synthetic construct
  misc_feature 1..390: note = derived and/or modified sequence opt11 from anti-HIV_Chain
  source 1..390: mol_type = other RNA
caagtgcaattggtccagagcggggccgaggtcaagaaaccgggcgcgagcgtgaaagtgagctgtaaagtgagcgggtacccgctcgcggaattgagcgtgcactgggtcaggcaagtgcccgggaaagggctcgagtgggtgggcgggttcgatcccgaggaagggaaaacggtctatgcccagaaatttcaagggcgcgtgaccatgaccgaggacaggagcacggacacggtctatatggagctcatatcgttgcgctatgaagataccgcggtctattactgtgccacggacaatcccgtgctccagctcggggaattgagcagcagcctggactattgggggcaagggaccctggtcacagtctcgagcgcgagcacgaaaggg

SEQ ID NO: 57941 - RNA, 390 nt, synthetic construct
  misc_feature 1..390: note = derived and/or modified sequence opt11 from anti-HIV_Chain
  source 1..390: mol_type = other RNA
gaagtccaactagtccaatccggcgccgaagtcaaaaaacccggcgaatccctccgcatctcctgcaaaacctccggctacaacttcaacgacgactggatcgcctgggtccgccaacgccccgacaaaggccccgaatggatgggcatcttctaccccggcgactcccaagccacctactccccctccttccaaggccacgtcaccttctccgccgacacctccatctccaccgcctacctccaatggacctccctcaaagcctccgacaccgccatctactactgcgcccgaacccgctgcttcggcgccaactgcttcaacttcatggacgtctggggcaaaggcaccgcactcaccgtcaccgtctcctccgcctccaccaaaggc

SEQ ID NO: 57942 - RNA, 390 nt, synthetic construct
  misc_feature 1..390: note = derived and/or modified sequence opt11 from anti-HIV_Chain
  source 1..390: mol_type = other RNA
caggtgcagctggtgcagttgctgcagagcggggcggaggtgaagaagccggggagtagtgtgaaggtgagctgtcagataagcgggtatgggtttagcaattatgcgataagttgggtgaggcaggcgccggggcaggggttggagtggttggggaggatagtgccggcggtggggatgacggagtatgcgcagaagtttcaggggagggtgacgtttacggcggataggagtacgataacggcgtatatggatctgagggggttgaggagcgacgatacggcggtgtattattgtgtgagggatccgcaggtggaggtgagggggaatgcgtttgatatatgggggcaggggacgatggtgacggtgagcagtgcgagtacgaagggg

SEQ ID NO: 57943 - RNA, 390 nt, synthetic construct
  misc_feature 1..390: note = derived and/or modified sequence opt11 from anti-HIV_Chain
  source 1..390: mol_type = other RNA
caagtccacctccaacaatggggcgccggcctcctcaaaccctcagaaaccctctccctaacctgcgccgtctccggcggatccttctccggattcttctggacctggatccgccaatcccccggcaaaggcctcgaatggatcggcgaagtcaaccactcaggcttcacccactccaacccctcactcgaatcccgcgccaccatctccgtcgccgcctccaacacccaattctccctccgactcgcctccgtcaccgccgccgacaccgccatctacttctgcgccctccgatacttcgactggtcccccttccgccgcgacacctacggcaccgacgtctggggccaaggcaccaccgtcatcgtctcctccgcctccaccaaaggc

SEQ ID NO: 57944 - RNA, 390 nt, synthetic construct
  misc_feature 1..390: note = derived and/or modified sequence opt11 from anti-HIV_Chain
  source 1..390: mol_type = other RNA
caagtgcgcctagaacagagcgggggcgcgctcagaaaaccgggcgcgagcgtgaccctgagctgccaagcaagcggatacaacttcgtaaaatacatcatacactgggtcaggcaaaggcccgggctcggattcgagtgggtgggcatgatcgacccctaccgcgggcgcccgtggtacgcccacagcttcgccgggcgcctaagcctgagcagggacacaagcacagaaacgctctacatgacgctctcgagcctaaaatcggacgacaccgcaacctacttctgcgccagggccgaggccgcaagcgacagccacagcaggcccataatggactggacgtggaggatcctgtgcctactcgcggtcgtgcccgcgagcacaaaagga

SEQ ID NO: 57945 - RNA, 390 nt, synthetic construct
  misc_feature 1..390: note = derived and/or modified sequence opt11 from anti-HIV_Chain
  source 1..390: mol_type = other RNA
caagtccgcctcgaacaatccggcgccgccgtccgcaaaccaggcgcctccgtcaccctctcctgccaagcctccggctacaacttcgtcaactacatcatccactgggtccgccaacgccccggcctcgacttcgaatgggtcggcatgatcgacccctaccgcggccgcccctggtccgcccacaaattccaaggccgcctctccctctcccgcgacgtctcaacagaaatcctctacatgaccctcaactccctccgctcagacgacaccgccacctacttctgcgcccgcgccgaagccgaatcccaatcccactcacgcccaatcatgttcgactcctggggccaaggctcccgcgtcaccgtctcctccgcctcaaccaaaggc

SEQ ID NO: 57946 - RNA, 390 nt, synthetic construct
  misc_feature 1..390: note = derived and/or modified sequence opt11 from anti-HIV_Chain
  source 1..390: mol_type = other RNA
caagtgcgattggaacagagcggggccgcggtcaagaaaccgggcgcgagcgtgaccataagctgtcaagcgagcgggtacaatttcgtgaaatttttcatacactgggtcaggcaaaggcccgggcaagggttcgagtgggtgggcatgatcgagccctatcgcgggcgcccgtggtcggccgggaactttcaagggcgcctgagcttgagcagggacgtgagtacggaaacgctctatatgacgctcaataacttgcgctcggacgataccgcggtctatttctgtgccaggctcgaggccgagagcgatagccatagcaggcccataatgtttgaccattgggggcacgggagcttggtcacggtctcgagcgcgagcacgaaaggg

SEQ ID NO: 57947 - RNA, 390 nt, synthetic construct
  misc_feature 1..390: note = derived and/or modified sequence opt11 from anti-HIV_Chain
  source 1..390: mol_type = other RNA
caggtcaggctcgagcaatcgggcgcggccgtgcgcaagcccggggcctcggtcacgctctcgtgccaggcctcgggctataactttgtcaattacataatccattgggtgcgccagcgcccgggcctggactttgaatgggtcgggatgatagacccgtacaggggcaggccctggagcgcgcacaagttcgagggcaggctctcactctcgcgcgatgtctcgaccgaggtcttgtacatgaccctgagctcgctcaggagcgatgacacggccacgtacttttgcgcgcgcgcggaagcggaatcgcaatcgcactcgcgcccgatcatgttcgattactggggccagggctcgcgcgtgaccgtgagctcggcctcaaccaagggc

SEQ ID NO: 57948 - RNA, 390 nt, synthetic construct
  misc_feature 1..390: note = derived and/or modified sequence opt11 from anti-HIV_Chain
  source 1..390: mol_type = other RNA
caagtgcgcctggaacagagcgggaccgcggtcaggaaaccgggcgcgagcgtgaccataagctgtcaagcgagcgggtacaatttcgtgaaatttttcatacacggggtcaggcaaaggcccgggcaagggttcgagtgggtaggcatgatcgagccctttcgcgggcgaccgtggtcggccgggaactttcaagggcgcttgagcttgagcagggacgtgagcacggaaacgctctatatgacgctcaataacctgcgctcggacgacaccgcggtctatttctgtgccaggctagaggccgagagcgatagccatagcaggccaataatgtttgaccattgggggcacgggagcctggtcacagtctcgagcgcgagcacgaaagga

SEQ ID NO: 57949 - RNA, 390 nt, synthetic construct
  misc_feature 1..390: note = derived and/or modified sequence opt11 from anti-HIV_Chain
  source 1..390: mol_type = other RNA
caagtccgcctcgaacaatcaggcaccgccatgcgcaaacccggcgcctccgtcaccctctcctgccaagcctccggctacaacttcgtcaaatacatcgtacactgggtccgccaaaaacccggcctaggcttcgaatgggtcggcatgatcgacccctaccgcggccgcccctggtccgcccacaaattccaaggccgcctatccctctcccgcgacacctccatggaaatcctctacatgaccctcacctccctcaaatcagacgacaccgccacctacttctgcgcccgcgccgaagccgcctccgactcccactcccgccccatcatgttcgaccactggggccaaggctcccgcgtcaccgtctcctccgcctccaccaaaggc

SEQ ID NO: 57950 - RNA, 390 nt, synthetic construct
  misc_feature 1..390: note = derived and/or modified sequence opt11 from anti-HIV_Chain
  source 1..390: mol_type = other RNA
caagtccgcctcgaacaatccggcgcagccatgcgcaaacccggcgcctccgtcaccctatcctgccaagcctccggctacaacttcgtcaaatacatcgtccactgggtccgccaaaaacccggcctcggcttcgaatgggtcggcatgatcgacccctaccgcggccgcccctggtcagcccacaaattccaaggccgactatccctctcacgcgacacctccatggaaatcctctacatgaccctcacctccctcaaatccgacgacaccgccacatacttctgcgcccgcgccgaagccgcctccgactcacactcccgccccatcatgttcgaccactggggccaaggctcccgagtcaccgtctcctccgcctcaaccaaaggc

SEQ ID NO: 57951 - RNA, 390 nt, synthetic construct
  misc_feature 1..390: note = derived and/or modified sequence opt11 from anti-HIV_Chain
  source 1..390: mol_type = other RNA
caagtccgcctcgaacaatccggcgccgccatgcgcaaacccggcgcctccgtaaccctctcctgccaagcctcaggctacaacttcgtcaaatacatcatccactgggtccgccaaaaacccggcctcggcttcgaatgggtcggcatgatcgacccctaccgcggccgcccctggtccgcccacaaattccaaggccgcctctccctctcccgcgacacctccatggaaatcctctacatgaccctcacctccctcaaatccgacgacaccgccacctacttctgcgcccgcgccgaagccgcctccgactcccactcccgccccatcatgttcgaccactggggccaaggctcccgcgtcaccgtctcctccgcctccaccaaaggc

SEQ ID NO: 57952 - RNA, 390 nt, synthetic construct
  misc_feature 1..390: note = derived and/or modified sequence opt11 from anti-HIV_Chain
  source 1..390: mol_type = other RNA
caagtccgcctcgaacaatccggcaacgccgtccgcaaacccggcgcctccgtcaccatctcctgccaagcctccggctacaacttcgtcaaattcttcatccactgggtccgacaacgccccggccaaggcttcgaatgggtcggcatgatcgaaccattccgcggccgcccctggtccgccggcaacttccaaggccgcctatccctatcccgcgacgtctccaccgaaacactctacatgaccctcaacaacctccgctccgacgacaccgccgtctacttctgcgcccgcctcgaagccgaatccgactcccactcccgccccataatgttcgaccactggggccacggctccctcgtcaccgtctcctccgcctccaccaaaggc

SEQ ID NO: 57953 - RNA, 390 nt, synthetic construct
  misc_feature 1..390: note = derived and/or modified sequence opt11 from anti-HIV_Chain
  source 1..390: mol_type = other RNA
caagtccgcctagaacaatccggcgccgccgtccgcaaacccggcgcctccgtcaccctctcctgccaagcctccggctacaacttcgtccgctacatcatccactgggtccgccaacgccccggcctcgacttcgaatgggtaggcatgatcgacccctaccgcggccgaccctggtccgcccacaaattcggcggccgcctctccctcaccagagacgtctccaccgaaatcctctacatgaccctcacctcactccgctccgacgacaccgccacctacttctgcgcccgcgcagaagccgaatcccaatcccactcccgccccatcatgttcgactcctggggacaaggctcccgcgtcaccgtctcctccgcctccaccaaaggc

SEQ ID NO: 57954 - RNA, 390 nt, synthetic construct
  misc_feature 1..390: note = derived and/or modified sequence opt11 from anti-HIV_Chain
  source 1..390: mol_type = other RNA
caggtcaggctcgagcaatcgggcgcggccgtgcgcaagcccggggcctcggtcacgctctcgtgccaggcctcgggctataactttgtcaattacataatccattgggtgcgccagcgcccgggcttggactttgaatgggtcgggatgatagacccgtacaggggcaggccctggagcgcgcacaagttccagggcaggctctcgctctcgcgcgatgtctcgaccgagatcttgtacatgaccttgagctcgctcagaagcgatgacacagccacgtacttttgcgcgcgcgcggaagcggaatcgcaatcgcactcgcgcccgatcatgttcgatttctggggccagggctcacgcgtgaccgtgagctcagcctcgaccaagggc

SEQ ID NO: 57955 - RNA, 390 nt, synthetic construct
  misc_feature 1..390: note = derived and/or modified sequence opt11 from anti-HIV_Chain
  source 1..390: mol_type = other RNA
caagtgcgcctggaacagagcgggaccgcggtcaggaaaccgggcgcaagcgtgaccataagctgtcaagcgagcgggtacaatttcgtgaaatttttcatacactgggtcaggcaaagacccgggcaagggttcgagtgggtgggcatgatcgagccctttcgcgggcgcccgtggtcggcagggaactttcaaggacgcttgagcctgagcagggacgtgagcacggaaacgctctatatgacgctcaataacttgcgctcggacgataccgcggtctatttctgtgccaggctcgaggccgagagcgatagccatagcaggcccataatgtttgaccattggggacacgggagcttggtcacggtctcgagcgcgagcacgaaaggg

SEQ ID NO: 57956 - RNA, 390 nt, synthetic construct
  misc_feature 1..390: note = derived and/or modified sequence opt11 from anti-HIV_Chain
  source 1..390: mol_type = other RNA
caagtccgcctcgaacaatccggcgccgccatgcgcaaacccggcgcctccgtcaccctctcctgccaagcctccggctacaacttcgtcaaatacatcgtccactgggtccgccaaaaacccggcctcggcttcgaatgggtcggcatgatcgacccctaccgcggccgcccctggtccgcccacaaattccaaggccgcctctccctctcccgcgacacctcaatggaaatcctctacatgaccctcacatccctcacctccgacgacaccgccacctacttctgcgcccgcgccgaagccgcctccgactcccactcccgccccatcatgttcgaccactggggccaaggctcacgcgtcaccgtctcctccgcctccaccaaaggc

SEQ ID NO: 57957 - RNA, 390 nt, synthetic construct
  misc_feature 1..390: note = derived and/or modified sequence opt11 from anti-HIV_Chain
  source 1..390: mol_type = other RNA
gaggtccagctcgtgcaatcgggcgggggcttggtccagcccgggggctcgctcaggctctcgtgcgcggcctcgggcctgacctttcgcaatttcgcgatgtcgtgggtgcgccaggccccgggcaagggcttggaatgggtctcgagtataagcgggagcgggggctcgacctattacgcggactcggtcaagggcaggttcacgatatcgcgagataactcgaaaaatacattgtacttgcaaatgaactcgctcaggggcgaggacacggccgtgtacttttgcgcgaaaggggtcgggtacgatatcttgaccgggctcggggacgcgttcgatatctggggccagggcacggtcgtggccgtgagctcggcatcgaccaagggc

SEQ ID NO: 57958 - RNA, 393 nt, synthetic construct
  misc_feature 1..393: note = derived and/or modified sequence opt11 from anti-HIV_Chain
  source 1..393: mol_type = other RNA
caagtccaactcgtccaatccggagccgccgtccgcaaacccggcgcctccgtaaccgtctcctgcaaattcgccgaagacgacgactactccccccactgggtcaaccccgcccccgaacactacatccacttcctccgccaagcccccggccaacaactcgaatggctcgcctggatgaaccccaccaacggcgccgtcaactacgcctggcaactccacggccgcctcaccgccacccgcgacggctccatgaccaccgccttcctcgaagtccgctccctccgatccgacgacaccgccgtctactactgcgcccgcgcccaaaaacgcggccgctccgaatgggcctacgcccactggggccaaggcacacccgtcctcgtctcctcc

SEQ ID NO: 57959 - RNA, 393 nt, synthetic construct
  misc_feature 1..393: note = derived and/or modified sequence opt11 from anti-HIV_Chain
  source 1..393: mol_type = other RNA
caagtccaactccaacaatggggcgccggcctcctcaaaccctccgaaaccctctcactcacctgcgccgtctacgccggctccttctccggctactactggacctggatccgccaaccccccggcaaaggcctcgaatggatcggcgaagtcaaccacggcggctccaccaactacaacccctcactcaaatcccgcgtcaccctctccgtcgacacctccaaaaaccaattctccctcaaactcacctccgtcaccgccgccgacaccgccgtctactactgcgcccgagtctcccgctacgacttctggtccggcaactacggctcctacggcctcgacgtctggggccaaggcaccaccgtcaccgtctcctccgcctcaaccaaaggc

SEQ ID NO: 57960 - RNA, 393 nt, synthetic construct
  misc_feature 1..393: note = derived and/or modified sequence opt11 from anti-HIV_Chain
  source 1..393: mol_type = other RNA
gaagtacaactcgtccaatcaggcggcggcgtcgtccaacccggacgctccctccgcctctcctgcgtcgtctccggcttcaccttctcctccttcaccttccactgggtccgccaagcccccggcaaaggcctcgaatgggtcgccggcatgtccttccacgccacctacatctactacgccgactccgtcaaaggccgcttcaccatctcccgcgacgactcccaagacaccctctacctcgaaatggactccctccgctccgaagacaccgccatctactactgcgccagagaccccggcatccacgactacggcgactacgcccccggcgccttcgactactggggccaaggctcccccgtcaccgtctcctccgcctccaccaaaggc

SEQ ID NO: 57961 - RNA, 393 nt, synthetic construct
  misc_feature 1..393: note = derived and/or modified sequence opt11 from anti-HIV_Chain
  source 1..393: mol_type = other RNA
caggtccagctcgtgcaatcgggcacggaagtgcaaaagcccggggcctcggtcaaggtctcgtgcaagacctcgggctatacctttagcaagtactatatccattgggtgcgccaggccccgggccagggcttggaatgggtcgggcgcataaacacggactcgggcgggaccgattacgcggaaaagttccagggcagggtcacgatgacgcgcgatacctcgatcacgaccgtgtacttggaaatgcgcgggctaacgagcgatgacacggccgcgttctattgcgcgcgcgggcccccgcacgcgggcgggtggacgatctattactatggactggacgtgtgggggcaagggacctcggtcatagtctcgagcgcgagcacgaaaggg

SEQ ID NO: 57962 - RNA, 393 nt, synthetic construct
  misc_feature 1..393: note = derived and/or modified sequence opt11 from anti-HIV_Chain
  source 1..393: mol_type = other RNA
cgcaccgtcgtcacccaacccccctccgtctccggcgcccccggccaacgcgtcaccatctcctgcaccggctcatcctccaacatcggcgccggctacgacgtccactggtaccaacaactccccggcaccgcccccaaactcctcatctacggcaactccaaccgcccctccggcgtccccgaccgattctccggctccaaatccggaacctccgcctccctagccatcaccggcctccaagccgaagacgaagccgactactactgccaatcatacgactcctccctctccggctccggcgtcttcggcaccggcaccaaagtcaccgtcctcggccaacccaaagccaaccccaccgtcaccctcttcccaccctcctccgaagaactc

SEQ ID NO: 57963 - RNA, 393 nt, synthetic construct
  misc_feature 1..393: note = derived and/or modified sequence opt11 from anti-HIV_Chain
  source 1..393: mol_type = other RNA
caagtgcaattgcaacagtgggggagcgggctcttgaaaccgagcgagaccttgagcttgacctgtgccgtgtacgggggctcgttcaggagctattactggaactggatcaggcaatcgcccgggaaagggctcgagtggataggcgaggtctcgcactcgggctcgaccaattacaatcccgcgctcaagagcagggtcacgatatcggtcgatacctcgaaaaatcaatttagcctgaaagtgaaatcggtcacggccgcggacacggccttgtactattgctcgcgcgggcgcgggaaaaggtgctcgggcgcgtactgtttcgcgggctatttcgatagctggggccagggcgggctcgtggtcgtgagctcggcctcgacaaagggc

SEQ ID NO: 57964 - RNA, 393 nt, synthetic construct
  misc_feature 1..393: note = derived and/or modified sequence opt11 from anti-HIV_Chain
  source 1..393: mol_type = other RNA
caagtccacctcgtccaatccggcgccgaagtcaaaaaacccggctcctccgtacgcgtctcctgcgaagcctccggctggaccttcggctccgtcaactccgccatcacctgggtccgccaagcccccggccaaggcctcgaatggatgggccgcacaatcccattcctcggcatctccaactacgcccaaaaattccaaggccgcgtcaccatcaccgccgacaaatcaaccaacatcgcctacgtcgacgtcacctcactcacctcccaagacaccgccgtctactactgcgcccgcctcatcaccggcatgaccgccccctggttctactacatggacgtctggggcaaaggcaccaccgtcaccgtctcctccgcctccaccaaaggc

SEQ ID NO: 57965 - RNA, 393 nt, synthetic construct
  misc_feature 1..393: note = derived and/or modified sequence opt11 from anti-HIV_Chain
  source 1..393: mol_type = other RNA
caagtccacctccaagaatccggcccccgcctcgtccgctcctccgaaaccctctcactcacctgctccgtccccggcggctccatcgtcaaccccatcaccaactactactggtcctggatacgccaatccccccgcaaaggcctccaatggatcggcgacatctactacaccggcacctcctcccgcaacccctccctcgactcccgcgtctccatctcaatggatgtctcccgcaaacaaatctccctcaccctctactcagtcaccgccgccgacaccgccgtccactactgcgcctcccaatccctctcctggtaccgcccctccggctacttcgaatcctggggccaaggcatcctcgtcaccgtctcctcagcctccaccaaaggc

SEQ ID NO: 57966 - RNA, 393 nt, synthetic construct
  misc_feature 1..393: note = derived and/or modified sequence opt11 from anti-HIV_LightChain
  source 1..393: mol_type = other RNA
atgaaactccccgtccgcctcctcgtcctcatgttctggatccccgcctcctcctccgacatcgtcatgacccaatcccccctctccctccccgtcacccccggcgaacccgcctccatctcctgccgctcctcccaacgcctcctctcctcctacggccacacctacctccactggtacctccaaaaacccggccaatccccccaactcctcatctacgaagtctccaaccgcttctccggcgtccccgaccgcttctccggctccggctccggcaccgacttcaccctcaaaatctcccgcgtcgaagccgaagacgtcggcgtctactactgctcccaatccacccacgtccccctcaccttcggccaaggcaccaaagtcgaaatcaaa

SEQ ID NO: 57967 - RNA, 396 nt, synthetic construct
  misc_feature 1..396: note = derived and/or modified sequence opt11 from anti-HIV_Chain
  source 1..396: mol_type = other RNA
caagtccaactccaagaatcaggccccggcctcgtcaaaccctccgaaaccctctccgtcacctgctccgtctccggcgactccatgaacaactactactggacctggatccgccaatcccccggcaaaggcctcgaatggatcggatacatctccgaccgcgcctccgccacctacaacccctccctcaactcccgcgtcgtcatctcccgcgacacctccaaaaaccaactctccctaaaactcaactccgtcacccccgccgacaccgccgtctactactgcgccaccgcccgccgcggccaacgcatctacggcgtcgtctccttcggcgaattcttctactactactcaatggacgtctggggcaaaggcaccaccgtcaccgtctcctcc

SEQ ID NO: 57968 - RNA, 396 nt, synthetic construct
  misc_feature 1..396: note = derived and/or modified sequence opt11 from anti-HIV_Chain
  source 1..396: mol_type = other RNA
caagtccaactccaagaatccggccccggcctcgtcaaaccccccgaaaccctctccctcacctgctccgtctccggcgcctcagtcaacgacgcctactggtcatggatccgccaatcacccggcaaacgccccgaatgggtcggctacgtccaccactccggcgacaccaactacaacccctccctcaaacgccgcgtcaccttctccctcgacaccgcaaaaaacgaagtctccctcaaactcgtcgccctcaccgccgcagactccgccgtctacttctgcgcccgcgccctccacggaaaacgcatctacggcatcgtcgccctaggcgaactcttcacctacttctacatggacgtctggggcaaaggcaccaccgtcaccgtctcatca

SEQ ID NO: 57969 - RNA, 396 nt, synthetic construct
  misc_feature 1..396: note = derived and/or modified sequence opt11 from anti-HIV_Chain
  source 1..396: mol_type = other RNA
caagtccaactccaagaatccggccccggcctcgtcaaaccctccgaaaccctctccctcacatgctccgtctccggcgcctccatctccgactcctactggtcctggatccgccgctcccccggcaaaggcctcgaatggatcggctacgtccacaaatccggcgacaccaactactcaccctccctcaaatcccgcgtcaacctctccctcgacacctccaaaaaccaagtctccctctccctcgtcgccgccaccgccgccgactccggcaaatactactgcgcccgcaccctccacggccgccgcatctacggaatcgtcgccttcaacgaatggttcacctacttctacatggacgtctggggcaacggcacccaagtcaccgtctcctcc

SEQ ID NO: 57970 - RNA, 396 nt, synthetic construct
  misc_feature 1..396: note = derived and/or modified sequence opt11 from anti-HIV_Chain
  source 1..396: mol_type = other RNA
caagtccacctccaagaatccggccccggcctcgtcaaaccctccgaaaccctctccctaacctgcaacgtctccggcaccctcgtccgcgacaactactggtcctggatgcgccaacccctcggcaaacaacccgaatggatcggctacgtccacgactccggcgacaccaactacaacccctccctcaaatcccgcgtccacctctccctcgacaaatccaacaacctcgtctccctacgcctaaccgcagtcaccgccgccgactccgccacctactactgcgcaaccaccaaacacggccgccgcatctacggcatcgtcgccttcaacgaatggttcacctacttctacatggacgtctggggcaaaggcaccaccgtcaccgtctcctcc

SEQ ID NO: 57971 - RNA, 396 nt, synthetic construct
  misc_feature 1..396: note = derived and/or modified sequence opt11 from anti-HIV_Chain
  source 1..396: mol_type = other RNA
caagtccaactacaagaatccggccccggcctagtcaaaccctccgaaaccctctccgtcacctgctccgtctccggcgactccatgaacaactactactggacctggatccgccaatcccccggcaaaggcctcgaatggatcggctacatctccgaccgcgaatccgccacctacaacccctccctcaactcacgcgtcgtcatctcccgcgacacctccaccaaccaactctccctaaaactcaactccgtcacccccgccgacaccgccgtctactactgcgccaccgcccgccgcggccaacgcatctacggcgtcgtctccttcggcgaattcttctactactactccatggacgtctggggccgcggcaccaccgtcaccgtctcctcc

SEQ ID NO: 57972 - RNA, 396 nt, synthetic construct
  misc_feature 1..396: note = derived and/or modified sequence opt11 from anti-HIV_Chain
  source 1..396: mol_type = other RNA
caagtccaactcgtcgaatccggccccggcctcgtcaccccctccgaaaccctctccctcacctgcaccgtctccaacggctcagtctccggccgcttctggtcctggatccgccaatcccccggccgcggcctcgaatggatcggctacttctccgacaccgaccgctccgaatactccccctccctccgctcccgcctcaccctctccctcgacgcctcccgcaaccaactctccctcaaactcaaatccgtcaccgccgccgactccgccacctactactgcgcccgcgcccaacaaggcaaacgaatctacggcatcgtctccttcggcgaattcttctactactactacatggacgcctggggcaaaggcaccgccgtcaccgtatcctcc

SEQ ID NO: 57973 - RNA, 396 nt, synthetic construct
  misc_feature 1..396: note = derived and/or modified sequence opt11 from anti-HIV_Chain
  source 1..396: mol_type = other RNA
caagtccaactccaagaatccggccccggcctcgtcaaaccccccgaaaccctctccctcacctgctccgtctccggcgcctccatcaacgacgcatactggtcctggatccgccaatcccccggaaaacgccccgaatgggtcggctacgtccaccactccggcgacaccaactacaacccctccctcaaacgccgagtcaccttctccctcgacaccgccaaaaacgaagtctccctaaaactcgtcgacctcaccgccgccgactccgccgtatacttctgcgcccgcgccctccacggcaaacgcatctacggcatcgtcgccctcggagaactcttcacctacttctacatggacgtctggggcaaaggcaccaccgtcaccgtctcctca

SEQ ID NO: 57974 - RNA, 396 nt, synthetic construct
  misc_feature 1..396: note = derived and/or modified sequence opt11 from anti-HIV_Chain
  source 1..396: mol_type = other RNA
caagtccaactccaagaatccggccccggcctcgtcaaaccccccgaaaccctctccctcacctgctccgtctccggcgcctcaatcaacgacgcctactggtcctggatccgccaatcccccggcaaacgccccgaatgggtcggctacgtccaccactccggcgacaccaactacaacccctccctcaaacgccgcgtctccttctccctcgacaccgccaaaaacgaagtctccctcaaactcgtcgacctcaccgccgccgactccgccatctacttctgcgcccgcgcactccacggcaaacgcatctacggcatcgtcgccctcggcgaactcttcacctacttctacatggacgtctggggcaaaggcaccaccgtcaccgtctcctcc

SEQ ID NO: 57975 - RNA, 396 nt, synthetic construct
  misc_feature 1..396: note = derived and/or modified sequence opt11 from anti-HIV_Chain
  source 1..396: mol_type = other RNA
caagtccaactccaagaatccggccccggcctcgtcaaaccctccgaaaccctctccgtcacctgctccgtctcaggcgactccatgaacaactcctactggacctggatccgccaatcccccggcaaaggcctcgaatggatcggctacatctccaaatcagaatccgccaactacaacccctccctcaactccagagtcgtcatctcccgcgacacctccaaaaaccaactctccctcaaactaaactccgtcacccccgccgacacagccgtctactactgcgccaccgcccgccacggccaacgcatctacggcgtcgtctccttcggcgaattcttcacctactactccatggacgtctggggcaaaggcaccaccgtcaccgtctcctcc

SEQ ID NO: 57976 - RNA, 396 nt, synthetic construct
  misc_feature 1..396: note = derived and/or modified sequence opt11 from anti-HIV_Chain
  source 1..396: mol_type = other RNA
caagtccaactccaagaatccggccccggcctcgtcaaaccctccgaaaccctctccctcacctgctccgtctccaacggctccgtctccggccgcttctggtcctggatccgccaatcccccggccgcggcctcgaatggatcggctacttctccgacaccgaaaaatccaactacaacccctccctccgctcccgcctcaccctctccgtcgacgcctccaaaaaccaactctccctcaaactcaactccgtcaccgccgccgactccgccacctactactgcgcccgcacccaacaaggcaaacgcatctacggcgtcgtctccttcggcgaattcttccactactactacatggacgcctggggcaaaggaaccgccgtcaccgtctcctcc

SEQ ID NO: 57977 - RNA, 396 nt, synthetic construct
  misc_feature 1..396: note = derived and/or modified sequence opt11 from anti-HIV_Chain
  source 1..396: mol_type = other RNA
caagtccaactcgtccaatccggcaccgccctcaaatcccccggctcctccgccaaactctcatgcaccgtcctcggcgacgaattcggcacctacttcatctcctggatccgccaagcccccggccaaggcctcgaatgggtcggcggcatcgtcccccactcccaactccaatcctccgcccaaaaattccacggccgcatcatcatctccgccggcgccggcgtcaccccccccgtcgtctccctccaactaaccaacctcaccttcgaagacaccggcacctacttctgcgcccgcgaacgcggccgccaccgcgacccaaaaaccggcgacgccctccgcggccgctacttcgacttctggggccgcggcaccggcgtctccgtctccgcc

SEQ ID NO: 57978 - RNA, 396 nt, synthetic construct
  misc_feature 1..396: note = derived and/or modified sequence opt11 from anti-HIV_Chain
  source 1..396: mol_type = other RNA
caagtacaattggtccagagcgggaccgcgctcaagagcccgggctcgagcgcgaaattaagctgtaccgtactcggagacgagttcgggacctatttcataagctggatcaggcaagcgcccggacaagggctcgagtgggtgggcgggatcgtaccccatagccagctccagagctcggcccagaaatttcacgggcgcataatcataagcgcaggcgcaggcgtgaccccgcccgtggtctcactccagctaacgaacttgacctttgaagataccgggacctacttctgtgccagggaaaggggcaggcacagggacccgaaaacgggcaaggccccgcgcgggcgctatttcgatttctggggcaggggcacgggcgtgacagtgagcgcg

SEQ ID NO: 57979 - RNA, 396 nt, synthetic construct
  misc_feature 1..396: note = derived and/or modified sequence opt11 from anti-HIV_Chain
  source 1..396: mol_type = other RNA
caagtgcaactggtccagagcgggacagcgctcaagagcccaggctcgagcgcgaaattgagctgtaccgtactcggggacgagttcgggacctatttcataagctggatcagacaagcgcccgggcaagggctcgagtgggtgggcgggatcgtgccccatagccagctccagagctcggcccagaaatttcacgggcgaataaccataagcgcaggcgcgggcgtgaccccgcccgtggtctcgctccagctcacgaacttgaccttcgaagataccgggacctatttctgtgccagggaaaggggcaggcacagggacccgaaaacgggcgacgccttgcgcgggcgctatttcgatttctggggcagaggcacgggcgtgcgcgtgagcacg

SEQ ID NO: 57980 - RNA, 396 nt, synthetic construct
  misc_feature 1..396: note = derived and/or modified sequence opt11 from anti-HIV_Chain
  source 1..396: mol_type = other RNA
caagtgcaactggtccagagcggggccgcggtaaagagcccgggctcgagcgcgaaattgagctgtaccgtgctcggggacgagttcgggacctatttcataagctggatcaggcaagcgcccgggcaagggctcgagtgggtgggcgggatcgtgccccatagccagctacagagctcggcccagcgctttcacgggcgcataaccataagtgcgggcgcgggcgtgacaccgccagtggtctcgctccagctcacgaacctgacctttgacgatgccgggacctatttctgtgccagggaaaggggcaggcacagagacccaaaaacgggcgatgccctgcgcgggcgctatttcgatttctggggcaggggcacgggcataagcgtgagcccg

SEQ ID NO: 57981 - RNA, 396 nt, synthetic construct
  misc_feature 1..396: note = derived and/or modified sequence opt11 from anti-HIV_Chain
  source 1..396: mol_type = other RNA
gaagtgcaattggtccagagcggggccgaggtcaagaaaccgggcgcgagcgtgaaagtgagctgtaaagtgagcgggtacacgctcacggaattgagcatacactgggtcaggcaagcgcccgggaaagggctcgagtggatgggcgggttcgaccccgaggacgatgaagcgatctatgaaccgaaatttcaagggcgactgaccatgaccgaggacacgagcacggacacagcctatatggagctctcgagcttgcgctcggaagataccgcggtctattactgtgccacggccgatccctttaaagtggcccaggacgagggcttgtacgtgatctttgactattgggggcaagggaccttggtcacggtctcgagcgcgagcacgaaaggg

SEQ ID NO: 57982 - RNA, 396 nt, synthetic construct
  misc_feature 1..396: note = derived and/or modified sequence opt11 from anti-HIV_Chain
  source 1..396: mol_type = other RNA
gaggtccagctcgtggaatcgggcgggggcctgctccagcccgggggctcgctcaggctctcgtgcgcggcatcgggctttagctttaacgatttcgagatgaattgggtgcgacaggccccgggcaagggcttggaatgggtctcgtacataagcaatgacgggaccatgatccattacgcggactcggtcaagggcaggttcacgatctcgcgcgataacgcgaaaaagagcttgttcttgcaaatgaactcgctcagggccgaggacacggccgtgtactattgcgcgcgcttggccgaggtcccgcccgcgatcaggggctcgtactattacgggatggatgtctggggacagggcacgaccgtgaccgtggcctcggcatcgaccaagggc

SEQ ID NO: 57983 - RNA, 396 nt, synthetic construct
  misc_feature 1..396: note = derived and/or modified sequence opt11 from anti-HIV_Chain
  source 1..396: mol_type = other RNA
caagtgcaattgatgcagagcggggccgaggtcaagcgcccgggcgcgagcgtgaaagtgagctgtaaagcgttcaggcactcgctcaataacttgggcataagctggatcaggcgcgcgcccgggcgcgggctcgagtggttaggctggatcaatgtctatgaagggaacacgaaatatggcaggcgctttcaagggcgcgtgaccatgaccacggacaggagcacgaacacggtctcgatggagctcaggagcttgacctcggacgataccgcggtctattactgtgccagggacaatcatttttggtcgggctcgagcaggtactattactttggcatggacgtgtgggggcaagggaccacggtcatagtctcgagcgcgagcacgaaaggg

SEQ ID NO: 57984 - RNA, 396 nt, synthetic construct
  misc_feature 1..396: note = derived and/or modified sequence opt11 from anti-HIV_Chain
  source 1..396: mol_type = other RNA
caagtgcaattggtccagtggggcgccgggctcttgaaaccgctcgagaccttgagcttgacctgtgccgtgtacggcgggtcgttcaatgggtatttctggagctggatcaggcaaacgcccgggaaagggctcgagtggataggcgagatcaatcacgggggctcggcaaatttcaatccctcgctcaagagcagggtcacgatgtcagtcgatacctcgaaaaatcaatttagcttgaaattggcctcggtcacggccgcggacacggccatatactattgcgcgcgcgggcgaataaccatggtcaggggcgatccccagcgcgggggcgtgcgcatggacgtgtgggggcaagggacctcggtcacggtctcgagcgcgagcacgaaaggg

SEQ ID NO: 57985 - RNA, 396 nt, synthetic construct
  misc_feature 1..396: note = derived and/or modified sequence opt11 from anti-HIV_Chain
  source 1..396: mol_type = other RNA
ctagtgcaactggtccagagcggggccgaggtcaagaaaccgggcgcgagcgtgaaagtgagctgtaaagtgagcgggcacacgctctcggaattgagcataaactgggtcaggcacgtgcccgggaaagggctagagtggatgggcgggctcgatccagaggacggggaagcgatccatgaaccgaaatttcaagggcgcttgaccatgaccgaggacacgagcacggacacggcctatagcacgctctcggtctgggccccggtcgcggccgcgatgtattactgtgccacggccgatccctttaaagtggcccaggacgagggcttgtacgtgatctttgactattgggggcaagggaccctggtcacggtctcgagcgcgagcacgaaaggg

SEQ ID NO: 57986 - RNA, 396 nt, synthetic construct
  misc_feature 1..396: note = derived and/or modified sequence opt11 from anti-HIV_Chain
  source 1..396: mol_type = other RNA
caagtgcaactgctccagagcgggggcgaggtcaagaaaccgggcgcgagcgtgaaagtgagctgtaaagtgagcgggtacacgctcacggaattgagcatacactgggtcaggcaagcgcccgggaaagggctcgagtggatgggcgggttcgatcccgaggacgatgaagcgatctatgaaccgaaatttcaagggcgcttgaccatgaccgaggacacgagcacggacacggcctatatggagctctcgagcttgcgctcggaagataccgcggtatattactgtgccacggccgatccctttaaagtggcccaggacgagggcttgtacgtgatctttgactattgggggcaagggaccttggtcacggtctcgagcgcgagcacgaaaggg

SEQ ID NO: 57987 - RNA, 396 nt, synthetic construct
  misc_feature 1..396: note = derived and/or modified sequence opt11 from anti-HIV_Chain
  source 1..396: mol_type = other RNA
caagtgcaattggtccagagcggggccgaggtcaagaaaccgggcgcgagcgtgaaagtgagctgtaaagtgagcgggtacacgctcacggaattgagcatacactgggtaaggcaagcgcccgggaaagggctcgagtggatgggcgggttcgatagcgaggacggggaagcgttctataaacagaactttcaagggcgcgtgaccatgaccgaggacacgagcacggacacggcctatatggagctcaggcgcttgcgctcggaagataccgcggtctattactgtgccacggccgatcgctttaaagtggcccaggacgagggcttgttcgtgatctttgactactgggggcaagggaccttggtcacggtctcgagcgcgagcacgaaaggg

SEQ ID NO: 57988 - RNA, 396 nt, synthetic construct
  misc_feature 1..396: note = derived and/or modified sequence opt11 from anti-HIV_Chain
  source 1..396: mol_type = other RNA
caagtccacctcgtccaatccggcgccgaagtcaaaaaacccggcgcctccgtccgcgtatcctgcaaagcctccggctacaccttcaccacctacggcatctcatgggtccgccaagcccccggccaaggcctcgaatggatgggctggatctccgcccactcaggcgacaccaactacgcccaaaaactccaagcccgcgtcaccatgaccaccgacacctccaccaacaccgcctacatggaactccgctccctcacatccgacgacaccgccgtctactactgcgcccgcgaccgcccccgccactactacgaccgaggcggctactactcccccttcgactactggggccaaggcaccctcgtcaccgtctcctccgcctcaaccaaaggc

SEQ ID NO: 57989 - RNA, 396 nt, synthetic construct
  misc_feature 1..396: note = derived and/or modified sequence opt11 from anti-HIV_Chain
  source 1..396: mol_type = other RNA
ctcgtccaactcctccaatcaggcgccgaagtcaaaaaacccggcgcctccgtcaaagtctcctgcaaagtctccggctacaccctcaccgaactctccatccactgggtccgccaagcccccggcaaaggcctcgaatggatgggcggcttcgaccccgaagacgacgaagccatctacgaacccaaattccaaggccgcctcaccatgaccgaagacacctccaccgacaccgcctacatggaactctcctccctccgatccgaagacaccgccgtctactactgcgccaccgccgaccccttcaaagtcgcccaagacgaaggcctctacgtcatcttcgactactggggccaaggcaccctcgtcaccgtctcctccgcctccaccaaaggc

SEQ ID NO: 57990 - RNA, 396 nt, synthetic construct
  misc_feature 1..396: note = derived and/or modified sequence opt11 from anti-HIV_Chain
  source 1..396: mol_type = other RNA
caagtgcaattggtccagagcggggccgaggtcaagaaaccgggcgcgagcgtgaaagtgagctgtaaagtgagcgggcacacgctctcggaattgagcataaactgggtcaggcacgtgcccgggaaagggctcgagtggatgggcgggctagatcccgaggacggggaagcgatccatgaaccgaaatttcaagggcgcttgaccatgaccgaggacacgagcacggacacggcctatgtcgagctctcgagcttgcgctcagaagataccgcgatgtattactgtgccacggccgatccctttaaagtggcccaggacgagggcttgtacgtgatctttgactattgggggcaagggaccttggtcacggtctcaagcgcgagtacgaaaggg

SEQ ID NO: 57991 - RNA, 396 nt, synthetic construct
  misc_feature 1..396: note = derived and/or modified sequence opt11 from anti-HIV_Chain
  source 1..396: mol_type = other RNA
caagtgcaactgctccagagcggggccgaggtcaagaaaccgggcgcgagcgtgaaagtgagctgtaaagtgagcgggtacacgctaacggaattgagcataaactgggtcaggcaagcgcccgggaaagggctcgagtggatgggcgggttcgatcccgaggacgatgaagcgatctatgaaccgaaatttcaagggcgcttgaccatgaccgaggacacgagcacggacacggcctatatggagctctcgagcttgcgctcggaagataccgcggtctattactgtgccacggccgatccctttaaagtggcccaggacgagggcttgtacgtgatcttcgactattgggggcaagggaccttggtcacggtctcgagcgcgagcacgaaaggg

SEQ ID NO: 57992 - RNA, 396 nt, synthetic construct
  misc_feature 1..396: note = derived and/or modified sequence opt11 from anti-HIV_Chain
  source 1..396: mol_type = other RNA
caaccccaactagtacaatccggctccggcgccgaagtcaaaaaacccggcgcctccgtccgcatctcctgcgaagcctccgaatacaacgtcttcgaccacttcatgcaatgggtccgccaagcccccggccaaggcctcgaatggatgggctggatcaacccccgcggcggctacccctcctactcccccaccttccaaggccgcctaaccttcacccgccaaccctcatgggacgactccaccatcaccttccacatggaactccgcggactcggccacgacgacaccgccgtctactactgcgcccgcccccactcccccgacgacgcctggtccctcgacgtctggggccgcggcaccctcgtcaccgtctcctccgcctccaccaaaggc

SEQ ID NO: 57993 - RNA, 396 nt, synthetic construct
  misc_feature 1..396: note = derived and/or modified sequence opt11 from anti-HIV_Chain
  source 1..396: mol_type = other RNA
caaccccaactcgtacaatccggctccggcgccgaagtcaaaaaacccggcgcctccgtccgaatctcctgcgaagcctccgaatacaacgtcttcgaccacttcatgcaatgggtccgccaagcccccggccaaggcctcgaatggatgggctggatcaacccccgcggcggctacccctcctactccccccgcttccaaggccgcctcaccttcacccgccaaccctcctgggacgactcctccgtcaccttccacatggaactccgcggactccgacacgacgacaccgccgtctactactgcgcccgcccccactcacccgacgacgcctggtccctcgacgtctggggccgcggcaccctcgtcaccgtctcctccgcatcaaccaaaggc

SEQ ID NO: 57994 - RNA, 396 nt, synthetic construct
  misc_feature 1..396: note = derived and/or modified sequence opt11 from anti-HIV_Chain
  source 1..396: mol_type = other RNA
gaagtgcaattggtcgagagcgggggcggggtcgtggaaccgggcgagagcttgcgcttgagctgtgccgcgagcgggttcacgttcaggagctatgacatgttctgggtcaggcaagcgaccgggaaatcgctcgagtgggtgagcgcgatcgggatcgcgggcgatacctattactcgggctcggtcaagggaaggttcacgatctcgcgcgagaacgcgcgcacgagcttgtacttgcaattgagcgggctcagggtcgaggactcggccgtgtacttttgcgtgcgcgggagcccgcccaggatcgcggccacggaatataactattactatggcctggacgtgtgggggcaagggaccacggtctcggtatttagcgcgagtacgaaaggg

SEQ ID NO: 57995 - RNA, 396 nt, synthetic construct
  misc_feature 1..396: note = derived and/or modified sequence opt11 from anti-HIV_Chain
  source 1..396: mol_type = other RNA
caggtccagctcgtgcaatcgggcgcggaagtgaaaaagcccgggagctcggtcaaggtctcgtgcaaggcctcgggcgggacctttaccacgtacgatatctcgtgggtgcgccaggccccgggccagggcctggaatggatgggcgggatactcccggactttggcgcgccctcgtacgcgcaaaagttccaggacagagtcacgatcacgaccgatgaatcgagctcgaccgcgtacatggaattgaactcgctcaggagcgaggacacggccatatactattgcgcgcgcgggcgcggggacgatttctggagcggggaatcaccctcgtggtatttcgattactggggccagggcacgctcgtgaccgtgagctcggcatcgaccaagggc

SEQ ID NO: 57996 - RNA, 396 nt, synthetic construct
  misc_feature 1..396: note = derived and/or modified sequence opt11 from anti-HIV_Chain
  source 1..396: mol_type = other RNA
cagccccagctcgtgcaatcgggctcgggcgcggaagtgaaaaagcccggagcctcggtcaggatctcgtgcgaggcctcagaatataacgtgttcgatcactttatgcagtgggtgcgccaggccccgatggagggcctggaatggatggggtggataaacccgcgcgggggctacccctcgtactcgcccacgttccagggcaggctcacgttcacacgccagccctcgtgggatgactcgaccataacctttcacatggaattgcgcggactcaggcacgatgacacggccgtgtactattgcgcgcgcccgcactcgcccgatgacgcgtggtcgctcgatgtctggggcaggggcacgctcgtgaccgtgagctcggcctcgaccaagggc

SEQ ID NO: 57997 - RNA, 396 nt, synthetic construct
  misc_feature 1..396: note = derived and/or modified sequence opt11 from anti-HIV_Chain
  source 1..396: mol_type = other RNA
gaagtgcgcctgctagagagcgggggcgggctcgtgcaaccgggcgggagcttgcgattgagctgtagcgcgagcgggttcacgttctcgaactcggccctgagctgggtcaggcaagcgcccgggaaagggctcgagtgggtgagctcggtcgtgagctcgggaggggacacgttctatgccgatagcgtgaaagggcgctttaccataagcagggacaatagcaggaacacgctatatcttcagatgaaaagcctgcgcgcggaagataccgcgctctattactgtgccaaggtccagatccagcaattgaactttggcgtgatcacggacgcgggcatggacgtgtgggggaaggggaccacggtcatagtctcgagcgcgagcacgaaaggg

SEQ ID NO: 57998 - RNA, 396 nt, synthetic construct
  misc_feature 1..396: note = derived and/or modified sequence opt11 from anti-HIV_Chain
  source 1..396: mol_type = other RNA
caggtccagctcgtggaatcgggcgggggcgtggtccagcccgggcgctcgctcaggctatcgtgcgtgggctcgggctttacctttagctcgagcgggatgcattgggtgcgccaggccccgggcaagggcttggaatgggtcgcggtcataagctcggacgggagcgatgaatattacggggactcagtcgagggcaggttcacgatctcgcgcgataactcgaaaaataccttgttcctgcaactggactcgctcgaggccgaggactcggccgtgtactattgcgcgaaaacgcccccgcactatgacgcgctcacgggctatccctcgagcgtgctcgagttctggggcttgggcacgctcgtgaccgtgagctcagcctcgaccaagggc

SEQ ID NO: 57999 - RNA, 396 nt, synthetic construct
  misc_feature 1..396: note = derived and/or modified sequence opt11 from anti-HIV_Chain
  source 1..396: mol_type = other RNA
gaggtccagctcgtgcaatcgggcgcggaagtgaaaaagcccgggagctcggtcaaggtctcgtgcaaggcctcgggcgggacctttaccacgtacgatatctcgtgggtgcgccaggccccgggccagggcttggaatggatcgggggcatactcccggactttggcgcgccctcgtacgcgcaaaagttccaggacagggtcacgatcacgaccgatgaatcgagcaggaccgcatacatggaactgaactcgctcaggagcgaggacacggccatatactattgcgcgcgagggcgcggggacgatttctggagcggggaatcgccctcgtggtatttcgattactggggccagggcacgcaagtgaccgtgagctcggcctcgaccaagggc

SEQ ID NO: 58000 - RNA, 396 nt, synthetic construct
  misc_feature 1..396: note = derived and/or modified sequence opt11 from anti-HIV_Chain
  source 1..396: mol_type = other RNA
caagtgcaactgctccagagcgggaccgaggtcaagaaaccggggtcgagcgtgaaagtgagctgtcgcgcgagcgggtggacgctagggaactcgcccaatagcgcgatcgggtgggtgcgccaggccccgggccagggcttggaatggatcgggcgcataatcccgatcctggacgtgaccaattacgcgcaaaagttccagggcagggtcacgatctcggccgataaatcgaccaatatcgcgtacatggaaataagctcgctcgggagcgaggacacggccttttactattgcgcgcgcgtgatcacgggcatgacctcgccctggtacttttacatggacgtgtggggcgaagggaccacggtcatagtctcgagcgcgagcacgaaaggg

SEQ ID NO: 58001 - RNA, 396 nt, synthetic construct
  misc_feature 1..396: note = derived and/or modified sequence opt11 from anti-HIV_Chain
  source 1..396: mol_type = other RNA
caagtgcacttggtccagagcggggccgaggtcaagaaaccgggctcgagcgtgcgcgtgagctgtaaagcgagcgggtggacgttcggggactcggtcaatagcgcgatcacgtgggtgcgccaggccccgggccagggcttggaatggatggggcgctttatcccgatcttgggcttgagcaattacgcgcaaaagttccaggacagggtcacgatcaatgtcgatcgctcgaccaataccgcgtacatggaattgagcgggctcaggagcgaggacacggccgtgtactattgcgcgcgcttgatcacgggcatgaacgcgccctggttctattacatggacgtgtgggggaaagggaccacgatcacggtctcgagcgcgagcacgaaaggg

SEQ ID NO: 58002 - RNA, 396 nt, synthetic construct
  misc_feature 1..396: note = derived and/or modified sequence opt11 from anti-HIV_Chain
  source 1..396: mol_type = other RNA
caagtgcacttggtccagagcggggccgaggccaagcgcccgggctcgagcgtacgcgtgagctgtcgcgcgagcgggggcgatttctcgagctataccttgagctgggtcaggcaagcgcccgggcaagggctcgagcgcatgggcggggtcgtgcccatgctagataccgtgcactatgcccagaaatttcaagggcgcctgaccttgagcgtggacgagggcacgagcacggcctatatggagctctcgagtttgcgctcggaagacaccgcgatgtattactgtaccaggggcaggcaaacgttcagggccatatggtcgggcccgcccgtggtctttgacatatgggggcaagggaccttggtctcggtctcgagcgcgagcacgaaaggg

SEQ ID NO: 58003 - RNA, 396 nt, synthetic construct
  misc_feature 1..396: note = derived and/or modified sequence opt11 from anti-HIV_Chain
  source 1..396: mol_type = other RNA
caagtgcacttggtccagagcggggccgaggccaagcgcccgggctcgagcgtgcgcgtgagctgtcgcgcgagcgggggcgatttctcgagctataccttgagctgggtcaggcaagcgcccgggcaagggatcgagtggatgggcggggtcgtgcccatgctcgataccgtgcactatgcccagaaatttcaagggcgcttgaccttgagcgtggacgagggcacgagcacggcctatatggagctctcgagcttgcgctcggaagataccgcgatgtattactgtaccaggggcaggcaaacgttcagggccatatggtcgggcccgcccgcggtctttgacatatgggggcaagggaccttggtcatagtctcgagcgcgagcacgaaaggg

SEQ ID NO: 58004 - RNA, 396 nt, synthetic construct
  misc_feature 1..396: note = derived and/or modified sequence opt11 from anti-HIV_Chain
  source 1..396: mol_type = other RNA
caagtccaactcgtccaatccggcgccgaactcaaaaaacccggctcctccgtcaaagtctcctgcaaagcctccggcggcaccttcaacaaccacaccttcaactgggtccgccaagcccccggccaaggcctcgaatggatgggccgcaccatccccatcctcggctcacgagactacgccaaaaccttccaagaccgcgtcaccatcatcgcagacaaatcaacctccaccgtctacctcgaactccgccgcctcaaatccgaagacaccggcgtctactactgcgccacctccatgtactacttcgactccggcggctactaccgaaacaccgacctcgacaaatggggccaaggctccctcgtcaccgtctcctccgcctccaccaaaggc

SEQ ID NO: 58005 - RNA, 396 nt, synthetic construct
  misc_feature 1..396: note = derived and/or modified sequence opt11 from anti-HIV_Chain
  source 1..396: mol_type = other RNA
caagtgtacttggtccagagcgggcccgagctcaagaaaccgggcgcgagcgtgaaaataagctgtaaagcgagcgggtacaatttcccgaaatatgccatacactgggtcaggcaagcgcccgggcaagggctccagtggatgggctggatcaatggcgataacggggacgcgcgctatagccagaaattgcaagggcgcgtgaccccgagcacggacacgagcgcgagcgtggtctatatggagctaaagcgcctgcgctcggaagataccgcggtctattactgtgccagagccttgtacccgtgggagatcgggggcgtgccctcgaccatgggcgatgactattgggggcaagggaccttgatcacggtatcgagcgcgagcacgaaaggg

SEQ ID NO: 58006 - RNA, 396 nt, synthetic construct
  misc_feature 1..396: note = derived and/or modified sequence opt11 from anti-HIV_Chain
  source 1..396: mol_type = other RNA
caagtacaactcgtacaatcaggccccgaactcatgaaacccggctcctccgtcaaagtctcctgccgcgcctccggcgacaacttcctcacctccaccttcaactggctccgccaagcccccggccaacgcctcgaatggatgggccgcttcatcccctccctcggactcatcacctccgcccccaaattctccgaccgcctcaccatcaccgccgaccaagccaccctcaccgcctacatggaactcaccggcctaacatccgaagacaccgccctctactactgcgcccgcggcctctgccgcggcggcaactgccgcctcggcccctccggctggctcgacccctggggccgcggcacccaagtcaccgtctcctccgcctccaccaaaggc

SEQ ID NO: 58007 - RNA, 396 nt, synthetic construct
  misc_feature 1..396: note = derived and/or modified sequence opt11 from anti-HIV_Chain
  source 1..396: mol_type = other RNA
ggcgtgcactttcaagggcacttggtccagagcgggggcggggtcaagaaaccgggctcgagcgtgaccataagctgtctcgcgagcgagtacacgttcacggaatttaccatacactggatcaggcaagcgcccgggcaagggcccttgtggttgggcttgatcaagcgctcgggcaggctcatgacctcatacaggttccaggacaggctctcgctcaggcgcgatcgctcgaccgggaccgtgttcatggaactgcgcgggctcaggatcgatgacacggccgtgtactattgcgcgcgagatggcttgggcgaggtcgcgcccgcgtacttgtacgggatcgatgtctggggccagggctcgaccgtgatcgtgacctcggcctcgacctcg

SEQ ID NO: 58008 - RNA, 396 nt, synthetic construct
  misc_feature 1..396: note = derived and/or modified sequence opt11 from anti-HIV_Chain
  source 1..396: mol_type = other RNA
caagtgcaattgctccagagcggggccgaggtcaagaaaccgggcgcgagcgtgaaagtgagctgtaaagtgagcgggtacacgctcacggaactgagcatacactgggtcaggcaagcgcccgggaaagggctcgagtggatgggcgggttcgatcccgaggacgatgaagcgatctatgaaccgaaatttcaagggcgcctgaccatgaccgaggacacgagcacagacacggcctatatggagctctcgagcctgcgctcggaagataccgcggtctattactgtgccacggccgatccctttaaagtggcccaggacgagggcttgtacgtgatctttgactattgggggcaagggaccttggtcacagtctcgagcgcgagcacgaaaggg

SEQ ID NO: 58009 - RNA, 396 nt, synthetic construct
  misc_feature 1..396: note = derived and/or modified sequence opt11 from anti-HIV_Chain
  source 1..396: mol_type = other RNA
caagtgcaattggtccagagcggggccgaggtcaagaaaccgggcgcgagcgtgaaagtgagctgtaaagtgagcgggtacacgctcacggaattgagcatacactgggtcaggcaagcgcccgggaaagggctcgagtggatgggcgggttcgatcccgaggacggggaagcgagctttgaaccgaaatttcaagggcgcttgaccatgaccgaggacacgagcacggacacggcctatatggagctctcgagcttgcgctcggaagataccgcggtctattactgtgccacggccgatccctttaaagtagcccaggacgagggcttgtacgtgatctttgactattgggggcaagggaccctggtcacggtctcgagcgcgagcacgaaaggg

SEQ ID NO: 58010 - RNA, 396 nt, synthetic construct
  misc_feature 1..396: note = derived and/or modified sequence opt11 from anti-HIV_Chain
  source 1..396: mol_type = other RNA
ggcgtgcactttcaagggcacttggtccagagcgggggcggggtcaagaaaccgggctcaagcgtgaccataagctgtctcgcgagcgagtacacgttcacggaatttaccatacactggatcaggcaagcgcccgggcaagggcccttgtggttgggcttgatcaagcgctcgggcaggctcatgacctcgtacaggttccaggacaggctctcgctcaggcgcgatcgatcgaccggaaccgtgttcatggaattgcgcgggctcaggatcgatgacacggccgtgtactattgcgcgcgcgatggcttgggcgaggtcgcgcccgcgtacttgtacgggatcgatgtctggggccagggcacgaccgtgatcgtgacctcggcctcgacatcg

SEQ ID NO: 58011 - RNA, 396 nt, synthetic construct
  misc_feature 1..396: note = derived and/or modified sequence opt11 from anti-HIV_Chain
  source 1..396: mol_type = other RNA
caagtgcaattgggcgagagcgggggcgggctcgtggaaccgggcgggagcttgcgcttgagttgtgccgcgagcgggttcttgttctcggactatcaaatgagctggatcaggctcgcgcccgggaaagggctcgagtggatcagctttatatcgggctttggctcggtctattacgcggactcggtcgagggcaggttcacgatctcgcgcgataacgcgcgcaatagcttgtacttgcaaatgaacaatctcagggccgaggacacggccgtgtactattgcgcgcgcgcgtacgggaccgggaactggcgcgggctctattactattactatggcatggacgtgtgggggcacgggaccacggtcacggtctcgagcgcgagcacgaaaggg

SEQ ID NO: 58012 - RNA, 399 nt, synthetic construct
  misc_feature 1..399: note = derived and/or modified sequence opt11 from anti-HIV_Chain
  source 1..399: mol_type = other RNA
caagtccaactcgtccaatccggcaccgccctcaaatcccccggctcctccgccaaactatcctgcaccgtcctaggcgacgaattcggcacctacttcatctcctggatccgccaagcccccggccaaggcctcgaatgggtcggcggcatcgtcccccactcccaactccaatcctccgcccaaaaattccacggccgcatcatcatctccgccggagccggcgtcaccccccccgtcgtctccctccaactcaccaacctcaccttcgaagacacaggcacctacttctgcgcccgagaacgcggccgccaccgcgaccccaaaaccggcgacgccctccgcggccgctacttcgacttctggggacgcggcaccggcctccgcgtctccacctcc

SEQ ID NO: 58013 - RNA, 399 nt, synthetic construct
  misc_feature 1..399: note = derived and/or modified sequence opt11 from anti-HIV_Chain
  source 1..399: mol_type = other RNA
gaagtgcaattggtccagagcgggggcgggctcgtgaaaccgggcgggagcttgcgcttgagctgtgccgcgagcgggttcacgttcaagaacgcatggatgagctgggtaaggcaagcgcccgggaaagggctcgagtgggtgggccatatcaagagcaagaccgatggcgggaccatagactatgccgcgcccgtgaaagggcgctttaccataagcagggacgatagcaagaacacgctctatctccagatgaatagcttgaaaatagaagataccgcggtctattactgtacaacggacataggctcgggcaggggctgggactttcactattacgatagcaacgactggggccagggcacgctcgtgaccgtgagctcagcctcgaccaagggc

SEQ ID NO: 58014 - RNA, 399 nt, synthetic construct
  misc_feature 1..399: note = derived and/or modified sequence opt11 from anti-HIV_Chain
  source 1..399: mol_type = other RNA
caggtccagctcgtggaatcgggcgggggcgtggtccagccagggcgctcgctcaggctcttttgcgcggcctcgggctttgcctttaacacgtacgggatgcattgggtgcgccaggccccgggcaagggcttggaatgggtcgcggtcacgtggcatgacgggagccagaaatattacgcggactcggtcaagggcaggttcacgatctcgcgcgataactcgaaaaataccctgtacttgcaaatgaactcgctcagggccgaggacacggccatatactattgcgcgagcgatcaagggggctttgacgatagctcgggatatttcgcgcccgggggcatggacgtgtgggggcgcgggaccacggtcatagtctcgagcgcgcccacgaaaggg

SEQ ID NO: 58015 - RNA, 399 nt, synthetic construct
  misc_feature 1..399: note = derived and/or modified sequence opt11 from anti-HIV_Chain
  source 1..399: mol_type = other RNA
ggctatagcgaggtccagctcgtgcaatcgggcccgggcttggtcaagccctcgcaaacgctctcgctcacatgcacggtctcgggcgggagcataagcaatggcgggcactattggaattggatacgccagcacccgggcaagggcctggaatggatcgggcacatatacaatatcgcgaccacgtactataacccgagcttgaaatcgcgcgtaagcataagcgtggacacgagcaagaaccagttctcgctcaagctatcgagcgtgaccgcggccgataccgcggtctattactgtgccaggggctcgggaaggtggacgatcggcgccaggatctatttcgataactggggccagggcgcgctcgtggccgtgagctcggcctcgaccaagggc

SEQ ID NO: 58016 - RNA, 399 nt, synthetic construct
  misc_feature 1..399: note = derived and/or modified sequence opt11 from anti-HIV_Chain
  source 1..399: mol_type = other RNA
caactacaattgaaagagagcgggcccgggatggtgaaaccgagcgagaccttgagcttgacctgtagcgtgagcggagcctcagtcgtgagcgcgaacgattactggggctggatcaggcaagcgcccgggaaagggctcgagtgcataggcataatcttgtacacgggctcgaccttttacaatccctcgctccagagcagggtcacgatctcgcgcgatccctcgaaaaatcacgtgagcttgacattgacctcagtcacggccgcggactcggccgtgtactattgcgcgcgcataccctatcactcggaatcatattataacgtggtcataggcgggttcgatgtctggggccagggaacgcgcgtgaccgtgagctcggcctcgaccaagggc

SEQ ID NO: 58017 - RNA, 399 nt, synthetic construct
  misc_feature 1..399: note = derived and/or modified sequence opt11 from anti-HIV_Chain
  source 1..399: mol_type = other RNA
tgtcaagtgcaattggtcgagagtgggggcggggtcgtgcaaccaggcaggagcttgcgcttgagctgtgtcgggagcgggttcacgttctcgagctcgggcatgcactgggtcaggcaagcgcccgggaaagggctagagtgggtggcagtgatatcgagcgatggctcggacgagtactatggcgatagcgtggaagggcgctttaccataagcagggacaatagcaagaacacgctctttctccagctcgatagcctggaagcggaagatagcgcggtctattactgtgccaagaccccgccccattacgatgccttgaccgggtacccgagctcggtcttggaattttgggggctcgggaccttggtaacggtctcgagcgcgagcacgaaaggg

SEQ ID NO: 58018 - RNA, 399 nt, synthetic construct
  misc_feature 1..399: note = derived and/or modified sequence opt11 from anti-HIV_Chain
  source 1..399: mol_type = other RNA
caggtgcagctggtgcagagtggggcggatgtgaagaagccgggggcgagtgtgaaggtgagttgtaaggtgagtgggtatacggtgagtgagctgagcatacattgggtgaggcaggcgccggggaaggggttggagtggatgggggggtttgatccggaggatgggaagacggtgagtgcgcagaattttcaggggagggtgacgatgacggaggataagagtacggggacggcgaatatggagttgaggagtctgaggagtgaggatacggcggtgtattattgtgcgacgacggtgcagttgatagtggatttttgtaatggggggccgtgttataattttgatgattgggggcaggggacgttggtgacggtgagtagtgcgagtacgaagggg

SEQ ID NO: 58019 - RNA, 399 nt, synthetic construct
  misc_feature 1..399: note = derived and/or modified sequence opt11 from anti-HIV_Chain
  source 1..399: mol_type = other RNA
ggcctcgacctcgaacacgacggccaccacaaagaagaaccccgagcctccgtcaccgtctcctgcgaagcctccggatacaacttcgtaaactacatcatccactgggtccgactcaccccaggccgcggcttcgaatggatgggcatgatcgacccccgccgcggccgcccctggtcagcccaaaaattccaaggccgcctcaccctcacccgcgacatcgactccgaacgcctctacatgcaactctccggcctccgcggcgacgacaccgccgtatacttctgcgcccgccaagaacccgacttccacgacggacacggacacaccctccgcggcatgttcgacagctggggccaaggctcccccgtctcagtctcctccgcctccaccaaaggc

SEQ ID NO: 58020 - RNA, 399 nt, synthetic construct
  misc_feature 1..399: note = derived and/or modified sequence opt11 from anti-HIV_Chain
  source 1..399: mol_type = other RNA
caagtgcgactggtccagagcggggcccagctcaagaaaccgggcgcgagcgtgaccgtaagctgtgaagcgagcgggtacaatttcgtgaactacatcataaactgggtcaggcaaacacccgggcgctcgttcgagtgggtgggcatgatcgatcccaggcgcgggcgcccgtggtcggcccagaaatttcaagggcgcttgaccctgaccagggacatagactcggaaaagctctatatgcatctctcgggcctgcgcggggacgataccgcggtctactactgtgccaggcaagacagcgatttccatgacgggcacgggcacacgctcaggggcatgttcgatagctggggccagggctcgcccgtgaccgtaagctcggcctcgaccaagggc

SEQ ID NO: 58021 - RNA, 399 nt, synthetic construct
  misc_feature 1..399: note = derived and/or modified sequence opt11 from anti-HIV_Chain
  source 1..399: mol_type = other RNA
caagtgcgcctgagccagagcggggccgcggtcgtgaaaacgggcgcgagcgtgaccataagctgtgaaacggaagggtacacgttcgtaaactatatcatacactgggtcaggcaaccgcccggacgcgggttcgagtggctgggcatgatcgatcccaggaacgggcacccgtggtttggccagcgctttcgcgggcgcttgagcctgcgcagggacaggagcacagaaacggtctttatgacgctatcgggcttgacatcggacgataacgggatatacttctgtgccaggaacgagccccagtactatgacgggagcgggcactcactaccgggaatgttcgattactggggccagggcacgcgcgtggtcgtgagctcggcctcgaccaagggc

SEQ ID NO: 58022 - RNA, 399 nt, synthetic construct
  misc_feature 1..399: note = derived and/or modified sequence opt11 from anti-HIV_Chain
  source 1..399: mol_type = other RNA
caagtgcgcttgagccagagcggggccgcggtcatgaaaacgggcgcgagcgtgaccataagctgtgaaacggaagggtacaatttcgtgaactatatcatacactgggtcaggcgcccgcccgggcgcggattcgagtggttgggcatgatcgatcccaagaacgggcacccgtggttcgcccaggccgtgcgcgggcgcctgagcctgcgcagggacacgttcaatgaagtagtctatatgacgctctcgggcttgacatcggacgataccgggctctatttctgtgccaggaacgagccccagtaccatgacggaaacgggcactcgctcccgggcatgttcgatttctggggccagggcacgctcgtgaccgtgagctcggcctcgaccaagggc

SEQ ID NO: 58023 - RNA, 399 nt, synthetic construct
  misc_feature 1..399: note = derived and/or modified sequence opt11 from anti-HIV_Chain
  source 1..399: mol_type = other RNA
caagtgcgcctgagccagagcggggcagcggtcgtgaaaacgggcgcgagcgtgaccataagctgtgaaacggaagggtacacgttcgtgaactatatcatacactgggtcaggcaaccgcccgggcgcgggttcgagtggttgggcatgatcgatcccaggaacgggcacccgtggtttggccagcgcttgcaagggcgcctgagcctacgcagggacaggagcacggaaacggtctttatgacgctctcgggcttgacctcggacgataccgggatctatttctgtgccaggaacgagccccagtactacgacgggagcgggcactcgctcccgggcatgttcgattactggggccagggcacgcgcgtggtcgtgagctcggcctcgaccaagggc

SEQ ID NO: 58024 - RNA, 399 nt, synthetic construct
  misc_feature 1..399: note = derived and/or modified sequence opt11 from anti-HIV_Chain
  source 1..399: mol_type = other RNA
caagtgcgcttgagccagagcggggccgcggtcgtgaaaacgggcgcgagcgtgaccataagctgtgaaacggaagggtacacgttcgtgaaccatatcatacactgggtcaggcaaccgcccgggcgcgggttcgagtggttgggcatgatcgatcccagaaacgggcacccgtggtttggccagcgcttgcgcgggcgcttgagcttgcgcagggacaggagcacggaaacggtctttatgacgctctcgggcctgacctcggacgatatcgggatctatttctgtgccaggaacgagccccagtactttgacgggagcgggcactcgctcccgggcatgttcgattactggggccagggaacgcgagtggtcgtgagctcagcatcgaccaagggc

SEQ ID NO: 58025 - RNA, 399 nt, synthetic construct
  misc_feature 1..399: note = derived and/or modified sequence opt11 from anti-HIV_Chain
  source 1..399: mol_type = other RNA
caagtacaattcttccaatccggctcctccatgaaaaaatccggcgcctccgtcaccatctcatgcgaagccaccggctacaacatcaaaaaccacatcctccactgggtccgccaaaaacccggccgcggcttcgaatgggtcggcatgatcgaccccatcaacggccgcccctggttcggccaagccttccgcggccgcctcaccctcacccgcgacctctccaccgaaaccttctacatgtccctctcaggcctcacctccgacgacaccgccacctacttctgcgcccgccgcgaagccgactaccacgacggcaacggccacaccctccccggcatgttcgacttctggggccccggcaccctcgtcaccgtctcctccgcctccaccaaaggc

SEQ ID NO: 58026 - RNA, 399 nt, synthetic construct
  misc_feature 1..399: note = derived and/or modified sequence opt11 from anti-HIV_Chain
  source 1..399: mol_type = other RNA
caagtgcgcttgagccagagcggggccgcggtcgtgaaaacgggcgcgagcgtgaccataagctgtgaaacggaagggtacacgttcgtgaactatataatacactgggtcaggcaatcgcccggacgcgggttcgagtggttgggcatgatcgatcccaggaacgggcacccgtggtttggccagcgcctgcgcgggcgcctgagcttgcgaagggataggagcacggaaacggtctttatgacgctctcgggcttgacctcggacgataccgcgatctatttctgtgccaggaacgagccccagtactatgacgggagcgggcactcgctcccgggcatgttcgattactggggccagggcacgcgcgtggtcgtgagctcggcctcgaccaagggc

SEQ ID NO: 58027 - RNA, 399 nt, synthetic construct
  misc_feature 1..399: note = derived and/or modified sequence opt11 from anti-HIV_Chain
  source 1..399: mol_type = other RNA
caagtccgcctctcccaatccggcgccgccatgaaaaaacccggcgcatccgtcaccatctcctgcgaaaccgaaggctacaccttcatcaactacatcatccactgggtccgccaaccccccggccgaggcttcgaatggctcggcatgatcgacccccgcaacggccgcccctggttcggccaatccgtccaaggccgcctctccctccgccgagacacatacaccgaagtcgtctacatgaccctctccggcctcacctcagacgacgccggcctctacttctgcgcccgcaacgaaccccaataccacgacggcaacggccactccctccccggcatgttcgactactggggccaaggcaccctcgtcgccgtctcctccgcctccaccaaaggc

SEQ ID NO: 58028 - RNA, 399 nt, synthetic construct
  misc_feature 1..399: note = derived and/or modified sequence opt11 from anti-HIV_Chain
  source 1..399: mol_type = other RNA
caggtcaggctcgtgcaatcgggcgcgcaattgaaaaagcccggggcctcggtcacggtctcgtgcgaggcctcgggctataactttgtcaattacataatcaattgggtgcgccagaccccgggcaggggctttgaatgggtcgggatgatagacccgcgcaggggcaggccctggagcgcgcaaaagttccagggccggctcacgctaacgcgcgatatcgatagcgagaaattgtacatgcacttgagcgggctcaggggcgatgacacggccgtgtactattgcgcgcgacaggactcggactttcacgatggccatggccataccttgcgagggatgtttgactcgtgggggcaagggagcccggtcacggtctcgagcgcgagcacgaaaggg

SEQ ID NO: 58029 - RNA, 399 nt, synthetic construct
  misc_feature 1..399: note = derived and/or modified sequence opt11 from anti-HIV_Chain
  source 1..399: mol_type = other RNA
caagtccacaccttccaatccggctcctccatgaaaaaatccggcgcctccgtcaccatctcctgcgaagccaccggctacaacatcaaaaactacatcctccactgggtccgccaaaaacccggccgcggcttcgaatgggtcggcatgatcgaccccatcaacggccgcccctggttcggccaacccttcagaggccgcctcaccctcacccgcgacctctccaccgaaaccttctacatgtccctctccggcctcacctcagacgacaccgccacctacttctgcgcccgacgcgaagccgactaccacgacggcaacggccacaccctccccggcatgttcgacttctggggccccggcaccctcatcaccgtctcctcagcctccaccaaaggc

SEQ ID NO: 58030 - RNA, 399 nt, synthetic construct
  misc_feature 1..399: note = derived and/or modified sequence opt11 from anti-HIV_Chain
  source 1..399: mol_type = other RNA
caagtccgcctcttccaatccggcgccgccatgaaaaaacccggcgcctccgtcacaatctcctgcgaagcctccggctacaacttcatgaactacttcgtccactgggtccgccaacgccccggccgcggcttcgaatggctcggcatgatcaacccccgcggcggccgcccctggtccgcccaatccgtccaaggccgcctcaccctcacccgcgacatctccaccgaaatgttctacatgcgcctcgacggcctccgctcagacgacaccgccacctacttctgcgcccgcaacgaagccgactaccacgacggcaacggccactccctccgaggcatgttcgactactggggccaaggctccctcatcaccgtctcctccgcctcaaccaaaggc

SEQ ID NO: 58031 - RNA, 399 nt, synthetic construct
  misc_feature 1..399: note = derived and/or modified sequence opt11 from anti-HIV_Chain
  source 1..399: mol_type = other RNA
caagtccaactcttccaatccggcgccgccatgcgcaaacccggcgcctccgtcaccatctcctgcgaagcctccggctacaacttcatgaactacttcgtacactgggtccgccaacgccccggccgcggcttcgaatggctcggcatgatcaacccccgcggcggccgcccatggtccgcccaatccgtccaaggccgcctcaccctcacccgagacacctcaaccgaaatgttctacatgcgcctcgacggcctccgctccgacgacaccgccacctacttctgcgcccgcaacgaagccgactaccacgacggcaacggacactccctccgcggcatgttcgactactggggccaaggctccctcatcaccgtctcctccgcctccaccaaaggc

SEQ ID NO: 58032 - RNA, 399 nt, synthetic construct
  misc_feature 1..399: note = derived and/or modified sequence opt11 from anti-HIV_Chain
  source 1..399: mol_type = other RNA
caagtgcgcttgagccagagcggggcagcgatcaagaaaccgggcgcgagcgtgaccataagctgtgaaacggaagggtacacgttcataaactatatcatacactgggtcaggcaaccgcccgggcgcgggttcgagtggctgggcatgatcgatcccaggaacgggcgcccgtggttcggccagagcgtgcaagggcgcttgagcttgcgcagggacacgtacacggaagtagtctatatgacgctctcgggcttgacctcggacgataccgggctctatttctgtgccaggaacgagccacagtaccatgacgggaacgggcactcgctcccgggcatgttcgacagctggggccagggcacgctcgtggccgtgagctcggcatcgaccaaggga

SEQ ID NO: 58033 - RNA, 399 nt, synthetic construct
  misc_feature 1..399: note = derived and/or modified sequence opt11 from anti-HIV_Chain
  source 1..399: mol_type = other RNA
caagtccgactattccaaagcggagccgccatgagaaaaccaggcgccagcgtaaccatcagctgcgaagcaagcggatacaacttcctaaactacttcgtacactgggtcagacaacgccccggacgcggattcgaatggctaggcatgatcaacccccgaggcggacgaccctggtcagcccaaagcgtacaaggccgcctaaccctaacccgcgacaccagcacagaaatgttctacatgagactcgacggcctacgctcagacgacaccgcaacctacttctgcgccagaaacgaagccgactaccacgacggaaacggacactcactcagaggcatgttcgactactggggccaaggctccctcataaccgtcagctcagcctcaaccaaaggc

SEQ ID NO: 58034 - RNA, 399 nt, synthetic construct
  misc_feature 1..399: note = derived and/or modified sequence opt11 from anti-HIV_Chain
  source 1..399: mol_type = other RNA
caagtgcgcctgagccagagcggggccgcggtcaagaaaccgggcgcgagcgtgaccatagtctgtgaaacggaagggtacaatttcatagactatatcatacactgggtcaggcaaccgcccgggcgcgggttcgagtggttgggcatgatcgatcccaggaacgggcgcccgtggtcgggccagaaagtacacggacgcttgagcctgtggagggacacgagcacggaaaaggtctatatgacgctcacgggcttgacctcggacgataccgggctctatttctgtggcaggaacgagccccagtaccatgacgataacgggcactcactcccgggcatgatcgattactggggccagggcacgatggtgaccgtgagctcggcctcgaccaagggc

SEQ ID NO: 58035 - RNA, 399 nt, synthetic construct
  misc_feature 1..399: note = derived and/or modified sequence opt11 from anti-HIV_Chain
  source 1..399: mol_type = other RNA
caagtacgcctgagccagagcggggccgcgatcaagaaaccgggcgcgagcgtgaccataagctgcgaaacggaagggtacacattcataaactatatcatacactgggtcaggcaaccgcccgggcgcggattcgagtggctgggcatgatcgatcccaggaacgggcgcccgtggttcggccagagcgtgcaagggcgcctgagcttgcgcagagacacgtacacggaagtggtctacatgacgctctcgggcctgacctcggacgatgccggacactacttctgcgccagaaacgagccccagtaccacgacgggaacgggcactcgctcccgggcatgttcgactactggggccagggcacgctcgtggccgtaagctcggcctcaaccaagggc

SEQ ID NO: 58036 - RNA, 399 nt, synthetic construct
  misc_feature 1..399: note = derived and/or modified sequence opt11 from anti-HIV_Chain
  source 1..399: mol_type = other RNA
caagtccgcctcttccaatccggcgccgccatgcgcaaacccggcgcctccgtcaccatctcatgcgaagcctccggatacaacttcatgaactacttcgtccactgggtacgccaacgacccggccgcggcttcgaatggctcggcatgatcaacccccgcggcggccgcccatggtcagcccaatcagtccaaggccgcctcaccctcacccgcgacacctccaccgaaatgttctacatgcgcctcgacggcctccgctctgacgacaccgccacctacttctgcgcacgcaacgaagccgactaccacgacggcaacggccactccctccgcggcatgttcgactactggggccaaggctccctcatcacagtctcctccgcctcaacaaaaggc

SEQ ID NO: 58037 - RNA, 399 nt, synthetic construct
  misc_feature 1..399: note = derived and/or modified sequence opt11 from anti-HIV_LightChain
  source 1..399: mol_type = other RNA
atgaaactccccgtccgcctcctcgtccttatgttctggatccccgcctcctcctccgacatcgtcatgacacaatcccccctctccctccccgtcacacccggcgaacccgcctccatctcctgccgctcatcccaacgcctcctctcctcctacggccacacctacctccactggtacctccaaaaacccggccaatccccccaactactcatctacgaagtctccaaccgcttctccggcgtccccgaccgcttctccggctccggctccggcaccgacttcaccctcaaaatctcccgcgtcgaagccgaagacgtcggcgtctactactgctcccaatccacccacgtccccctaaccttcggccaaggcaccaaagtcgaaatcaaacgcaaa

SEQ ID NO: 58038 - RNA, 402 nt, synthetic construct
  misc_feature 1..402: note = derived and/or modified sequence opt11 from anti-HIV_Chain
  source 1..402: mol_type = other RNA
cagccctatatcgtgcaatcgggcccggccgtaaaaggggccgggagctcggtcacggtcacgtgcaaggtcgatggcgatgacgatggaatattctcgttcgggacctatttcatggtatgggtcaggcaagcgcccgggcaagggctccagtacatgggcgggctcgtgccctcgtacgcgcccacgtacgcgcacaagttcgagggcaggatcacgatctcggccgcgggcacgcccccggtcgtgagcttgaccttgctcaatctcacgaacgacgacgcggccacgtacttttgcgcgcgcgagcgcgggcgccattacgatagcaagaccagggaaaatcgcaggggcaggtactttgacatgtgggggcgcgggaccaggatcacggtctcgccc

SEQ ID NO: 58039 - RNA, 402 nt, synthetic construct
  misc_feature 1..402: note = derived and/or modified sequence opt11 from anti-HIV_Chain
  source 1..402: mol_type = other RNA
cagccctatatcgtgcaatcgggcccggccgtgaaaggggccgggagctcggtcacggtaacgtgcagggtcgatggcgatgacgatggcatattcaatttcgggacctatttcatggtctgggtcaggcaagcgcccgggcaagggctccagtacatgggcgggctcgtgccatcgtacgcgccaacgtacgcgcacaagttcgagggcaggatcacgatctcggccgcgggcacgcccccggtcgtgagcttgaccctgatcaacctcacgaacgcggacgcggccacgtacttttgcgcgcgagagcgcgggcgccattacgatagcaagaccagggaaaatcgcagaggcaggtactttgacatgtgggggcgcgggaccaggatcacggtctcgccc

SEQ ID NO: 58040 - RNA, 402 nt, synthetic construct
  misc_feature 1..402: note = derived and/or modified sequence opt11 from anti-HIV_Chain
  source 1..402: mol_type = other RNA
cgcgtccactcccaagtccaactcgtcgaatccggccccggcctcgtcaaaccatcccaaaccctctccctaacctgcaccgtctcaggcggctccatctccaacggcggccactactggaactggatccgacaacaccccggcaaaggcctcgaatggatcggccacatctacaacatcgcaaccacctactacaacccctccctcaaatcccgcgtctccatctccgtcgacacctccaaaaaccaattctccctcaaactctcctccgtcaccgccgccgacaccgccgtctactactgcgcccgcggctccggccgctggaccatcggcgcccgcatctacttcgacaactggggccaaggcgccctcgtcgccgtctcctccgcctccaccaaaggc

SEQ ID NO: 58041 - RNA, 402 nt, synthetic construct
  misc_feature 1..402: note = derived and/or modified sequence opt11 from anti-HIV_Chain
  source 1..402: mol_type = other RNA
agcgtggacgagcgattgctcgagttcgggggcaggctcgtgcaaccgggcgggagcttgcgcttgagctgtagcgcgagcgggttcacgttctcgaactcggccatgagctgggtcaggcaagcgcccgggaaagggctcgagtgggtgagctcgatcttgagctcgggagtgggcacgttctatgccgatagcgtgaaagggcgctttaccgtgagcagggacaatagcaggaacacactctatctccagatgaagtcgttgcgcgcggaagataccgcgctatattactgtgccaaggtccagatccagcaattgaactttggagtgatcacggacgcgggcctggacgtgtgggggaaagggaccacgctcatagtcagcagcgcgagcacaaaaggg

SEQ ID NO: 58042 - RNA, 402 nt, synthetic construct
  misc_feature 1..402: note = derived and/or modified sequence opt11 from anti-HIV_Chain
  source 1..402: mol_type = other RNA
gtgcaatcgcaagtgtacttggtccagagcgggggcgaggtcaagaaaccgggctcaagcgtgaaagtgagctgtaaagcgagcggggactcgttctcgagctcagtcataacctgggtcaggcaagcgcccgggcaagggcccgagtggatgggcaggatcataccagtgctcggggtcgcggcctatgcccagaacttttacgggcgcgtgaccataagcgcggacacgagctcaaacacggcctatatggagctcagctcattgcgctttgaagataccgcggtattttactgtgccagggaaacgggtaggggcgggaacttggccttgcgacagtactttttcgatagctggggccagggcacgctcgtgaccgtgagctcgccctcgaccaagggc

SEQ ID NO: 58043 - RNA, 402 nt, synthetic construct
  misc_feature 1..402: note = derived and/or modified sequence opt11 from anti-HIV_Chain
  source 1..402: mol_type = other RNA
caactccaactccaagaatccggccccggcctcgtcaaaccctccgaaaccctatccctaacctgctccgtctccgacggctccatcaactccaactcctactactgggcctggatccgccaatcccccggcaaaggcctcgaatggatcggctccgtctactacttcggtggcacatactactccccctccctcaaatcccgcgtcaccatgtccgtcgaccgctccaaaaaccaattctccctcaacgtctcatccgtcaccgccgccgacaccgccatctactactgcgcccgccacgtccgcccctacgaccgctcaggctaccccgaacgccccaactggttcgacccctggggccgcggcaccctcgtcaccgtctcctccgcctccaccaaaggc

SEQ ID NO: 58044 - RNA, 402 nt, synthetic construct
  misc_feature 1..402: note = derived and/or modified sequence opt11 from anti-HIV_Chain
  source 1..402: mol_type = other RNA
caagtccaactccaccaatggggcgccggcctcctcaaaccctccgacaccctctccctcacctgcggcatcctcggcgtctcaccccccggctccctcaccggctactactggacatggatccgccaaccccccggcaaaggcctagaatggatcggcgaagtctaccactccggctccaccaactacaacccctccctcgcctcccgcgtcaccatctccatgggcaccaccaaaacccaattctcccttcgcctaacctcagtcaccgccgccgactcagccgtatactactgcgcctccggcaaagtctggggcatcaccgcccgcccccgcgacgccggcctcgacgtctggggccaaggcaccaccgtcaccgtcacctccgcctccaccaaaggc

SEQ ID NO: 58045 - RNA, 402 nt, synthetic construct
  misc_feature 1..402: note = derived and/or modified sequence opt11 from anti-HIV_Chain
  source 1..402: mol_type = other RNA
caagtgcaattggtccagagcggggccgaggtcaagaaaccgggatcgagcgtgaaagtgagctgtcgcgcgagcgggggctcgttcgggaactatgccataaactgggtcaggcaagcgcccatgcaagggctcgagtggatgggcgggatcatacccatattcgggaccacgaactatgcccagaactttcgcgggcgcgtgaccataaacgcggacacgttcacgaacacggtcaatatggatctctcgagcttgcgctcggaagataccgcggtctattactgtggcagaagcataaacgcggccgtgcccgggctcgagggcgtgtactattactatggcatggccgtgtgggggcaagggaccacggtcacggtctcgagcgcgagcacgaaaggg

SEQ ID NO: 58046 - RNA, 402 nt, synthetic construct
  misc_feature 1..402: note = derived and/or modified sequence opt11 from anti-HIV_Chain
  source 1..402: mol_type = other RNA
ttcgtgcaactggtcgagagcgggggcgggctagtgcaaccgggcgggagcttgcgcttgagctgtgccgcgagcgggttcaatttcaatacatattggatgaactgggtcaggcaagcgcccgggaaagggctagagtgggtggccaatatgaaggaagatggctcggaaaagtactatgtcgatagcgtgaaagggcgctttaccataagcagggacaatgccaagaactcactctatctacagatgaatagcttgcgagcggaagataccgcagtctattactgtgccaggaacccggaatcgcgctgtatcgtgggcaggaacaggggctggtgcaggtactttgacctgtgggggcgcgggagcttggtcacggtctcgcccgcgagcacgaaaggg

SEQ ID NO: 58047 - RNA, 405 nt, synthetic construct
  misc_feature 1..405: note = derived and/or modified sequence opt11 from anti-HIV_Chain
  source 1..405: mol_type = other RNA
caactccaactcgaccaacccggcgccgccatgaaatccctcggctcctccctcaccatcacctgccgcgtctccggcgacgacctcggctccttccacttcggcacctacttcatgatctgggtccgccaaggccccggccaaggcctcgaatacatgggcggcatcctcccctccaccaaaacccccacctacgcccacaaattccgcggccgcgtctccatctccgcacccggcgtcccccccgtcctatccctcgccctcacaaacctcacctacgacgacaccgccacctacttctgcgcccgcgaacgcggccgccacttcgaacccaaaaaccgcgaccacctcgaaggcaaattcctcgacctctggggccgcggcaccttcgtccgcgtctccccc

SEQ ID NO: 58048 - RNA, 405 nt, synthetic construct
  misc_feature 1..405: note = derived and/or modified sequence opt11 from anti-HIV_Chain
  source 1..405: mol_type = other RNA
caagtccaactcgtccaacccggcacagcaatgaaatccctcggctcctccctcaccatcacctgccgcgtctccggcgacgacctcggctccttccacttcggcacctacttcatgatctgggtccgccaagcccccggccaaggcctcgaatacatgggaggcatcctcccctccaccaaaacccccacctacgcccacaaattccgcggccgcgtctccatctccgcccccggcgtcccccccgtcctctccctcgcactcaccaacctcacctacgacgacaccgccacctacttctgcgcccgcgaacgcggccgccacttcgaacccaaaaaccgagacaacctcgaaggcaaattcttcgacctctggggccgcggcaccttcgtccgcgtctccccc

SEQ ID NO: 58049 - RNA, 405 nt, synthetic construct
  misc_feature 1..405: note = derived and/or modified sequence opt11 from anti-HIV_Chain
  source 1..405: mol_type = other RNA
caagtccaactcgtccaacccggcaccgccatgaaaacactcggctcctccctcaccatctcctgccgcgtctccggcgacgacggcaacttccacttcggcacctacttcatggcctgggtccgacaagtccccggccaaggcctcgaatacatgggcggcatcctcccctccaccaaatcccccacctacgcccacaaattccgaggccgcgtctccatctccaccgccggcgtcccccccgtcgtctccctcgccctcaccaacctaacctacgacgacaccgccacctacttctgcgcccgcgaacgcggccgccactacgactccaaaaaacaagaaaactaccgcggcaaattcttcgacctctggggccgcggcacctgggtccgcgtctcccccacc

SEQ ID NO: 58050 - RNA, 405 nt, synthetic construct
  misc_feature 1..405: note = derived and/or modified sequence opt11 from anti-HIV_Chain
  source 1..405: mol_type = other RNA
cacctcgtccaatccggcaccgaagtcaaaaaacccggctcatccgtcaccgtctcctgcaaagcctacggcgtcaacaccttcggcctctacgccgtcaactgggtccgccaagcccccggccaatccctcgaatacatcggccaaatctggcgctggaaatcctcagcctcccaccacttccgcggccgcgtcctcatctccgccgtcgacctcaccggctcctccccccccatctcctccctcgaaatcaaaaacctcacctccgacgacaccgccgtctacttctgcaccaccacctccacctacgaccaatggtccggcctccaccacgacggcgtcatggccttctcctcctggggccaaggcaccctaatctccgtctccgccgcctccaccaaaggc

SEQ ID NO: 58051 - RNA, 405 nt, synthetic construct
  misc_feature 1..405: note = derived and/or modified sequence opt11 from anti-HIV_Chain
  source 1..405: mol_type = other RNA
caggtccagctcgtgcaatcgggcgcggaagtgaaaaagcccgggagctcggtcaaggtctcgtgcaaggcctcgggcgggacctttagcacgtacgcgttctcgtgggtgcgccaggccccgatcgagggcttggaatggatgggcgggataatcccgatctttggcacggaaaattacgcgcaaaagttccagggcagggtcacgatcacggccgataaatcgacctcgaccgcgtacatggaattgagctctctcagaagcgaggacacggccgtatactattgcgcgcgcgatcgctcgagcgcgatcgggtactgtagctcgatctcgtgctataaagggagctttgacatatgggggcaagggacaatggtcacagtctcaagcgcgagcacgaaaggg

SEQ ID NO: 58052 - RNA, 405 nt, synthetic construct
  misc_feature 1..405: note = derived and/or modified sequence opt11 from anti-HIV_Chain
  source 1..405: mol_type = other RNA
caagtgcaactggtccagagcggggcagaagtcaagaaaccgggctcgagcgtgaaagtgagctgcaaagcgagcgggggcacgttctcgacctatgccttcagctgggtcaggcaagcgcccgggcaagggctcgagtggatgggcgggatcataccaatattcgggaccgagaactatgcccagaaatttcaagggcgcgtgaccataaccgcagacaagagcacgagcacggcctatatggagctctcgagcctgcgctcggaagacaccgcagtctattactgtgccagagacaggagctcggccataggctattgctcgagcataagctgttacaaaggctcgttcgatatctggggccagggcacgatggtgaccgtgagctcggcctcgaccaagggc

SEQ ID NO: 58053 - RNA, 405 nt, synthetic construct
  misc_feature 1..405: note = derived and/or modified sequence opt11 from anti-HIV_Chain
  source 1..405: mol_type = other RNA
gaagtccaactcgtcgaatccggcggcggcctcgtccaacccggcggctccctccgcctctcctgcgccgcctccggcttcaccttctcctcctactccatgaactgggtccgccaagcccccggcaaaggcctcgaatgggtctcctacatctccggctcctcctacaccatctactacgccgactccgtccgcggccgcttcaccatctcccgcgacaacgccaaaaactccctctacctccaaatgaactccctccgcgacgaagacaccgccgtctacttctgcgcccgagccaccccccccaaccccctcaacctctacaactacgactcctccggctcctccttcgactactggggccaaggcaccctagtcaccgtctcctccgcctcaaccaaaggc

SEQ ID NO: 58054 - RNA, 405 nt, synthetic construct
  misc_feature 1..405: note = derived and/or modified sequence opt11 from anti-HIV_Chain
  source 1..405: mol_type = other RNA
gaggtccagctcgtgcaatcgggcgcggaagtgaaaaagcccgggagctcggtcaaggtctcgtgcaaggcctcgggcgggacctttagcacgtacgcgttctcgtgggtgcgccaggccccgggccagggcttggaatggatgggcgggataatcccgatctttggcacagaaaattacgcgcaaaagttccagggcagggtcacgatcacggccgataaatcgacctcgaccgcgtacatggaactgagctcgctcaggagcgaggacacggccgtgtactattgcgcgcgcgatcgctcgagcgcgatcgggtactgtagctcgatctcatgctataaagggagctttgacatatgggggcaagggaccatggtcacggtctcgagcgcgagcacgaaaggg

SEQ ID NO: 58055 - RNA, 405 nt, synthetic construct
  misc_feature 1..405: note = derived and/or modified sequence opt11 from anti-HIV_Chain
  source 1..405: mol_type = other RNA
gaggtccagctcgtggaatcgggcgcggaagtgaaaaagcccgggagctcggtcaaggtctcgtgcaaggcctcgggcgggacctttagcacgtacgcgttctcgtgggtgcgccaggccccgggccagggcttggaatggatgggcgggataatcccgatctttggcacggaaaattacgcgcaaaagttccagggcagggtcacgatcacggccgataaatcgacctcgaccgcgtacatggaattgagctcgctcaggagcgaggacacggccgtgtactactgcgcgcgcgatcgctcgagcgcgatcggatactgtagctcgatctcgtgctataaagggagctttgacatatgggggcaagggaccatggtcacggtctcgagcgcgagcacgaaaggg

SEQ ID NO: 58056 - RNA, 405 nt, synthetic construct
  misc_feature 1..405: note = derived and/or modified sequence opt11 from anti-HIV_Chain
  source 1..405: mol_type = other RNA
cccttggtccagctcgagccctcgggcgtggaagtgaaaaagcgcggggcctcggtcaaggtctcgtgcaaggtctcgggctatagcttgaccgagctctcgatgcattgggtgcgccaggccccgggcaagggcctggaatggatggggagctttgacccgctcgatggcgataccatatacgcgcaaaagttccagggcagggtcacgatgacggtcgatacctcgaccgataccgcgtacatggacttgagctcgctcaggttcgaggacacggccgtgtactattgcgcgaccccgagcaaggcctattactatgactcgcccaattacgagggcgatttctatatggatgtctggggcaagggcacgaccgtgatcgtgagctcggcctcgaccaagggc

SEQ ID NO: 58057 - RNA, 408 nt, synthetic construct
  misc_feature 1..408: note = derived and/or modified sequence opt11 from anti-HIV_HeavyChain
  source 1..408: mol_type = other RNA
cagatccatctcgtgcaatcgggcacggaagtgaaaaagcccgggagctcggtcacggtctcgtgcaaggcctatggcgtaaacacgttcgggctctatgccgtgaactgggtcaggcaagcgcccgggcaatcgctcgagtacattggccagatctggcgatggaaatcgagcgcgagccatcactttcgcgggcgcgtgctcataagcgcggtcgatctcacgggctcgagcccgcccataagctcgctcgagatcaagctcacgagcgatgacacagccgtgtacttttgcacgaccacgagcacgtacgataaatggagcgggctccatcacgatggcgtgatggcgttctcgagcaggggccagggcacgctcataagcgtgagcgcggcctcgaccaagggc

SEQ ID NO: 58058 - RNA, 408 nt, synthetic construct
  misc_feature 1..408: note = derived and/or modified sequence opt11 from anti-HIV_HeavyChain
  source 1..408: mol_type = other RNA
cagatccatctcgtgcaatcgggcacggaagtgaaaaagccagggagctcggtcacggtctcgtgcaaggcctatggcgtgaacacgttcgggctctatgccgtgaactgggtcaggcaagcgcccgggcaagggctcgagtacataggccagatctggcgctggaaatcgagcgcgagccatcactttagagggcgcgtgctcataagcgcggtcgatctcacgggctcgagcccgcccataagctcgctcgagatcaaggtcacgagcgatgacacggccgtgtacttttgcacgaccacgagcacgtacgatgaatggagcgatctccatcacgatggcgtgatggcgttctcgagctggggccagggcacgctcataagcgtgagcgcggcctcgaccaagggc

SEQ ID NO: 58059 - RNA, 408 nt, synthetic construct
  misc_feature 1..408: note = derived and/or modified sequence opt11 from anti-HIV_HeavyChain
  source 1..408: mol_type = other RNA
cagatccatctcgtgcaatcgggcacggaagtgaaaaagcccgggagctcggtcacggtctcgtgcaaggcctatggcgtgaacacgttcgggctctatgccgtgaactgggtcaggcaagcgcccgggcaatcgctcgagtacataggccagatctggcgctggaaatcgagcgcgagccatcactttcgcgggcgcgtgctcataagcgcggtcgatctcacgggatcgagcccgcccataagctcgctcgagatcaagctcacgagcgatgacacggccgtgtacttttgcacgaccacgagcacgtacgatcgctggagcgggctccatcacgatggcgtgatggcgttctcgagctggggccagggcacgctaataagcgtgagcgcggcctcgaccaagggc

SEQ ID NO: 58060 - RNA, 408 nt, synthetic construct
  misc_feature 1..408: note = derived and/or modified sequence opt11 from anti-HIV_Chain
  source 1..408: mol_type = other RNA
tgtaatccgagggtgcatagtgaggtgcagctggtggagagtggggcggaggtgaagaagccgggggcgagcgtgaaggtggcgtgtaaggtgagtgggaagaagttgagtgatttgagtatacattgggtgaggcaggcgccggggaaggggctggagtggatgggggggtttgatgaggaggatgggaagataagctatgagaggaagtttcaggggagggtgagtatgacggaggatacggcgagggatacggcgtttatggagatgagcagcttgaggagtgatgatacggcggtatatttttgtgcggcggcaccgaggctggatttgggggagttgagcagtgggtttcatttttgggggttggggacgttggtgacggtgagtagtgcgagtacgaagggg

SEQ ID NO: 58061 - RNA, 408 nt, synthetic construct
  misc_feature 1..408: note = derived and/or modified sequence opt11 from anti-HIV_Chain
  source 1..408: mol_type = other RNA
atctgggccccactcatcgccgtcaccttcctagtcctccactgcgaatccctcggaacctgctgctgctgccaagcctccggcggcaccttcaacaccttcgccatcaactgggtccgccaagcccccggccaaggcctagaatgggtcggcggcataatccccgtcttcggcaccgcctcctacgcccaaaaattccaaggccgcgtcaccgtcaccaccgacgaatcacgcggcaccgcctacatggaactaaactcactccgctccgaagacaccgccgtctactactgcgcccgcggccaaaccgacctcaacgacgacctctggtccgactactccacccccggcttcgactactggggccaaggcaccctcgtcaccgtctcctccgcctccaccaaaggc

SEQ ID NO: 58062 - RNA, 408 nt, synthetic construct
  misc_feature 1..408: note = derived and/or modified sequence opt11 from anti-HIV_Chain
  source 1..408: mol_type = other RNA
ctgcagccgagggtgcatagtgaggtgcagttggtggagagtggggcggaggtgaagaagccgggggcgagtgtgaaggtgagttgtaaggtgagtgggtatacgttgagtgatttgagtatgcattgggtgaggcaggcgccggggaaggggttggagtggatgggggggtttgatgaggaggatggggagataacgtatgcgcagaagtttcaggggagggtgagtatgacggaggatacgagtagggatacggcgtatatggagttgagtagtttgaggagtgaggatacggcggtgtattattgtgcgacggcgccgaggctggagctgggggagttgagtagtgggtttcattattgggggttggggacgttggtgacggtgagtagtgcgagtacgaagggg

SEQ ID NO: 58063 - RNA, 408 nt, synthetic construct
  misc_feature 1..408: note = derived and/or modified sequence opt11 from anti-HIV_Chain
  source 1..408: mol_type = other RNA
cagagccaggtccatctagtgcaatcgggcgcggaagtgaaaaagcccgggagctcggtcaaggtctcgtgccaggcctcgggcgggacctttaacacgttcgcgatcaattgggtgcgccaggccccgggacagggcctggaatgggtcgggggcataatcccggtctttggcacggcctcgtacgcgcaaaagttccagggcagggtcacggtcacgaccgatgaatcgcgcgggaccgcgtacatggaattgaactcgctcaggagcgaggacacggccgtgtactattgcgcgcgcgggcaaacggacttgaacgatgacttgtggtcggactatagcacgcccgggttcgattactggggacagggcacgctcgtgaccgtgagctcggcctcgaccaagggc

SEQ ID NO: 58064 - RNA, 408 nt, synthetic construct
  misc_feature 1..408: note = derived and/or modified sequence opt11 from anti-HIV_Chain
  source 1..408: mol_type = other RNA
ggctccgaagtccaactcgtcgaatccggcgccgaagtcaaaaaacgaggcgcctccgtcaaagtctcctgcaaagtctccggctactccctcaccgaactctccatgcactgggtccgccaagcccccggcaaaggcctcgaatggatgggctccttcgaccccctcgacggcgacaccatctacgcccaaaaattccaaggccgcgtcaccatgaccgtcgacacctccaccgacaccgcctacatggacctctcctccctccgcttcgaagacaccgccgtctactactgcgccaccccctccaaagcctactactacgactcccccaactacgaaggcgacttctacatggacgtctggggaaaaggcaccaccgtcatcgtctcctccgcctccaccaaaggc

SEQ ID NO: 58065 - RNA, 408 nt, synthetic construct
  misc_feature 1..408: note = derived and/or modified sequence opt11 from anti-HIV_Chain
  source 1..408: mol_type = other RNA
caagtgcaattggtacagagcgggggcgaggtcaagaaaccgggcgcgagcgtgaaagtgagctgtaaagtgagcgggtactcgctcacggaattgagcatgcactgggtcagacaagcgcccgggaaagggctcgagtggatgggcgtgttcgatcccttggaaggggacggggtctatgtccagaaatttcgcgggagagtgatcatgaccgaggacacgagcacggacacggcctatatggagctcacgagcttgcgatcggaagataccgcgatctattactgtgccacgaaagcgaaagattactattacgagagctcggactatagcccgtactattactattacatggacgtgtgggggaaagggaccacggtcacggtctcgagcgcgagcacgaaaggg

SEQ ID NO: 58066 - RNA, 408 nt, synthetic construct
  misc_feature 1..408: note = derived and/or modified sequence opt11 from anti-HIV_Chain
  source 1..408: mol_type = other RNA
gaagtgcaattggtacagagcggggccgaggtcaagaaaccgggcgcgagcgtgaaagtgagctgtaaagtgagcgggtacacgctcacggaattgagcatgcactgggtcaggcaagcgcccgggaaagggctcgagtggatgggcgtgttcgaccccttggaaggggacggggtctatgccgagaaatttcgcgggcgcgtgatcatgaccgaggacacgagcacggacacgggctatatggagctaacgagcttgcgctcggaagataccgcgatctattactgtgccacgaaagcgaaagattactattacgagagctcggactatagcccgtactattactattacatggacgtgtgggggaaagggaccacggtcacggtctcgagcgcgagcacgaaaggg

SEQ ID NO: 58067 - RNA, 408 nt, synthetic construct
  misc_feature 1..408: note = derived and/or modified sequence opt11 from anti-HIV_Chain
  source 1..408: mol_type = other RNA
caagtgcaattggtccagagcggggccgaggtcaagaaaccgggcgcgagcgtgaaagtgagctgtaaagcgagcgggtacacgttcacgcgatatcacatacactgggtcaggcacgcgcccgggcaagggctagagtggatgggcaagatcaatccctcgcgcgcgagcacgaaatatgcaaagaaatttcaagatcgcgtgaccatgaccagggacacgagcacgagcacggtctatatggagctatcgagcttgcgcggggacgataccgcggtctattactgtggcagggaaatgggaacgttcacgctcctgggcgtggtcatagaccattacgatttctatcccatggacgtgtgggggcaagggaccccggtcacggtctcgagcgcgagcacgaaaggg

SEQ ID NO: 58068 - RNA, 408 nt, synthetic construct
  misc_feature 1..408: note = derived and/or modified sequence opt11 from anti-HIV_Chain
  source 1..408: mol_type = other RNA
tcccgccccccctcctgcctcctcggctgctggtgctgctccggcttcctactccccgccgtcatcctccccaacctccactccccctgcctctccctcctcgaatcccaacccccctcactcgccgacctcgtctccgccttcgccgtcatggacatccccatctacatcggcacctaccgatcccaagcctccctccactcctcctccaccaaattccccaccgacttcctcggctcccaaaccggctccgtcgccgtcggccaaggccaaatctcccacctccgctccgtcgaatggcgcctccgcatgtgggaattcatcaccgccctaaaagtccacatgttcctctcccgctccgaccgcggcccccgctggaaaaacgtctcctccctcctcaactcccgc

SEQ ID NO: 58069 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagcccccggccaatccctcgaatacatcggccaaatctggcgctggaaatcctccgcctcccaccacttccgcggccgcgtcatcatctccgccgtcgacctcaccggctcctccccccccatctcacccctcgaaatcaaaaacctcacatccgacgacaccgccgtctacttctgcacaaccacctccacctccgaccgatggtccggcctccaccacgacggcgtcatggccttctcatcctggggccaaggcaccctaatctccgtctctgccgcctccaccaaaggc

SEQ ID NO: 58070 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagcccccggccaatccctcgaatacatcggccaaatctggcgctggaaatcctccgcctcccaccacttccgcggccgcgtcatcatctccgccgtcgacctcaccggctcatccccccccatctcctccctcgaaatcaaaaacctcacctcagacgacaccgccgtctacttctgcaccaccgcctctacctacgacaaatggtccggcctacaccacgacggcgtcatggccttctcctcctggggccaaggcaccctcatctccgtctccgccgcctcaaccaaaggc

SEQ ID NO: 58071 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagcacccggccaatccctcgaatacatcggacaaatatggcgctggaaatcctccgcctcccaccacttccgcggccgcgtcctcatctcagccgtcgacctcaccggcccctccccccccatctcctccctcgaaatcaaaaacctcacctccgacgacaccgccgtctacttctgcaccacaacctccacctacgacaaatggtccggcctccaccacgacggcgtcatggccttctcctcctggggccaaggcaccctcatctcagtctccgcagcctccaccaaaggc

SEQ ID NO: 58072 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggatcctccgtcgccgtctcctgcaaagcctacggcgtcaacaccttcggcctctacgccgtcaactgggtccgccaagcccccggccaatccctagaatacatcggccaaatctggcgctggaaatcctccgcctcccacgacttccgcggccgcgtcatcatctccgcagtcgacctaaccggctcctcaccccccatctcctccctcgaaatcaaaaacctcacctccgacgacaccgccgtctacttctgcaccgccacctccacccccgactactggtccggcctacaccacgacggcgtcatggccttctcctcctggggccaaggcaccctaatctccgtctccgccgcctccaccaaaggc

SEQ ID NO: 58073 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatcaggcaccggcgtcaaaaaacccggctcctccgtcaccgtctcctgcaaggcctacggcgtcaacaccttcggcctatacgccgtcaactgggtccgccaagcccccggccaaggcctcgaatacatcggccaaatctggcgctggaaatcctccgcctcccaccacttccgcggccgcgtcctcatctccgccgtcgacctcaccggctcctccccccccatcacctccctcgaaatcaaaaacgtcacctcagacgacaccgccgtctacttctgcaccaccacctccacctacgacaaatggtccggcctctaccacgacggcgtcatggccttctcctcctggggccaaggcaccctcatctcagtatccgccgcctccaccaaaggc

SEQ ID NO: 58074 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagccccaggccaatccctcgaatacatcggccaaatctggcgctggaaatcctccgcctcccaccacttccgcggccgcgtcatcatctccgccgtcgacctcaccggctcctccccccccatctcctccctcgaaatcaaaaacctcacctccgacgacaccgccgtctacttctgcaccaccacctccacctccgactactggtccggactccaccacgacggcgtcatggccttctcctcctggggccaaggcaccctcatctccgtctccgccgcctccaccaaaggc

SEQ ID NO: 58075 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtaaccgtctcctgcaaagcatacggcgtcaacaccttcggcctctacgccgtaaactgggtccgccaagcccccggccaatccctagaatacatcggccaaatctggcgctggaaatcctccgcctctcaccacttccgcggccgcgtcctcatctccgccgtcgacctcaccggctcctccccccccatctcctccctcgaaatcaaaaacctcacctccgacgacaccgccgtctacttctgcaccaccacctccacctacgaccgctggtccggcctacaccacgacggcgtcatggccttctcatcctggggccaaggcaccctcatctccgtctccgccgcctccaccaaaggc

SEQ ID NO: 58076 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggaaccgaagtccgaaaacccggctcatcagtcaccgtctcctgcaaagcctacggcgtcaacaccttcggcctctacgccgtcaactgggtccgccaagcccccggccaatccctcgaatacatcggccaaatctggcgctggaaatcctccgcctcccaccacttccgcggacgcgtcctcatctccgccgtcgacctcaccggctcctccccccccatctcctccctcgaaatcaaaaacctcacctccgacgacaccgccgtctacttctgcaccaccacatccacctacgacaaatggtccggcctccaccacgacggcgtcatggccttctcctcctggggccaaggcaccctaatctccgtctccgccgcctccaccaaaggc

SEQ ID NO: 58077 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagcccccggccaatccctcgaatacatcggccaaatctggcgatggaaatcctccgcatcccaccacttccgcggccgcgtcctcatctccgccgtcgacctcaccggctcctccccccccatctcctcccttgaaatcaaaaacctcacctccgacgacaccgccgtctacttctgcaccaccacctccacctacgaccaatggtccggcctccaccacgacggcgtcatggccttctcctcctggggccaaggcaccctcatctccgtctccgccgcctccacaaaaggc

SEQ ID NO: 58078 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtaaccgtctcctgcaaagcctacggcgtcaacaccttcggactctacgccgtctcctgggtccgccaagcccccggccaacgcctcgaatacatcggccaaatccgccgatggaaatcctccgcctcccaccacttccgcggacgcgtcaccgtctccgccgtcgaccccaccggctcctccccccccatctcctccctcgaaatccgcgacctcaccaccgacgacaccgccgtctacttctgcaccaccacctccacctcagactactggtccggcctccacaacgaacgcggcaccgccttctcctcctggggccaaggcaccctcatctccgtctccgccgcctccaccaaaggc

SEQ ID NO: 58079 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatcaggcaccgaagtcaaaaaacccggctcctccgtcaccgtctcctgcaaagcctacggcgtcaacaccttcggcctctacgccgtcaactgggtccgccaagcccccggccaaggcctcgaatacatcggccaaatctggcgctggaaatcctccgcctcccaccacttccgcggccgcgtcctaatctccgccatcgacctcaccggctcctccccccccatctcctccctcgaaatcaaaaacgtcacctccgacgacaccgccgtctacttctgcaccaccatgtccacctacgacaaatggtccggcctccaccacgacggcgtcatggccttctcctcctggggccaaggcaccctaatctccgtctccgccgcctccaccaaaggc

SEQ ID NO: 58080 - RNA, 411 nt, synthetic construct
  misc_feature 1..411: note = derived and/or modified sequence opt11 from anti-HIV_HeavyChain
  source 1..411: mol_type = other RNA
caaatccacctcgtccaatccggcaccgaagtcaaaaaacccggctcctccgtcaccgtctcctgcaaagcctacgaagtcaacaccttcggcctctacgccgtcaactgggtccgccaagcccccggccaatccctcgaatacatcggccaaatctggcgctggaaatcatccgcctcccaccacttccgaggccgcgtcctcatctccgccgtcgacctcaccggctcctccccccccatctcctccctagaaatcaaaaacgtcacctcagacgacaccgccgtctacttctgcaccaccacctccacccacgacaaatggtccggcctccaccacgacggcgtcatggccttctcctcctggggccaaggcaccctcatctccgtctccgccgcctccaccaaaggc

SEQ ID NO: 58081 - RNA, 411 nt, synthetic construct
  misc_feature 1..411: note = derived and/or modified sequence opt11 from anti-HIV_HeavyChain
  source 1..411: mol_type = other RNA
cagatccatctcgtgcaatcgggcacggaagtgaaaaagcccgggagctcggtcacagtctcgtgcaaggcctatggcgtgaacacgttcgggctctatgccgtgaactgggtcaggcaagcgcccgggcaagggctcgagtacataggccagatctggcgctggaaatcgagcgcgagccatcactttcgcgggcgcgtgctcataagcgcggtcgatctcacgggctcgagcccgcccataagctcgctcgagatcaagaacgtgacctcggacgataccgcggtctatttctgtaccacgacctcgacctatgacaagtggtcgggcttgcaccatgacggggtcgtggcctttagctcgtgggggcaagggaccttgatctcggtctcggccgcgagcacgaaaggg

SEQ ID NO: 58082 - RNA, 411 nt, synthetic construct
  misc_feature 1..411: note = derived and/or modified sequence opt11 from anti-HIV_Chain
  source 1..411: mol_type = other RNA
caagtcaccctcgtccaatccggcgccgaagtcaaaaaacccggcgcctccgtccgcatctcctgccgagcatccggcttcaccttcgacgactactccgactactccttcatacccaccacctacctcatccactggttccgccaagcccccggccaaggcctcgaatggatggcctggatcaactccgtcaacggcggccgcaacatcgcccgccaattccaaggccgcgtcaccgtcgcccgcgaccgctccaactccatcgccttcctcgaattctccggcctccgccacgacgacaccgccgtctacttctgcgcccgcgaccgccgagacgacgaccgcgcctggctcctcgacccctggggccaaggcacccgcgtcaccgtctcctccgcctccaccaaaggc

SEQ ID NO: 58083 - RNA, 411 nt, synthetic construct
  misc_feature 1..411: note = derived and/or modified sequence opt11 from anti-HIV_Chain
  source 1..411: mol_type = other RNA
caaatccacctcgtccaatccggcaccgaagtcaaaaaacccggctcctccgtcaccgtctcctgcaaagcctacggcgtcaacaccttcggcctctacgccgtcaactgggtccgccaagcccccggccaatccctcgaatacatcggccaaatctggcgctggaaatcctccgcctcccaccacttccgcggccgcgtcctcatctccgccgtcgacctcaccggctcctccccccccatctcctccctagaaatcaaaaacctcacctccgacgacaccgccgtctacttctgcaccaccacctccacctacgacaaatggtccggcctccaccacgacggcgtcatggccttctcctcctggggccaaggcaccctcatctccgtctccgccgcctccaccaaaggc

SEQ ID NO: 58084 - RNA, 414 nt, synthetic construct
  misc_feature 1..414: note = derived and/or modified sequence opt11 from anti-HIV_Chain
  source 1..414: mol_type = other RNA
gtggtccagctcgtgcaatcgggcgcggaagtgcgcaagcccgggagctcgctaaaggtctcgtgcaagagctcgggcgggacctttagcaggttcgtggtcaattgggtgcgccaggccccgggccagggcttggaatggatgggcgggatgatcccgatctttggcatagccaagtacgcgcaaaagttccaggacagggtaacgatgacggccgatgaatcgaaaaataccgtgtacttggactttagctcgctaaggagcgatgacacggccgtgtactattgcgcgcgcgatcgcggggacacgcgcttgctagattacggggactatgaagatgaaaggtactattacgggatggatgtctggggccagggcacgaccgtgatcgtaagctcggcatcgaccaagggc

SEQ ID NO: 58085 - RNA, 414 nt, synthetic construct
  misc_feature 1..414: note = derived and/or modified sequence opt11 from anti-HIV_Chain
  source 1..414: mol_type = other RNA
caagtgcagctggtgcagagcggggcagaggtgaggaaaccggggagtagcttgaaagtgagctgtaaatcgagcgggggaacgttcagtaggtttgtggtgaactgggtgaggcaggcgccggggcaggggctagagtggatgggagggatgataccaatattcgggatagcgaaatatgcacagaaatttcaagacagggtgacaatgacggcggacgagagcaagaacacggtgtatctggatttctcgagcttgagaagtgacgatacagcggtgtattactgtgcaagggacaggggagatacaaggctattggactatggggattacgaggacgagaggtattactatggaatggacgtgtgggggcaagggacaacggtgatagtaagcagcgcgagcacgaaaggg

SEQ ID NO: 58086 - RNA, 414 nt, synthetic construct
  misc_feature 1..414: note = derived and/or modified sequence opt11 from anti-HIV_Chain
  source 1..414: mol_type = other RNA
gaggtgcagttggtggagagtggggcggaggtgaggaagccggggtcgagtctgaaggtgagttgtaagagtagcggggggacgtttagtaggtttgtggtgaattgggtgaggcaggcgccggggcaggggttggagtggatgggggggatgataccgatatttgggatagcgaagtatgcgcagaagtttcaggatagggtgacgatgacggcggatgagagtaagaatacggtgtatttggattttagtagcctgaggagtgatgatacggcggtgtattattgtgcgagggataggggggatacgaggttgttggattatggggattatgaggatgagaggtattattatgggatggatgtgtgggggcaggggacgacggtgatagtgagcagtgcgagtacgaagggg

SEQ ID NO: 58087 - RNA, 414 nt, synthetic construct
  misc_feature 1..414: note = derived and/or modified sequence opt11 from anti-HIV_Chain
  source 1..414: mol_type = other RNA
caagtgcaactggtcgagagcggggccgaggtcaggaaaccgggctcgagcctgaaagtgagctgtaaatcgagcgggggcacgttctcgcgatatgtcgtgaactgggtcaggcaagcgcccgggcaagggctcgagtggatgggcgggatcatacccatattcgggatcgcgaaatatgcccagaaatttcaagatcgagtgaccatgaccgcggacgagcccaagaacacggtctatctcgatttcaatagcttgcgctcggacgatacagcggtctattactgtgccagggacaggggcgataccaggctcttggactatggcgattacgaggacgagcgctattactacggcatggacgtgtgggggcaagggaccacggtaatagtctcgagcgcgagcacgaaaggg

SEQ ID NO: 58088 - RNA, 414 nt, synthetic construct
  misc_feature 1..414: note = derived and/or modified sequence opt11 from anti-HIV_Chain
  source 1..414: mol_type = other RNA
caagtgcaattggtccagagcggggccgaggtcaggaaaccgggctcgagcttgaaagtgagctgtaaatcgagcgggggcacgttctcgcgatatgtcgtgaactgggtcaggcaagcgcccgggcaagggctagagtggatgggcgggatgatacccatattcgggatcgcgaaatatgcccagaaatttcaagatagagtgaccatgaccgcggacgagagcaagaacacggtctatctcgatttctcgagcttgcgatcggacgatacagcggtctattactgtgccagggacaggggcgataccaggctactggactatggcgattacgaggacgagcgctattactatggcatggacgtgtgggggcaagggaccacggtcatagtctcgagcgcgagcacgaaaggg

SEQ ID NO: 58089 - RNA, 414 nt, synthetic construct
  misc_feature 1..414: note = derived and/or modified sequence opt11 from anti-HIV_Chain
  source 1..414: mol_type = other RNA
caggtgcagttggtgcagagcggggcggaggtaaggaagccggggagtagcttgaaggtgagctgtaagagtagcggggggacgttcagtagatatgtagtgaactgggtgaggcaggcgccggggcaggggctggagtggatgggggggataataccgatattcgggatagcgaagtatgcacagaagtttcaggatagggtgacgatgacggcggatgagagcaagaacacggtgtatctggatttcagtagcttgaggagtgacgatacggcggtgtattactgtgcgagggacaggggggatacgaggctactggactatggggattacgaggacgagaggtattactatgggatggacgtgtgggggcaggggacgacggtgatagtgagtagcgcgagcacgaagggg

SEQ ID NO: 58090 - RNA, 414 nt, synthetic construct
  misc_feature 1..414: note = derived and/or modified sequence opt11 from anti-HIV_Chain
  source 1..414: mol_type = other RNA
caagtgcaattggtcgagagcggggccgaggtcaggaaaccgggctcgagcctgaaagtgagctgtaaatcgagcgggggaacgttctcgcgctatgtagtgaactgggtcaggcaagcgcccgggcaagggctcgagtggatgggcgggatcatacccatattcgggatcgcgaaatatgcccagaaatttcaagatcgcgtgaccatgaccgcggacgaaagcaagaacacggtatatctcgatttctcgagcttgcgctcggacgataccgcggtctattactgtgccagggacaggggcgataccagactcttggactatggcgattacgaggacgagcgctattactatggcatggacgtgtgggggcaagggaccacggtaatagtctcgagcgcgagcacgaaaggg

SEQ ID NO: 58091 - RNA, 414 nt, synthetic construct
  misc_feature 1..414: note = derived and/or modified sequence opt11 from anti-HIV_Chain
  source 1..414: mol_type = other RNA
caagtgcaattggtccagagcggggccgaggtcaggaaaccgggatcgagcttgaaagtgagctgtaaatcgagcgggggcacgttctcgcgatatgtcgtgaactgggtcaggcaagcgcccgggcaagggctcgagtggatgggagggatcataccaatattcgggatcgcgaaatatgcccagaaatttcaagatcgagtgaccatgaccgcggacgagccaaagaacacggtctatctcgatttcaatagcttgcgctcggacgataccgcggtctattactgtgccagggacagaggcgataccaggctcttggactatggagattacgaggacgagcgctattactatggcatggacgtgtgggggcaagggaccacggtcatagtatcgagcgcgagcacgaaaggg

SEQ ID NO: 58092 - RNA, 414 nt, synthetic construct
  misc_feature 1..414: note = derived and/or modified sequence opt11 from anti-HIV_Chain
  source 1..414: mol_type = other RNA
gtggtgcagctggtgcagagcggggcagaggtgaggaagccggggagtagcctgaaggtgagctgtaagagtagcggggggacgttcagtaggtatgtagtgaactgggtgaggcaggcgccggggcaggggctggagtggatgggggggatgataccgatattcgggatagcgaagtatgcacagaagtttcaggatagggtgacgatgacggcggacgagagcaagaacacggtatatttggattttagtagcttgaggagtgacgatacggcggtgtattactgtgcgagggacaggggggatacgaggctgttggactatggggattacgaggacgagaggtattattatgggatggacgtgtgggggcaggggacgacggtgatagtgagtagcgcgagcacgaagggg

SEQ ID NO: 58093 - RNA, 414 nt, synthetic construct
  misc_feature 1..414: note = derived and/or modified sequence opt11 from anti-HIV_Chain
  source 1..414: mol_type = other RNA
ttcatatgctttagcgtggtcgtgcgcttgctcgagttcgggggcaggctcgtgcaaccgggcgggagcttgcgattgagctgtagcgcgagcgggttcacgttctcgaactcggccatgagctgggtcaggcaagcgcccgggaaagggctcgagtgggtgagctcgatcttgagctcgggcgtgggcacgttctatgccgatagcgtgaaagggcgatttaccgtgagcagggacaatagcagaaacacgctctatctccagatgaagtcgttgcgcgcggaagataccgcgctatattactgtgccaaggtccagatccagcaactgaactttggcgtgatcacggacgcgggcctggacgtgtgggggaaagggaccacgctcatagtcagcagcgcgagcacgaaaggg

SEQ ID NO: 58094 - RNA, 414 nt, synthetic construct
  misc_feature 1..414: note = derived and/or modified sequence opt11 from anti-HIV_Chain
  source 1..414: mol_type = other RNA
caagtgcaattggtccagagcggggccgaggtcaggaaaccaggctcgagcttgaaagtgagctgtaaatcgagcgggggcacgttctcgcgctatgtcgtgaactgggtcaggcaagcgcccgggcaagggctagagtggatgggcgggatcataccaatattcggaatcgcgaaatatgcacagaaatttcaagatcgagtgaccatgaccgcggacgagagcaagaacacggtctatctagatttctcgagcttgcgatcgggcgataccgcggtctattactgtgccagggacagaggcgataccaggctcttggactatggcgattacgaggacgagcgctattactatggcatggacgtgtgggggcaagggaccacggtcacggtctcgagcgcgagcacgaaaggg

SEQ ID NO: 58095 - RNA, 417 nt, synthetic construct
  misc_feature 1..417: note = derived and/or modified sequence opt11 from anti-HIV_Chain
  source 1..417: mol_type = other RNA
caagtacaactggtcgagagcggggccgaggtcaagaaaccgggctcgagcgtgaaagtgagctgtaaagcgagcgggggcacgttcaatatctttgcctttagctgggtcaggcaagcgcccgggcaagggctcgagtggatgggcgggatcatacccatattcgcaagcccgaactatgcccagcgctttcaagggcgcgtgaccataaccgcggacgagagcacgagcacggtccatatggagctctcgagcttgcgctcggaagataccgcaatctactactgtgccaaggacgcgcacatgcacatagaggaacccagggactatgactatatctggggcacaagcccgtactatttcgattactggggccagggaacgctcgtgaccgtgagctcggcctcgaccaagggc

SEQ ID NO: 58096 - RNA, 417 nt, synthetic construct
  misc_feature 1..417: note = derived and/or modified sequence opt11 from anti-HIV_Chain
  source 1..417: mol_type = other RNA
caggtccagctcgtggaatcgggcgcggaagtgaaaaagcccggggcctcggtcaaggtctcgtgcaaggcctcgggctatacctttacctcgcacgatatcaattgggtgcgccaggccacgggccagggcttggaatggatggggtggatgaacccgaactcgggcgataccgggtacgcgcacaagttccagggcagggtcacgatgacgcgaaataccccgatctcaaccgcgtacatggaactgagctcgctcaggagcgaggacacggccgtgtactattgcgcgcgagggcgcgcgacctcgcgcaataccccgtgggcgcactattacgatagctcgggctattacggggccggggactattgggggcaagggaccttggtcacagtctcgagcgcgagcacgaaaggg

SEQ ID NO: 58097 - RNA, 417 nt, synthetic construct
  misc_feature 1..417: note = derived and/or modified sequence opt11 from anti-HIV_Chain
  source 1..417: mol_type = other RNA
caagtccaaatccgacaatccggccccggcctcgtcaaacccctcgaaaccctctccctctcctgcatcgtcttcggcggctccttcatcgcctaccactggacctggatccgccaagcccccctcaaaggcctcgaatggatcggcgacatcgaccaaggcggcgacatcacctactccccctccctcaaatcccgcgtcaccatgtccgtcgaccgctccaaatcccaattctccctcaaactctcctccgtcaccgccgccgacgccgccgtctactactgcgtacgcggcccccccaaccgatacgccgtcacctcattcacctccggcacccaccgcgaacgctcctcctactacttcgactactggggccccggcaccctcgtcaccgtctcctccgcctccaccaaaggc

SEQ ID NO: 58098 - RNA, 423 nt, synthetic construct
  misc_feature 1..423: note = derived and/or modified sequence opt11 from anti-HIV_Chain
  source 1..423: mol_type = other RNA
aatggcgggagcctgcgattgagctgtcgcgtgagcggattcgggttccatctctatgaaatgaactgggtcaggcaagcgcccgggaaagggctagagtggataagctcgatctcgggctcgggcgagagcacgcactatagcgatagcataaccgggcgatttagcatgagcagggacgaggccaaggactcgctctatctccagatgaataacttgcgcgtggaagataccgcggtctattactgtacaaggggctttagcatgggcgatggcacgggctttagctttgacacgtgggggcgagggaccatggtcacggtctcaagcgggctcgataccgtgagcttggcatcgaccaagggcccgagcgtgttcccgctagcgccctgtagcaggagcacgagcgatgccaggctctca

SEQ ID NO: 58099 - RNA, 423 nt, synthetic construct
  misc_feature 1..423: note = derived and/or modified sequence opt11 from anti-HIV_Chain
  source 1..423: mol_type = other RNA
caggtccagctcgtgcaatcgggcgcggaagtgaaaaagcccgggagttcggtcaaggtctcgtgcaaggcctcgggcgggacctttagcacgtacgcgatctcgtgggtgcgccaggccccgggccagggcttggaatggatgggcgggataatcccgagctttagcatgagcaattacgcgcaagatttccagggcaggctaacgatcacggccgatgaatcgacctcgagcgtgtacatggaactgaactcgctcaggagcgaggacacggccgtgtactattgcgcgcgagatttcccgcgctttcacaggctcgtgggcaattacgatttctggcgcgggaccttggacaggttctcatacatggacttgtgggggcgcgggaccgcggtcacggtctcgagcgcaagcacgaaaggg

SEQ ID NO: 58100 - RNA, 423 nt, synthetic construct
  misc_feature 1..423: note = derived and/or modified sequence opt11 from anti-HIV_Chain
  source 1..423: mol_type = other RNA
ctagtccaactcgtcgaatccggcggcggcgtcgtccaacccggccgctccctccgcctctcatgcgccgcctccggcttcaccttctccacctacgccatgcactgggtccgccaagcccccggcaaaggcctcgaatgggtcgccgtcatctcctacgacggctccaacaaattctacgccgactccgtcaaaggccgattcaccatctcccgcgacaactccaaaaacaccctctacctccaaatgaactccctccgcgcagaagacaccgccgtctactactgcgcccgccccaaattcctccccggcgccgacatcgtcgtcgtcgtcgccgccacccccttcgactactggggccaaggcaaccccggccaccgcctactctcattccaccaaggccccatcggcctcccccccggc

SEQ ID NO: 58101 - RNA, 423 nt, synthetic construct
  misc_feature 1..423: note = derived and/or modified sequence opt11 from anti-HIV_HeavyChain
  source 1..423: mol_type = other RNA
atggaatggagcggggtctttatctttctcttgagcgtgaccgcgggcgtgcactcggaagtgcaattggtcgagagcgggggcgggctcgtgaaaccgggcgggagcttgcgcttgagctgtgcagcgagcgggtacacgttctcgaactattggataggctgggtcaggcaagcgcccgggaaagggctagagtggataggcgatatctatcccgggggcaattacatacgcaataacgagaaatttaaagataaaacgaccttgagcgcggacacgagcaagaacacggcctatctccagatgaatagcctgaaaacggaagataccgcggtctattactgtggctcgagctttggctcgaactatgtctttgcctggttcacgtactggggccagggcacactcgtgaccgtgagctcg

SEQ ID NO: 58102 - RNA, 423 nt, synthetic construct
  misc_feature 1..423: note = derived and/or modified sequence opt11 from anti-HIV_HeavyChain
  source 1..423: mol_type = other RNA
atggaatggtccggcgtcttcatcttcctcctctccgtcaccgccggcgtccactcccaagtccaactcgtccaatccggccccgacgtcaaaaaaccaggcacctccatgaaaatgtcctgcaaaacatccggctacaccttctccaactactggatcggctgggtccgccaagcccccggccaaggactcgaatggatcggcgacatctaccccggcggcaactacatccgcaacaacgaaaaattcaaagacaaaaccaccctcaccgccgacacctccacctccaccgcctacatgcaactcggctccctccgctccgaagacaccgccgtctactactgcggatcctccttcggctccaactacgtcttcgcctggttcacctactggggccaaggcaccctcgtcaccgtctcctca

SEQ ID NO: 58103 - RNA, 429 nt, synthetic construct
  misc_feature 1..429: note = derived and/or modified sequence opt11 from anti-HIV_Chain
  source 1..429: mol_type = other RNA
caagtcttcgtccaactagtccaatccggcggcggcctcgtccaacccggcggctccgtccgcctctcctgcaccgcctccggcttcctcttctccacctactccatgaactgggtccgccaagcccccggcaaaggactcgaatgggtctcctccatctccaccacctccaactacatctactacgccgactccgtaaaaggccgcttcaccatctcccgatcaaacggccaaggctccctatacctccaactcaactccctccgcgtcgaagacaccgccgtctactactgcgcccgcgacaccaaagtaggagccccccgccaagactgctacgccatggacctctggggccaacgcgaccacggccaccgcctcctctccttccaccaaggccccatcggcctcccccccggcgccctcctccaa

SEQ ID NO: 58104 - RNA, 432 nt, synthetic construct
  misc_feature 1..432: note = derived and/or modified sequence opt11 from anti-HIV_Chain
  source 1..432: mol_type = other RNA
atcatcctcttcctcgtcgccaccgccaccggcgtccactccgacatccaaatgacccaatccccctcctcactctccgcatccgtcggcgaccgcgtcaccatcacctgccgcgcctcccaatccatcgaccgctacctcaactggtaccaacacaaacccggcaaagcacccaaactcctcatctacgccgcctccaacctccacaccgacgtcccatcccgcttctcaggctccggcgccggaacctacttcaccctcaccatcacctcactccaacccgaagacttcgccacctactactgccaacaatcccactccccctccttcggccaagaatcctactccatcgccttcggccaaggcacccgcctcgaaatcaaacgcaccgtcgccgccccctccgtcttcatcttccccccctccgacgaa

SEQ ID NO: 58105 - RNA, 432 nt, synthetic construct
  misc_feature 1..432: note = derived and/or modified sequence opt11 from anti-HIV_Chain
  source 1..432: mol_type = other RNA
ctccaacaactccaagtcccccgcctctccatgtggcgcgtcttcaaagtcgccgccgccaccggcgcccaaaccctcaccgtcgaagaacccggctcctcagtcaaagtctcctgcaaagcctcaggcggctcctccaccgcctacggctactcctgggtccgccaagcccccggccaaggcttcgaatggatgggccgcatcatccccttctacggcatcatcacctacgcccccaaattccaaggccgcgtcaccatcaccgccgaccgatccacctcaaccgtctacatggaactcacatccctcaccttcgccgacaccgccctcttcttctgcgcccgcgacttcggcgacccccgcaacggctactacttcgactcctgggaccaaggcctctggctcaccgtctcctctgcctccaccaaaggc

SEQ ID NO: 58106 - RNA, 432 nt, synthetic construct
  misc_feature 1..432: note = derived and/or modified sequence opt11 from anti-HIV_Chain
  source 1..432: mol_type = other RNA
caggtcaggctcgagcaatcgggcgtggccatgcgcaagcccggggcctcggtcacgctctcgtgccaggcctcgggctataacttcgtcaagtacataatccattgggtgcgccagaaaccgggcttgggcttcgaatgggtcgggatgatagacccgtacaggggcaggccctggagcgcgcacaagttccagggccgactctcgctctcgcgcgatacctcgatggagatcctgtacatgaccctgacctcgctcaagagcgatgacacggccacgtacttctgcgcgcgcgcggaagcggcctcggacatacactcccgcccgatcatactaacgggcccgggcgagtacgggctcgacctcgagcacatggactggacctggcgcatactctgcctcctggccgtggcaccaggctgccactcgcaa

SEQ ID NO: 58107 - RNA, 435 nt, synthetic construct
  misc_feature 1..435: note = derived and/or modified sequence opt11 from anti-HIV_Chain
  source 1..435: mol_type = other RNA
atgttcttgttcttggtcgcgggcgcgaccggggtccagagccaggtctatctagtgccctttggcccggaagtgaaaaagcccgggagctcggtcaaggtctcgtgcaaggcctcaggcgatagctttacctcgagcgtgatcacgtgggtgcgccaggccccgggccagggcccggaatggatggggcgcgtgatcccggtattgggcgtggccgcgtacgcgcaaaaattctatggcagggtcacgatcacggccgatacctcgagcaataccgcgtacatggaagtgaactcgctcaggttcgaggacacggccgtgtactattgcgcgcgagagaccgggcgcgggggcaatctcgcgctcaggcaatatttctttgactcgtgggggcaagggaccttggtcacggtctcgagcccgagcacgaaaggg

SEQ ID NO: 58108 - RNA, 438 nt, synthetic construct
  misc_feature 1..438: note = derived and/or modified sequence opt11 from anti-HIV_Chain
  source 1..438: mol_type = other RNA
caagtccaactccaagaatccggccccggactcgtcaaaccctccggcaccctctcactcacctgcgccgtctccggcgcctccatctcctctcgcaactggtggacctgggtccgccaaccccccggcaaaggcctcgaatggatcggagaaatctacgaatccggcgccaccaactacaacccctccctcaaatcccgcgtcaccatctccgtagacaaatccaaaaaccaattctccctccgactcacctccgtcaccgccgccgacaccgccgtctacttctgcgcacgcctcatgaccttcggcggcctcatcggcaccctcgactactggggccaaggcaccctcgtcaccgtcctccaaccccccccccgcgcccaccgctaccacccccgcaatctccttcaagaacacctctgcgcccgcgtaatgcca

SEQ ID NO: 58109 - RNA, 444 nt, synthetic construct
  misc_feature 1..444: note = derived and/or modified sequence opt11 from anti-HIV_HeavyChain
  source 1..444: mol_type = other RNA
atggagtggtcgggagtgttcatattcttgctctcagtcacggccggggtccatagcgaggtccagctcgtggaatcgggcgggggcttggtcaagcccgggggctcgctcaggctctcgtgcgcggcctcgggctatacctttagcaattactggatcgggtgggtgcgccaggccccgggcaagggcctggaatggatcggggacatatacccgggcgggaactatatcaggaacaatgaaaagttcaaggacaagaccacgctatcggccgatacctcgaaaaataccgcgtacttgcaaatgaactcgctaaagaccgaggacacggccgtgtactattgcgggagctcgttcgggagcaattacgtgttcgcgtggtttacctattgggggcaagggacattggtcacggtctcgagcggggaatcgctcaagcccttg

SEQ ID NO: 58110 - RNA, 444 nt, synthetic construct
  misc_feature 1..444: note = derived and/or modified sequence opt11 from anti-HIV_HeavyChain
  source 1..444: mol_type = other RNA
atggaatggtccggcgtcttcatcttcctcctctccgtcaccgcaggcgtccactcccaagtccaactagtccaatccggacccgacgtcaaaaaacccggcacctccatgaaaatgtcctgcaaaacctccggctacaccttctcaaactactggatcggctgggtccgccaagcccccggccaaggcctcgaatggatcggcgacatctaccccggcggcaactacatccgaaacaacgaaaaattcaaagacaaaaccaccctcaccgccgacacctccacctccacagcctacatgcaactcggctccctccgctccgaagacaccgccgtctactactgcggctcctccttcggctccaactacgtcttcgcctggttcacctactggggccaaggcaccctcgtcaccgtctcctcaggagaatccctcaaacccctc

SEQ ID NO: 58111 - RNA, 447 nt, synthetic construct
  misc_feature 1..447: note = derived and/or modified sequence opt11 from anti-HIV_Chain
  source 1..447: mol_type = other RNA
caagcccgcctcgaccaatggggcaccggcctcctcaaaccctcagaaaccctctcactcaaatgcgccgtcttcggcgtactcttcaccgactacaactggacctgggtccgccaatcccccggcaaaggcctcgaatggatcggccacctcgaccaccgcggcggcggcaactacaacccctccctcgaatcccgagtcaccatctccctcgactactccaaagcccaattctccctccacctcaaatccgtcaccgtcgccgacaccgccctctactactgcgccggcgccgtcaaaggcttctggttcgacgaagtctacaactggttcggccccggcgtccgcgaaccctggctcccctccccccaaccccccccccgagcccaccgctcctccccctggcacccccccccacgcgcccccctagtcacagccaccgtcccc

SEQ ID NO: 58112 - RNA, 447 nt, synthetic construct
  misc_feature 1..447: note = derived and/or modified sequence opt11 from anti-HIV_Chain
  source 1..447: mol_type = other RNA
caagcccgcctcgaccaatggggcaccggcctcctcaaaccctccgaaacactttccctaaaatgcgccgtcttcggcgtcctcttcaccgactacaactggacctgggtccgccaatcccccggcaaaggcctcgaatggatcggccacctcgaccacagaggcggcggcaactacaacccctccctcgaatcccgcgtcaccatctccctcgactactccaaagcccaattctccctccacctcaaatccgtcaccgtcgccgacaccgccctctactactgcgccggcgccgtcaaaggcctctggttcgacgaaacctacacctggttcggcccctggtcccaaggcacccgcgtcaccgtcgcctccgcctcaaccaaaggcccctccgtcttccccctcgccccctcatccaaatccacctccggcacccgcgacctctcc

SEQ ID NO: 58113 - RNA, 447 nt, synthetic construct
  misc_feature 1..447: note = derived and/or modified sequence opt11 from anti-HIV_Chain
  source 1..447: mol_type = other RNA
gccgcccgcctagaccaatggggcaccggcctcgtcaaaccctccgaaaccctatccctaaaatgcgccgtcttcggcgtcgacttccccgactacacctggacctgggcccgacaagcccccggcaaaggcctcgaatggatcggccaccgcgaccaccgcggcggctcctcctacaacccctccctctccggccgcgccaccatctccctcgacacctccaaagcccaattctccctccacatcaaatccgtcacagtcgcagacaccgcaacctactactgcgccggcgccgtcgccggcctctggttcgaagacgcctacaactggttcggcccctggtcccaaggcaccctcgtcaccgtcgccgccgcctccacaaaaggcccctccgtcttcccactcgccccatcatccaaatccacctccggccacgcctccgtcctc

SEQ ID NO: 58114 - RNA, 450 nt, synthetic construct
  misc_feature 1..450: note = derived and/or modified sequence opt11 from anti-HIV_Chain
  source 1..450: mol_type = other RNA
ctcgcgcaattggaacagagcgggggcggggtcgtgaaaccgggcgggagcttgcgcttgccctgcgccgcgagcgggttcacgttcatagactattacatggcctggatcaggctcgcgcccgggaaagggctcgagtggttgagctatatctcgaaaaatggcgattacacgaaatatagcgagagcttaaaagggcgctttaccataagcagggacaatgccaagaacttggtcatactccagctcaatcgcttgagagcggacgacaccgcgatctatttctgtgccagggccgacggcttaacctatttcggggaattgctccagtacatattcgatctctggggccagggcgcgcgcgtgatcgtgagctcggcctcgaccaagggcccgagcgtgttcccgctcgcaccctcgagcaagagcacaagtgggcacgcgagcgtg

SEQ ID NO: 58115 - RNA, 459 nt, synthetic construct
  misc_feature 1..459: note = derived and/or modified sequence opt11 from anti-HIV_Chain
  source 1..459: mol_type = other RNA
caagtgcaattggtccagagcggggccgaggtcaagaaaccgggcgcgagcgtgaaagtgagctgcaaagtaagcgggtacacgctcacggaactgagcatacactgggtcaggcaagcacccgggaaagggctcgagtggatgggcgggttcgacagcgaggacggagaagcaatctataaacagaactttcaagggcgcgtgaccatgaccgaggacacgagcacggacacggcctatatggagctctcgcgcttgcgatcggaagataccgcggtctattactgcgccacggccgatcgctttaaagtggcccaggacgagggcttgttcgtgatctttgactattgggggcaagggaacccgggacatcgcttgctatcgctccaccaagggcccataggcctgccaccgggcacgctcccgcccaaggccacaagcgggcacgcggccagacgc

SEQ ID NO: 58116 - RNA, 462 nt, synthetic construct
  misc_feature 1..462: note = derived and/or modified sequence opt11 from anti-HIV_Chain
  source 1..462: mol_type = other RNA
ctcgtccaactcgtacaatccggcgccgaagtcaaaaaacccggcgcctccgtcaaagtctcctgcaaagtctccggctactcactcaccgaactctccatccactgggtccgccaagcccccggcaaaggcctcgaatggatgggcggattcgactccgaagacggcgaagccatctacaaacaaaacttccaaggccgcgtcaccatgacagaagacacctcaaccgacaccgcctacatggaactctcacgcctccgctccgaagacaccgccgtctactactgcgccaccgccgacccattcaaagtcgcccaagacgaaggcctcttcgtcatcttcgactactggggccaaggcaccaccggccaccgcctcctctcactccaccaaggcccccaccgcctctactccctaggcaccctcctctcccgcgcccccatcgtccaaacccacatggcc

SEQ ID NO: 58117 - RNA, 471 nt, synthetic construct
  misc_feature 1..471: note = derived and/or modified sequence opt11 from anti-HIV_Chain
  source 1..471: mol_type = other RNA
caaatccacctcgtacaatccggcaccgacgtcaaaaaacccggctcctccgtcacagtctcctgcaaagcctacggcgtcaacaccttcggcctctacgccgtcaactgggtccgccaagccccaggccaatccctcgaatacatcggccaaatctggcgctggaaatcatcagcctcccaccacttccgcggccgcgtcctaatctccgccgtcgacctcaccggctcctcaccccccatctcctccctagaaatcaaaaacctcacctcagacgacaccgcagtctacttctgcaccacaacctccacctacgaccaatggtccggcctccaccacgacggcgtcatggccttctcctcccgcggccaaggcaccctcatctccgtctccgccgcctccaccaaaggcccctccgtcttccccctcgccccctcctccaaatccacctacggcctcgcccacgtcctc

SEQ ID NO: 58118 - RNA, 477 nt, synthetic construct
  misc_feature 1..477: note = derived and/or modified sequence opt11 from anti-HIV_Chain
  source 1..477: mol_type = other RNA
caacaccaactcgtcccctgcgtcgccgaagtccgcaaacccggcgcctccgtcaaagtctcctgcaaagtatccggatacaccctcaccgaaatctccatgcactgggtccgccaagcccccggcaaaggcctcgaatggatgggcggcttcgaccgcgaagacggcgaaaccatctacgcccaaaaattccaaggccgcgtcaccatgaccgaagacacatccaccgacaccgcctacatggaactctcctccctccgctccgaagacaccgccgtctactactgcgccaccacctacctcgccgtcgtccccgacggcttcgacggttactcatcctcatggtactggttcgacccctggggccaaggcaccctcgtcaccgtctcatccgcctccatgcaaggccccatgctcctctcccccacaggcaccctcctcccccgcgcacccctcgtccaaacccgcccaggcccc

SEQ ID NO: 58119 - RNA, 642 nt, synthetic construct
  misc_feature 1..642: note = derived and/or modified sequence opt11 from anti-HIV_LightChain
  source 1..642: mol_type = other RNA
gacatagtaataacccaatccaccaaattcatgtcaacctccgtcggcgaccgcgtctccatcacatgcaaagcctcccaggacgtctccaccgccgtcgcctggtaccaacaaaaacccggccaatcccccaaactcctaatatactgggcctccacccgccacaccggcgtccccgaccgcttcaccggctcaggctccggcaccgactacaccctcaccatctcccgcgtacaagccgaagacctcgccctctactactgccaacaacactacaccaccccctggaccttcggcggcggcaccaaactcgaaatcaaacgcaccgtcgccgccccctccttcgtcatcttcccaccctccgacgaacaactcaaatcaggcaccgcatccgtcgtctgcctactcaacaacttctacccccgcgaagccaaagtccaatggaaagtcgacaacgccctccaatccggcaattcccaagaatccgtcaccgaacaagactcaaaagactccacctactccctctcctccaccctcaccctctccaaagccgactacgaaaaacacaaagtctacgcatgcgaagtcacccaccaaggcctctcctcacccgtcaccaaatccttcaaccgcggcgaatgc

SEQ ID NO: 58120 - RNA, 651 nt, synthetic construct
  misc_feature 1..651: note = derived and/or modified sequence opt11 from anti-HIV_Chain
  source 1..651: mol_type = other RNA
caatccgtcctcacccaaccaccctccgtctccgccgccccaggacaaaaagtcaccatctcttgctccggatcctcctcaaacatcggaaacaactacgtcctatggtaccaacaattccccggcaccgcacccaaactactaatctacggcaacaacaaacgcccctcaggcatcccagaccgattctccggctccaaatccggaacctcagccaccctcggaatcaccggcctacaaaccggcgacgaagccgactacttctgcgcaacctgggactccggcctatccgccgactgggtcttcggcggaggcaccaaactcaccgtcctctcccaacccaaagccgccccctcagtaaccctcttccccccctcctccgaagaactccaagccaacaaagccaccctcgtctgcctcatctccgacttttaccccggcgccgtcaccgtcgcctggaaagccgactcctcccccgtcaaagccggagtcgaaaccaccacaccctccaaacaatccaacaacaaatacgcagcctcctcatacctctccctcacacccgaacaatggaaatcacaccgctcctactcttgccaagtcacccacgaaggctccacagtcgaaaaaaccgtcgcccccaccgaatgctca

SEQ ID NO: 58121 - RNA, 657 nt, synthetic construct
  misc_feature 1..657: note = derived and/or modified sequence opt11 from anti-HIV_Chain
  source 1..657: mol_type = other RNA
gacatcgtcatgacccaatcaccagactccctcgccgtctccctcggcgaacgcgtcaccatgaactgcaaatcctcccaatccctcctctactcaaccaaccaaaaaaactacctcgcctggtaccaacaaaaaccaggccaatccccaaaactcctcatatactgggcaaactccaccgaatccggcgtccccgaccgcttctccggctccggctccggcaccgacttcaccctcaccatctcatccgtccaagccgaagacgtagccgtctactactgccaacaatactactcctaccgcacattcggaggcggcaccaaactcgaaatcaaacgcaccgtcgccgccccaagcgtcttcatattccccccctctgacgaacaactcaaatccggcaccgcctccgtcgtctgcctcctcaacaacttctacccccgcgaagccaaagtacaatggaaagtcgacaacgcactccaatccggcaactcccaagaatcagtcaccgaacaagactcaaaagactccacctacagcctctcctccaccctaaccctcagcaaagccgactacgaaaaacacaaagtctacgcctgcgaagtcacccaccaaggcctctcctcccccgtcaccaaatccttcaaccgcggcgaatgc

SEQ ID NO: 58122 - RNA, 753 nt, synthetic construct
  misc_feature 1..753: note = derived and/or modified sequence opt11 from anti-HIV_SingleChain
  source 1..753: mol_type = other RNA
atgcaagtacaactggaacagagcggggccgaagtcaagaaaccgggcgcgagcgtgaaagtgagctgtcaagcgagcggatacaggttctcaaactttaccgtacactgggtaaggcaagcgccagggcaaagattcgagtggatgggctggatcaacccctataacgggaacaaggagttcagcgcgaaattccaagatcgcgtgacctttaccgcggacacaagcgcgaacacggcctatatggaactcagaagcctgcgcagtgcagacacagcggtatactactgcgccagggtaggggaatggggctgggacgatagtccgcaagataactattacatggacgtgtgggggaaaggaaccacggtaatagtctcgagcgggggagggggatcgggcgggggcgggagcgggggcggcgggtcggacatagaattgacccagagcccggggacgctatcgctatcacccggggaaagggccacgttctcgtgcaggagctcgcactcgataaggagcaggagagtggcctggtaccagcacaagccagggcaagcgcccaggctcgtgatacatggagtaagcaatagagcaagcgggatatcggacaggttctcgggatcaggctcgggcacggacttcaccctaaccataacaagagtcgagccagaggactttgccttgtactactgccaggtatatggcgcgagcagctacacgttcgggcaagggaccaagctcgagcgcaag

SEQ ID NO: 58123 - RNA, 1338 nt, synthetic construct
  misc_feature 1..1338: note = derived and/or modified sequence opt11 from anti-HIV_LightChain
  source 1..1338: mol_type = other RNA
gaagtcaaactcgaagaatccggcggaggcctggtccaaccaggcggctcccgcaaactctcatgcgccgcctcaggcttcacattctcctcattcggcatgcactgggtacgacaagcccccgaaaaaggactcgaatgggtcgcctacatatcctcaggctcctcaaccctccactacgccgacaccgtaaaaggccgtttcaccataagtcgcgataaccccaaaaacaccctcttcctccaaatgaaactcccctccctatgctacggactcctcggatcacgcaatctcagccaccgactcctctcacaaaatgacacccccatctgcctcaccgtctctagcgcatccacgaaaggaccctccgtcttcccactcgccccttcctccaaatccacctctggcggaaccgcagcactaggctgcctcgtaaaagactacttccctgaacccgtcacagtaagctggaactcaggggccctcacatccggcgtccacaccttccccgccgtccttcaatcctccggcctctactccctctccagcgtcgtcaccgtcccgtcctcatcccttggcactcagacctacatctgtaacgtcaaccacaaaccctccaacaccaaagtcgataagaaagtcgaaccaaaatcctgcgacaaaacccacacttgtcccccgtgccccgcacccgaactactaggcggaccctccgtcttcctcttcccacctaaacccaaagacactctcatgatctcccgcacccccgaagtcacatgcgtcgtcgtcgacgtctcccacgaggacccagaagtcaaattcaactggtacgtcgacggcgtcgaagtccacaacgccaaaaccaaaccccgcgaagaacaatataactccacataccgcgtcgtctccgtcctcacagtactacaccaagactggctgaatggaaaagaatacaaatgcaaagtcagcaacaaagccctacccgcccccatcgagaaaactatctccaaagcaaaaggccaaccccgagaaccacaagtttacaccctacccccgtcccgagaagaaatgaccaaaaaccaagtcagcctcacatgcctggttaaaggcttctacccctccgacatcgccgtcgaatgggaatcaaatggacaacccgaaaacaactataaaaccaccccacccgtcctagactccgacggctctttcttcctctactccaaattaacagtcgacaaatctcgctggcaacaaggcaacgtcttctcttgcagcgtaatgcacgaagccctccacaaccactacacccagaaatccctctccctctcccccggtaaa

SEQ ID NO: 58124 - RNA, 1380 nt, synthetic construct
  misc_feature 1..1380: note = derived and/or modified sequence opt11 from anti-HIV_Chain
  source 1..1380: mol_type = other RNA
gaagtacaactggtcgaatccggaggaggcctagtcaaacccggcggttcactccgcctcacatgcgtcgcatccggattcaccttctctgacgtctggctcaactgggtccgccaggcccccggaaagggcctcgaatgggtcggccgcataaaaagccgcacagacggcggcacaaccgactacgctgcatccgtcaaaggccgcttcaccatctcccgcgacgacagcaaaaacactctttacctccaaatgaactccctcaaaacagaagataccgctgtctactcctgtaccaccgacggattcatcatgatccgtggcgtgtccgaagactactactactactacatggacgtctggggaaaaggaaccactgtaaccgtatcctccgcctccaccaaaggaccaagcgtcttccccctcgccccatccagcaaatccacctccggaggcaccgcagccctcggctgccttgtcaaagactacttccccgaacccgtcaccgtctcctggaactccggcgccctcacctccggggtccacacattcccagccgttctccaatcaagcggcctatactcactctcctccgtcgtcaccgtccccagcagctccctcggcacacaaacatacatctgtaacgtaaaccataaaccttccaacaccaaagttgacaagaaagtagaaccaaaatcctgcgacaaaacacatacctgtcccccatgccccgcccccgaactcctcggaggcccttccgtattcttattccctcccaaacccaaagacaccctcatgatatcccgcacccccgaagtaacctgcgtcgtcgtcgatgtctcccacgaagaccccgaagtcaaattcaactggtacgtcgacggcgtcgaagtccacaacgcaaaaaccaaaccacgcgaagaacaatacaactccacatacagagtagtatccgtcctcaccgtcctccaccaagactggctaaacggtaaagaatataaatgcaaagtctcaaacaaagccctcccagcccccatcgagaaaaccatctcaaaagcaaaaggccaaccccgtgaaccccaagtctacaccctacccccatcaagagacgaactcaccaaaaaccaagtctcactaacctgcctcgtgaaaggcttctacccctcagacatcgccgtcgaatgggaaagcaacggccaacctgaaaacaactacaagaccaccccaccagtcctagactccgacggctctttcttcctatactcaaaactcactgtcgacaaatcccgctggcaacaaggcaacgtcttctcctgctcagtcatgcacgaagccctacacaaccactatacccaaaaatcactctccctctcacctggc

SEQ ID NO: 58125 - RNA, 1413 nt, synthetic construct
  misc_feature 1..1413: note = derived and/or modified sequence opt11 from anti-HIV_Chain
  source 1..1413: mol_type = other RNA
atggaatggagcggagtattcatgttcctcctctccgtcacagccggcgtacactcccaagtccaactccaacaatccggcccagaagtcgtaaaacccggagcctccgtaaaaatgagctgcaaagcctccggctacaccttcacctcctacgtaatccactgggtccgacaaaagcccggacaaggcctcgactggatcggctacattaacccttacaacgacggcaccgactacgatgaaaaattcaaaggcaaagccaccctcacctccgacacctccacctccaccgcttacatggaactctcatccctacgatcagaagacactgccgtttactactgcgccagagaaaaagacaactacgcaaccggcgcctggttcgcctactggggccaaggtaccctcgtcaccgtctcatccgcctccaccaaaggaccctcagtattccccctcgcacccagctccaagtccaccagcggtggaaccgcagccctaggctgcctagtcaaagactacttccccgaaccagtcaccgtatcctggaactccggagcactcacctcaggcgtacacactttccccgccgtcctacagtcatccggcctatactccctctcctccgtagtaacggtcccctcctccagcctcggcacccaaacctacatctgcaacgtcaaccacaaaccctcaaacaccaaagtcgacaagaaagtcgaacccaaatcctgcgacaaaactcacacatgcccaccgtgccccgcccccgagttcgaaggcggtccatcagtatttctcttcccacccaaacccaaagacaccctaatgatatcccgaacacccgaagtaacctgtgtcgtcgtagacgtatcacacgaagaccccgaagtcaaattcaactggtacgttgacggcgtagaagtccacaacgccaaaacaaagccccgcgaagaacaatacaattccacatacagagtagtatccgtacttaccgtcctccaccaagactggctgaacggcaaagaatacaaatgcaaagtatccaacaaagcactccccgcctctatagagaaaaccatctccaaagccaaaggccaaccccgcgaaccacaagtctacacactcccaccctccagagacgaactcaccaaaaaccaagtctcacttacatgcctcgtcaaaggcttctacccatcagacatagccgtcgaatgggaatccaacgggcaacccgaaaacaactacaaaacaacccctcccgtactcgactccgacggctccttcttcctctactccaaactcaccgtagacaaatcccgctggcaacaaggcaacgttttctcatgcagcgtcatgcacgaagccctccacaaccactatacccaaaagtcactctccctgtcccccggaaaa

SEQ ID NO: 58126 - RNA, 645 nt, synthetic construct
  misc_feature 1..645: note = derived and/or modified sequence opt11 from anti-influenza_Fab
  source 1..645: mol_type = other RNA
atcgtactcacacaaagccccgccacactatccgtctcccccggagaacgcgccaccctatcctgccgcgcctcacaagtcatctcccacaacctcgcatggtaccaacaaaaacccggccaagcaccccgcctcctcatctacggcgcctccacccgcgcctccggcatacccgcccgattctcaggctcaggctccggcaccgactacaccctaaccatcacctccctccaacccgaagacttcgccgtctactactgccaacactactccaactggcccccacgactcaccttcggcggcggcaccaaagtcgaaatcaaacgcaccgtcgccgcccccagcgtattcatattcccaccctccgacgaacaactaaaaagcggcaccgcctctgtcgtctgcctcctaaacaacttctacccccgcgaagccaaagtccaatggaaagtcgacaacgcactccaatccggcaactcccaagaaagcgtcaccgaacaagactccaaagactccacctactccctatcctccaccctcaccctctccaaagccgactacgaaaaacacaaagtctacgcgtgcgaagtcacccaccaaggcctctcctcccccgtaaccaaatccttcaaccgcggcgaatgc

SEQ ID NO: 58127 - RNA, 681 nt, synthetic construct
  misc_feature 1..681: note = derived and/or modified sequence opt11 from anti-influenza_Fab
  source 1..681: mol_type = other RNA
gtccaactagtcgaatccggcggcggcgtcgtccaacccggcaaatccccccgcctctcctgcgccgcctccggccccaccttctcatcctacgccgtccactgggtccgccaagccccaggcaaaggccttgaatgggtcaccctcatctcctacgacggcgccaaccaatactatgccgactccgtcaaaggccgcttcaccatctcccgcgacaactccaaaaacaccgtatacctccaaatgaactccctccgccctgaagacaccgccgtctactactgcgccgtccccggccccgtcttcggaatcttccccccctggtcatacttcgacaactggggccaaggcatcctcgtcacagtctcatcagcctccaccaaaggcccctccgtcttccccctagccccctcatctaaatccacctccggcggaaccgccgctctcggctgcctcgtcaaagactacttccccgaacccgtaaccgtctcctggaactcaggcgccctcacatccggcgtccacaccttccccgccgtcctccaatcctccggcctctactccctctcatccgtcgtcacagtcccttcctcctccctcggcacccaaacctacatctgcaacgtcaatcacaaaccctccaacaccaaagtcgacaaaaaagtcgaaccaaaatcctgc

SEQ ID NO: 58128 - RNA, 1515 nt, synthetic construct
  misc_feature 1..1515: note = derived and/or modified sequence opt11 from anti-influenza_Fab
  source 1..1515: mol_type = other RNA
gccggatcaaccgccaccctctgcctcggccaccacgccgttcccaacggaaccatcgtcaaaacaatcactaacgatcaaatcgaagtcaccaacgcaacagaactcgtccaatcctcaagcaccggcgaaatctgcgactcaccacaccaaatcctcgacggcaaaaactgcaccctcatcgacgccctcctaggcgacccccaatgcgacggcttccaaaacaaaaaatgggacctgttcgtcgaacgctccaaagcctatagcaactgctacccctacgacgtccctgattacgcaagcctccgctcactcgtagcatcctcaggcaccctcgaattcaacaacgagtctttcaactggaccggcgtaacacaaaacggcacctcctccgcgtgcatccgccgatccaaaaactcattcttcagccgactaaactggctaacacaccttaacttcaaataccccgccctaaacgtcaccatgcccaacaacgaacaattcgacaaactctacatctggggcgtccaccacccaggaacagacaaagaccagatcttcctctacgcccaagcaagcggaagaatcacagtgtcaacgaaacgcagtcaacaaaccgtctcaccaaacatcggatcaaggccccgagtccgcaacataccctcacggatctccatctactggaccatcgtaaaaccaggcgacatcctactaatcaactccaccggcaacctcatcgctccgcgcggctacttcaaaatacgctccggaaaaagctccataatgcggtccgacgcacccataggaaaatgcaactccgagtgcatcaccccaaatggcagcatccccaatgacaaacctttccaaaacgtcaaccgcatcacctacggcgcctgcccccgctacgtaaaacaaaacaccctcaaactcgccaccggtatgagaaacgtaccagaaaaacaaacccgcggcatattcggcgccatcgccggtttcatcgaaaacggctgggaaggcatggtcgacggatggtacggctttcgacaccaaaatagcgaaggacgcgggcaagccgccgacctcaaatccacacaagcagccatagatcaaataaacggcaaactaaaccggctgatcggaaaaaccaacgaaaaatttcaccaaatagaaaaagaattcagcgaggtcgaaggccgcatacaggacctagaaaaatacgtcgaggacacaaaaatagacctctggagctacaacgcggaactcctggtagcacttgaaaaccagcacaccatagacctaaccgactcagaaatgaacaaactcttcgaaaaaaccaaaaaacaacttagagaaaacgccgaagacatgggcaacggctgcttcaaaatataccacaaatgcgacaacgcatgcatcggttcaattagaaacggaacctacgaccatgacgtctaccgcgacgaagccctcaacaaccgcttccaaatcaaaggatctggcagactcgtacctcgc

SEQ ID NO: 58129 - RNA, 657 nt, synthetic construct
  misc_feature 1..657: note = derived and/or modified sequence opt11 from anti-influenza_Fab
  source 1..657: mol_type = other RNA
caagtccaactcgtacaatccggcggaggcgtcgtccaacccggccgctccctccgactctcctgcgccgcctccgaattcaccttccgcatgtacgccacccactgggtccgccaagcccccggcaaaggcctcgaatgggtcgccctcatctcctacgacggctccaacaaatactacgccgactcagtcaaaggccgcttcaccatctcccgcgacaactccatgaataccgtctacctacaaatgaacaccctccgccccgaagacaccgccgtctactactgcgcccgcgacctcggcggctacttcatccgaggaatcatggacgtctggggacaaggcaccctagtcaccgtctcatccgcctcaacaaaaggcccctccgtcttcccactcgccccctcatccggcggcaccgcagccctcggctgcctcgtcaaagactacttcccagaacccgtcaccgtatcctggaactccggcgccctcacctccggcgtccacaccttccccgccgtactccaatcctccggcctatactcactttcctcagtagtcaccgtcccatcctcctccctcggcacccagacatacatctgcaacgtcaaccacaaaccctccaacaccaaagtagacaaacgagtcgaacccaaa

SEQ ID NO: 58130 - RNA, 642 nt, synthetic construct
  misc_feature 1..642: note = derived and/or modified sequence opt11 from anti-influenza_Fab
  source 1..642: mol_type = other RNA
gaactccaaatgacccaatccccctcctccgtctccgcctcagtcggcgaccgcgtcaccatcacttgccgcgcctcccaaggcatctcctcctggctagcctggtaccaacaaaaacccggcaaagcccccaaactcctcatctacgccgcatcctcccttcaatccggcgtcccctccagattctccggctccggctccggcaccgacttcaccctcaccatctcctcactccaacccgaagacttcgccacctactactgccaacaagccaactccttccccctcaccttcggcggcggcaccaaagtcgaaatcaaacgcacagtagccgccccctccgtcttcatcttcccaccctccgacgaacaactaaaatcaggcaccgcctccgtcgtctgcctcctcaacaacttctacccccgcgaggccaaagtccaatggaaagtagacaacgccctacaatccggaaactcccaagaatcagtcaccgaacaagactcaaaagactccacctactcactctcctcaaccctaacactctccaaagccgactacgaaaaacacaaagtctacgcctgcgaagtcacccaccaaggcctatcctcccccgtcaccaaatccttcaaccgaggcgaatgc

SEQ ID NO: 58131 - RNA, 993 nt, synthetic construct
  misc_feature 1..993: note = derived and/or modified sequence opt11 from anti-influenza_Fab
  source 1..993: mol_type = other RNA
gctgaccccggcgacaccatctgcatcggataccacgccaacaactccaccgacacagtcgacaccgtcctcgaaaaaaacgtaacagtcacccactccgtaaacctactcgaagacagccacaacggcaaactctgcaaactcaaaggtatcgccccactccaactaggcaaatgcaacatcgcaggctggctccttggcaaccccgaatgcgacctactcctcaccgcctcctcctggtcctacatcgtcgagacctccaactccgaaaacggaacctgctacccaggcgacttcatcgactacgaagaactccgcgaacaactctcttccgtatcctccttcgagaaattcgaaatcttcccaaaaacatcctcctggcccaaccacgaaaccaccaaaggcgtcacagcagcctgctcctacgccggcgcctcctcattctaccgcaatctcctctggctcaccaaaaaaggctcatcataccccaaactctccaaatcctacgtgaacaacaaaggaaaagaagtcctagtcctctggggcgtacaccacccccccactggtaccgatcaacaatccctctaccaaaacgccgacgcctacgtctccgtcggatcatccaaatacaaccgacgattcacaccagaaatagccgcccgccccaaagtccgcgaccaagcaggcagaatgaactactactggaccctcctcgaacctggcgacaccatcaccttcgaagccacaggaaacctaatagccccctggtacgccttcgccctaaaccgaggatccggctccggcatcatcacatccgacgcacccgtccacgactgcaacacaaaatgccaaacaccacacggcgcgatcaactcctccctccccttccaaaacatccacccagtaaccatcggagaatgccccaaatacgtccgctccaccaaactccgcatggccaccggcctccgtaacatccccagcatccaatcccgc

SEQ ID NO: 58132 - RNA, 537 nt, synthetic construct
  misc_feature 1..537: note = derived and/or modified sequence opt11 from anti-influenza_Fab
  source 1..537: mol_type = other RNA
ggcctcttcggggcgatcgcgggcttcatcgagggcggatggacgggcatgatcgacggctggtacgggtaccaccaccagaacgagcaagggagcgggtacgcggccgaccaaaagagcacgcaaaacgccatagacgggatcacgaacaaggtcaacagcgtgatcgagaaaatgaacacgcaattcaccgcggtcgggaaagagttcaacaacctggaaaggcgaatagaaaacctcaacaaaaaggtcgacgacgggttcctggacatatggacatacaacgccgagctcttggtactgctcgagaacgagcgcacgctcgacttccacgactcgaacgtgcgcaacctctacgaaaaggtcaagagccagctcaagaacaacgccaaggaaataggcaacggatgcttcgagttctaccacaagtgcgatgacgcgtgcatggaatcggtcaggaacgggacctacgactaccccaagtactcggaagagagcaagctcaaccgcgaagaaatagacggggtctcgggcagg

SEQ ID NO: 58133 - RNA, 642 nt, synthetic construct
  misc_feature 1..642: note = derived and/or modified sequence opt11 from anti-influenza_Apo
  source 1..642: mol_type = other RNA
caatcagtcctcacacaacccccctccgtctccgtagcccccggccaaacagcccgcatcacctgcggcggcaacgacatcggccgaaaatccgtccactggaaccaacaaaaacccggccaagcccccgtcctcgtcgtctgctacgactccgaccgcccctccggtatccccgaacgcttctcaggctccaactccggcaacaccgcaaccctcacaatctcacgcgtcgaagccggcgacgaagccgactactactgccaagtctgggactcatcctccgaccacgtaatcttcggaggcggaaccaaactcaccgtcctaggccaacccaaagcagccccatccgtcaccctcttccccccctcctccgaagaactccaagccaacaaagccaccctcgtctgcctaatctccgacttctaccccggcgcagtcacagtcgcatggaaagctgactcatcccccgtcaaagccggcgtcgaaaccaccaccccctccaaacaatccaacaacaaatacgccgcctcctcctacctctcactcacccccgaacaatggaaatcccaccgctcatactcctgccaagtcacccacgaaggctcaaccgtcgaaaaaaccgtagcccccaccgaatgctcc

SEQ ID NO: 58134 - RNA, 687 nt, synthetic construct
  misc_feature 1..687: note = derived and/or modified sequence opt11 from anti-influenza_Apo
  source 1..687: mol_type = other RNA
gaagtccaactcgtacaatccggcgccgaagtcaaaaaacccggcgcctccgtcaaagtctcatgcaaagcatccggctacacattcacagactaccacatcaactgggtcagacaagcccccggacaaggactcgaatggatgggctggatccaccccaactccggcgacaccaactacgcccaaaaatttcaaggctgggtcaccatgacacgcgacaccgccatctccaccgcctacatggaagtcaacggactaaaatccgacgacaccgccgtctactactgcgcccgcggcggcctcgaaccccgctcagtcgactactactactacggcatggacgtctggggccaaggcaccaccgtcaccgtctcctccgcctccaccaaaggcccctccgtcttccccctcgccccctcctcaaaatccacctccggaggcaccgcagccctaggatgcctcgtcaaagactacttccccgaacccgtaaccgtctcctggaactcaggcgccctcacctccggcgtacacaccttcccagccgtcctccaatcctccggcctctactccctctcctccgtcgtcaccgtcccctcatcctccctcggcacccaaacatacatctgcaacgtcaaccacaaaccctccaacaccaaagtcgacaaacgcgtagaacccaaatcctgc

SEQ ID NO: 58135 - RNA, 333 nt, synthetic construct
  misc_feature 1..333: note = derived and/or modified sequence opt11 from anti-influenza-A_kappa_LightChain_V-Region
  source 1..333: mol_type = other RNA
gacatcgtcatgacccaatcccccgactccctcgccgtctccctcggcgcccgcgccaccatcaactgcaaatcctcccaatccgtcaccttcaactacaaaaactacctcgcctggtaccaacaaaaacccggccaaccccccaaagtcctcatctactgggcctccgcccgcgaatccggcgtccccgaccgcttctccggctccggctccggcaccgacttcaccctcaccatctcctccctccaagccgaagacgtcgccgtctactactgccaacaacactaccgcaccccccccaccttcggccaaggcaccaaagtcgaaatcaaa

SEQ ID NO: 58136 - RNA, 333 nt, synthetic construct
  misc_feature 1..333: note = derived and/or modified sequence opt11 from anti-influenza-A_kappa_LightChain_V-Region
  source 1..333: mol_type = other RNA
gacatcgtcatgacccaatcccccgactccctcgccgtctccctcggcgaacgagcaaccatcaactgcaaatcctcccaatccgtctcctccaacaacaaaaactacctcgcctggtaccaacaaaaacccggccaaccccccaaagtcctcatctactgggcctccgcccgcgaatccggcgtccccgaccgcttctccggctccggctccggcaccgacttcaccctcaccatctcctccctccaagccgaagacgtcgccgtctactactgccaacaacactaccgcaccccccccaccttcggccaaggcaccaaagtcgaaatcaaa

SEQ ID NO: 58137 - RNA, 333 nt, synthetic construct
  misc_feature 1..333: note = derived and/or modified sequence opt11 from anti-influenza-A_kappa_LightChain_V-Region
  source 1..333: mol_type = other RNA
gacatcgtaatgacccaatcccccgactccctcgccgtctccctcggcgaacgcgccaccatcaactgccgctcatcccaatccgtctcctccaacaacaaaaacttcctcgcctggtaccaagaaaaacccggccaaccccccaaagtcctcatctactgggcctccgcccgcgaatccggcgtccccgaccgcttctccggctccggctccggcaccgacttcaccctcaccatctccggcctccaagccgaagacgtcgccgtctactactgccaacaacactaccgcaccccccccaccttcggccaaggcaccaaagtcgaaatcaaa

SEQ ID NO: 58138 - RNA, 333 nt, synthetic construct
  misc_feature 1..333: note = derived and/or modified sequence opt11 from anti-influenza-A_kappa_LightChain_V-Region
  source 1..333: mol_type = other RNA
gacatcgtcatgacccaatcccccgactccctcgccgtctccctcggcgaacgcgccaccatcaactgcaaatcctcccaatccgtcaccttcaactacaaaaactacctcgcctggtaccaacaaaaacccggccaaccccccaaactcctcatctactgggcctccacccgcgaatccggcgtcccagaccgcttctccggctccggctccggcaccgacttcaccctcaccatctcatccctccaagccgaagacgtcgccgtctactactgccaacaacactaccgcaccccccccaccttcggccaaggcaccaaagtcgaaatcaaa

SEQ ID NO: 58139 - RNA, 339 nt, synthetic construct
  misc_feature 1..339: note = derived and/or modified sequence opt11 from anti-influenza-A_kappa_LightChain_V-Region
  source 1..339: mol_type = other RNA
gacatcgtcatgacccaatcccccgactccctcgccgtctccctcggcgaacgcgccaccatcaactgcaaatcctcccaatccgtcctctactcctccaacaacaaaaactacctcgcctggtaccaacaaaaacccggccaaccccccaaactcctcatctactgggcctccacccgcgaatccggcgtccccgaccgcttctccggctccggctccggcaccgacttcaccctcaccatctcctccctccaagccgaagacgtcgccgtctactactgccaacaatactactccaccccccccaccttcggccaaggcaccaaagtcgaaatcaaa

SEQ ID NO: 58140 - RNA, 333 nt, synthetic construct
  misc_feature 1..333: note = derived and/or modified sequence opt11 from anti-influenza-A_kappa_LightChain_V-Region
  source 1..333: mol_type = other RNA
gacatccaaatgacccaatcccccgactccctcgcagtctccctcggcgcccgcgccaccatcaactgcaaatcctcccaatccgtcaccttcaactacaaaaactacctcgcctggtaccaacaaaaacccggccaaccccccaaagtcctcatctactgggcctccgcccgcgaatccggcgtccccgaccgcttctcaggctccggctccggcaccgacttcaccctcaccatctcctccctccaagccgaagacgtcgccgtctactactgccaacaacactaccgcaccccccccaccttcggccaaggcaccaaagtcgaaatcaaa

SEQ ID NO: 58141 - RNA, 387 nt, synthetic construct
  misc_feature 1..387: note = derived and/or modified sequence opt11 from anti-influenza-A_HeavyChain_V-Region
  source 1..387: mol_type = other RNA
caagtccaactcgtcgaatcaggcggcggcgtagtccaacccggacgctccctccgcctctcatgcgccgcctccggcttcaccttctcctcctacggcatgcactgggtccgccaagcccccggcaaaggcctcgaatgggtcgccgtcatctcatacgacggctccaacaaatactacgccgactccgtcaaaggccgcttcaccatctcccgcgacaactccaaaaacaccctctacctccaaatgaactccctccgcgccgaagacaccgccgtctactactgcgccaaagactcacaactccgctcactcctctacttcgactggctctcccaaggctacttcgactactggggccaaggcaccctcgtcaccgtctcctcc

SEQ ID NO: 58142 - RNA, 387 nt, synthetic construct
  misc_feature 1..387: note = derived and/or modified sequence opt11 from anti-influenza-A_HeavyChain_V-Region
  source 1..387: mol_type = other RNA
caagtacaactcgtccaatccggcggcggcgtcgtccaacccggccgctccctccgcctctcctgcgtcgcctccggcttcaccttctccacctacgccatgcactgggtccgccaagcccccggccgcggcctcgaatgggtcgccgtcatctcctacgacggcaactacaaatactacgccgactccgtcaaaggccgcttctccatctcccgcgacaactccaacaacaccctccacctcgaaatgaacaccctccgcaccgaagacaccgccctctactactgcgccaaagactcccaactacgatccctcctctacttcgaatggctctcacaaggctacttcgacccctggggccaaggaaccctcgtcaccgtctcctcc

SEQ ID NO: 58143 - RNA, 387 nt, synthetic construct
  misc_feature 1..387: note = derived and/or modified sequence opt11 from anti-influenza-A_HeavyChain_V-Region
  source 1..387: mol_type = other RNA
caagtccaactcgtccaatccggcggcggcgtcgtacaacccggccgctcactccgcctctcatgcgcagcctccggcttcaccttctccacctacggcatgcactgggtccgccaagcccccggcaaaggcctagaatgggtcgccgtcatctcctacgacggcaactacaaatactacgccgactccgtcaaaggccgcttcacaatctcccgcgacaactccaaaaacaccctctacctcgaaatgaactcactccgcaccgaagacaccgccctctactactgcgccaaagactcccaactccgctccctcctctacttcgactggctctcccaaggctacttcgaccactggggccaaggcaccctcgtcaccgtctcctcc

SEQ ID NO: 58144 - RNA, 387 nt, synthetic construct
  misc_feature 1..387: note = derived and/or modified sequence opt11 from anti-influenza-A_HeavyChain_V-Region
  source 1..387: mol_type = other RNA
caagtccaactcgtccaatccggcggcggcgtcgtcccccccggccgctccctccgactatcctgcgccgcatccggcttcacattctccacctacggcatgcactgggtccgccaagcccccggcaaaggcctcgaatgggtcgccgtcatctcctacgacggcaactacaaatactacgccgactccgtccgcggccgcttcaccatctcccgcgacaactccaaaaacaccctcaacctcgacatgaactccctccgaaccgaagacaccgccctctactactgcgccaaagactcacaactccgctccctcctctacttcgactggctctcccaaggctacttcgaccactggggccaaggcaccctcgtcaccgtctcctcc

SEQ ID NO: 58145 - RNA, 387 nt, synthetic construct
  misc_feature 1..387: note = derived and/or modified sequence opt11 from anti-influenza-A_HeavyChain_V-Region
  source 1..387: mol_type = other RNA
caagtccaactcgtcgaatccggcggcggcgtcgtccaacccggccgctccctccgcctctcatgcgccgcctccggcttcaccttctccacctacgccatgcactgggtccgccaagcccccggcaaaggcctcgaatgggtcgccgtcatctcctacgacgccaactacaaatactacgccgactcagtcaaaggccgcttcaccatctcccgcgacaactccaaaaacaccctctacctacaaatgaactccctccgcgccgaagacaccgccgtctactactgcgcaaaagactcccaactccgctccctcctctacttcgaatggctctcccaaggctacttcgactactggggccaaggcaccctcgtcaccgtctcctca

SEQ ID NO: 58146 - RNA, 387 nt, synthetic construct
  misc_feature 1..387: note = derived and/or modified sequence opt11 from anti-influenza-A_HeavyChain_V-Region
  source 1..387: mol_type = other RNA
caagtccaactcgtcgaatcaggcggcggcgtcgtccaacccggccgatccctccgcctctcctgcgccgcctccggcttcaccttctccacctacgccatgcactgggtccgccaagcccccggcaaaggcctcgaatgggtcgccgtcatctcctacgacggcaactacaaatactacgccgactccgtcaaaggccgcttcaccatctcccgcgacaactccaaaaacaccctctacctccaaatgaactccctacgcgccgaagacaccgccgtatactactgcgccaaagactcccaactccgctccctcctctacttcgaatggctctcccaaggctacttcgacccctggggccaaggcaccctcgtcaccgtatcctcc

SEQ ID NO: 58147 - RNA, 387 nt, synthetic construct
  misc_feature 1..387: note = derived and/or modified sequence opt11 from anti-influenza-A_HeavyChain_V-Region
  source 1..387: mol_type = other RNA
caagtccaactcgtccaatcaggcggcggcgtcgtccaacccggccgctccctccgcctatcctgcgtcgcctccggcttcaccttctccacctacgccatgcactgggtccgccaagcccccggccgcggcctcgaatgggtcgcagtcatctcctacgacggcaactacaaatactacgccgactccgtcaaaggccgcttctccatctcccgcgacaactccaacaacaccctccacctcgaaatgaacacactccgcaccgaagacaccgccctctactactgcgcaaaagactcccaactccgctccctcctctacttcgaatggctctcccaaggctacttcgacccctggggccaaggcaccctcgtcaccgtcacctcc

SEQ ID NO: 58148 - RNA, 330 nt, synthetic construct
  misc_feature 1..330: note = derived and/or modified sequence opt11 from anti-influenza-A_LightChain_V-Region
  source 1..330: mol_type = other RNA
aacttcatgctcacccaacccccctccgcctccggcacccccggccaacgcgtcaccatctcctgctccggctcctcctccaacatcggcggcaacaccgtccactggttccaacaactccccggcaccgcccccaaactcctcatctacaccaactccctccgcccctccggcgtacccgaccgcttctccggctccaaatccggcacctccgcctccctcgccatctccggcctccaatccgaagacgaagccgactactactgcgccgcctgggacgactccctcaacggccaagtcttcggaggcggcaccaaactcaccgtccta

SEQ ID NO: 58149 - RNA, 390 nt, synthetic construct
  misc_feature 1..390: note = derived and/or modified sequence opt11 from anti-influenza-A_HeavyChain_V-Region
  source 1..390: mol_type = other RNA
caagtgcaattgctagagagcggaggcggggtcgtgcaaccgggcaggagcctgcgcttgagctgtgccgcaagcgggttcacgttctcgaactatggcatgcactgggtcaggcaagcgcccgggaaagggctcgagtgggtggccataatctcgttcgatggctcgaaaaagtactatgccaatagcgtgaaagggcgctcgaccataagcagggacaatagcaagaacacgctctcgctacagatgaatagcttgggcccggaagataccgcgctctattactgtgccaagctcccgagcccgtactatttcgatagcaggttcgtgtgggtggccgcgagcgcgttccatttctggggccagggcatactcgtgaccgtgagctca

SEQ ID NO: 58150 - RNA, 132 nt, synthetic construct
  misc_feature 1..132: note = derived and/or modified sequence opt11 from anti-influenza_Chain
  source 1..132: mol_type = other RNA
aacgtccccgaatggtcctacatcgtcgaaaaagccaaccccgccaacgacctctgctaccccggcaacttcaacgactacgaagaactcaaacacctcctctcccgcatcaaccacttcgaaaaaatccaa

SEQ ID NO: 58151 - RNA, 162 nt, synthetic construct
  misc_feature 1..162: note = derived and/or modified sequence opt11 from anti-influenza_Chain
  source 1..162: mol_type = other RNA
tccggccgcctcgtcccccgcggctcccccggctccggctacatccccgaagccccccgcgacggccaagcctacgtccgcaaagacggcgaatgggtcctcctctccaccttcctcggcaaacccatccccaaccccctcctcggcctcgactccaccggc

SEQ ID NO: 58152 - RNA, 291 nt, synthetic construct
  misc_feature 1..291: note = derived and/or modified sequence opt11 from anti-influenza_Chain
  source 1..291: mol_type = other RNA
atgtcgctcttgaccgaggtcgagaccccgatcaggaacgagtgggggtgtaggtgcaatggctcgagcgatcccttggccatagccgcgaacataatcgggatcttgcacttgatcctgtggatactcgatcgcttgttctttaaatgcatctatcgcaggttcaagtacgggctcaagggcgggccctcaaccgagggcgtgccaaagagcatgcgcgaggaatatcgcaaggaacagcaatcggccgtggacgcggacgatggccatttcgtgagcatagaattggaa

SEQ ID NO: 58153 - RNA, 300 nt, synthetic construct
  misc_feature 1..300: note = derived and/or modified sequence opt11 from anti-influenza_Chain
  source 1..300: mol_type = other RNA
atgaacaacgccaccttcaactgcaccaacatcaaccccatcacccacatccgcggctccatcatcatcaccatctgcgtctccctcatcgtcatcctcatcgtcttcggctgcatcgccaaaatcttcatcaacaaaaacaactgcaccaacaacgtcatccgcgtccacaaacgcatcaaatgccccgactgcgaacccttctgcaacaaacgagacgacatctccaccccccgcgccggcgtagacatcccctccttcatcctccccggcctcaacctctccgaaggcacccccaac

SEQ ID NO: 58154 - RNA, 300 nt, synthetic construct
  misc_feature 1..300: note = derived and/or modified sequence opt11 from anti-influenza_Chain
  source 1..300: mol_type = other RNA
gaactcacacaatccccctcctccctctccgcctccgtcggcgactccgtcaccatcacctgccgcacctccgaacgcatctccacctacctcaactggtaccaacaaaaacccggcaaagccccccgcctactcgtctccggcgcctccaccctccaaggcggcgtcccctcccgcttctccggctccggctccggcaccgccttcaccctcaccatcaactccctccaacccgaagacttcgccacctactactgccaacaatcctactccacccccctcaccttcggcggcggcacc

SEQ ID NO: 58155 - RNA, 300 nt, synthetic construct
  misc_feature 1..300: note = derived and/or modified sequence opt11 from anti-influenza_Chain
  source 1..300: mol_type = other RNA
atgacccaatccccctcctccatgtccgtctccctcggcgacaccgtctccatcacctgccacgcctcccaagacatctccggccacatcggctggctccaacaaaaacccggcaaatccttcaaaggcctcatctaccacggcaccaacctcgaagacggcgtcccctcccgcttctccggctccggctccggcgccgacttctccctcaccatctcctcactcgaatccgaagacttcgccgactactactgcgtccaatacgtccaattcccctggaccttcggcggcggcaccaaa

SEQ ID NO: 58156 - RNA, 306 nt, synthetic construct
  misc_feature 1..306: note = derived and/or modified sequence opt11 from anti-influenza_Chain
  source 1..306: mol_type = other RNA
gacatccaagtcacccaatccccctcctccctctcagcctccgtcggcgaccgcgtcaccatctcctgccgcgcccaatccctctcctcctacctccactggtaccaacaaaaacccggccaaccccccaaactcctcatctacgccgccaccaccctccaatccggcgtcccctcccgcttctccggctccggctccggcaccgacttcaccctcaccatctccaccttccaagccgaagacgtcgccacctactactgccaacaatcccgcaccttcggccaaggcaccaaagtcgaaatcaaa

SEQ ID NO: 58157 - RNA, 306 nt, synthetic construct
  misc_feature 1..306: note = derived and/or modified sequence opt11 from anti-influenza_Chain
  source 1..306: mol_type = other RNA
gacatccaaatgacccaatccccctcctccctctccgcctccgtcggcgaccgcgtcaccatctcctgccgcgcccaatccctctcatcctacctccactggtaccaacaaaaacccggccaaccccccaaactcctcatctacgccgccaccaccctccaatccggcgtcccctcccgcttctccggctccggctccggcaccgacttcaccctcaccatctccaccttccaagcagaagacgtcgccacctactactgccaacaatcccgcaccttcggccaaggcaccaaagtcgaaatcaaa

SEQ ID NO: 58158 - RNA, 309 nt, synthetic construct
  misc_feature 1..309: note = derived and/or modified sequence opt11 from anti-influenza_Chain
  source 1..309: mol_type = other RNA
gacatccaaatcacccaatccccctcctccctctccgcctccgtcggcgaccgcgtcaccatcacctgccgcacctcccaatccctctcctcctacctccactggtaccaacaaaaacccggcaaagcccccaaactcctcatctacgccgcctcctccctccaatccggcgtcccctcccgcttctccggctccggctccggcaccgacttcaccctcaccatctcctccctccaacccgaagacttcgccacctactactgccaacaatcccgcaccttcggccaaggcaccaaagtcgaaatcaaa

SEQ ID NO: 58159 - RNA, 309 nt, synthetic construct
  misc_feature 1..309: note = derived and/or modified sequence opt11 from anti-influenza_Chain
  source 1..309: mol_type = other RNA
gacatccaaatgacccaatccccctcctcactctccgcctccgtcggcgaccgcgtcaccatcacctgccgcacctcccaatccctctcctcctacctccactggtaccaacaaaaacccggcaaagcccccaaactcctcatctacgccgcctcctccctccaatccggcgtcccctcccgcttctccggctccggctcaggcaccgacttcaccctcaccatctcctccctccaacccgaagacttcgccacctactactgccaacaatcccgcaccttcggccaaggcaccaaagtcgaaatcaaa

SEQ ID NO: 58160 - RNA, 309 nt, synthetic construct
  misc_feature 1..309: note = derived and/or modified sequence opt11 from anti-influenza_Chain
  source 1..309: mol_type = other RNA
gacatccaagtcacccaatccccctcctccctctccgcctccgtcggcgaccgcgtcaccatctcctgccgcgcctcccaacgcctcaactcctacctccactggtaccaacaaacccccggccaagcccccaaactcctaatctacgccacctcaaccctccaatccggcgtctcaccccgcttctccggctccggctccggcaccgacttcaccctcaccatctcctccctccaacccgaagacgtcgccacctactactgccaactctcccgcaccttcggccacggcaccaaagtcgaaatcaaa

SEQ ID NO: 58161 - RNA, 309 nt, synthetic construct
  misc_feature 1..309: note = derived and/or modified sequence opt11 from anti-influenza_Chain
  source 1..309: mol_type = other RNA
gacatccaaatgacccaatccccctcctccctctccgcctccgtcggcgaccgcgtcaccatctcctgccgcgcctcccaacgcctcaactcctacctccactggtaccaacaaacccccggccaagcccccaaactcctcatctacgccacctccaccctccaatccggcgtctcaccccgcttctccggctccggctccggcaccgacttcaccctcaccatctcctccctccaacccgaagacgtcgccacctactactgccaactctcccgcaccttcggccacggcaccaaagtcgaaatcaaa

SEQ ID NO: 58162 - RNA, 309 nt, synthetic construct
  misc_feature 1..309: note = derived and/or modified sequence opt11 from anti-influenza_Chain
  source 1..309: mol_type = other RNA
gacatccaagtcacccaatccccctcctccctctccgcctccgtcggcgaccgcatcaccatctcctgccgcacctcccaatccctccgctcctacctccactggtaccaacaaaaacccggcaaagcccccaaactcctcatctacgcctcctccaccctccaatccggcgtcccctcccgcttctccggctccggctccggcaccgacttcaccctcaccatctccaacctccaacccgaagacttcgccacctactactgccaactctcccgcaccttcggccaaggcaccaaagtcgaaatcaaa

SEQ ID NO: 58163 - RNA, 309 nt, synthetic construct
  misc_feature 1..309: note = derived and/or modified sequence opt11 from anti-influenza_Chain
  source 1..309: mol_type = other RNA
gacatccaaatgacccaatccccctcctccctctccgcctccgtcggcgaccgcatcaccatctcctgccgcacctcccaatccctccgctcctacctccactggtaccaacaaaaacccggcaaagcccccaaactcctcatctacgcctcctccaccctccaatccggcgtcccctcccgcttctccggctccggctccggcaccgacttcaccctcaccatctccaacctccaacccgaagacttcgccacctactactgccaactctcccgcaccttcggccaaggcaccaaagtcgaaatcaaa

SEQ ID NO: 58164 - RNA, 309 nt, synthetic construct
  misc_feature 1..309: note = derived and/or modified sequence opt11 from anti-influenza_Chain
  source 1..309: mol_type = other RNA
gacatccaaatgacccaatccccctcctccctctccgcctccgtaggcgaccgcgtcaccatcacctgccgcacctcccaatccctctcctcctacacccactggtaccaacaaaaacccggcaaagcccccaaactcctaatctacgccgcctcctcccgcctctccggcgtcccctcccgcttctccggctccggctccggcaccgacttcaccctcaccatctcctccctccaacccgaagacttcgccacctactactgccaacaatcccgcaccttcggccaaggcaccaaagtcgaaatcaaa

SEQ ID NO: 58165 - RNA, 309 nt, synthetic construct
  misc_feature 1..309: note = derived and/or modified sequence opt11 from anti-influenza_Chain
  source 1..309: mol_type = other RNA
gacatccaaatgacccaatccccctcctccctctccgcctccgtcggcgaccgcgtcaccatcacctgccgcacctcccaatccctctcctcctacacccactggtaccaacaaaaacccggcaaagcccccaaactcctcatctacgccgcctcctcccgcggctccggcgtcccctcccgcttctccggctccggctccggcaccgacttcaccctcaccatctcctccctccaacccgaagacttcgccacctactactgccaacaatcccgcaccttcggccaaggcaccaaagtcgaaatcaaa

SEQ ID NO: 58166 - RNA, 309 nt, synthetic construct
  misc_feature 1..309: note = derived and/or modified sequence opt11 from anti-influenza_Chain
  source 1..309: mol_type = other RNA
gacatccaaatgacccaatccccctcctccctctccgcctccgtcggcgaccgcgtcaccatcacctgccgcacctcccaatccctctcctcatacgaccactggtaccaacaaaaacccggcaaagcccccaaactcctcatctacgccgcctcctcccgcctctccggcgtcccctcccgcttctccggctccggctccggcaccgacttcaccctcaccatctcctccctccaacccgaagacttcgccacctactactgccaacaatcccgcaccttcggccaaggcaccaaagtcgaaatcaaa

SEQ ID NO: 58167 - RNA, 318 nt, synthetic construct
  misc_feature 1..318: note = derived and/or modified sequence opt11 from anti-influenza_Chain
  source 1..318: mol_type = other RNA
gaaatcgtcatgacccaatcccccgacaccctctccgtctcccccggcgaacgcgccaccctctcctgccgcgcctcccaatccgtcaaccgccgcctcgcctggtaccaacaaaaacccggccaagccccccgcctcctcatccacgacgcctccacccgcgccaccggcatccccgcccgattctccggctccggctccggcaccgaattcaccctcaccatctcctccctccaatccgaagacttcgccgtctactactgccaacaatacgacaactggctctccttcggccaaggcacccgcctcgaaatcaaa

SEQ ID NO: 58168 - RNA, 318 nt, synthetic construct
  misc_feature 1..318: note = derived and/or modified sequence opt11 from anti-influenza_Chain
  source 1..318: mol_type = other RNA
gacatccaactcacccaatccccctcctccctatccgcctccgtcggcgaccgcgtcaccatcacctgccgcgcctcccaaggcatcctcaactgcctcgcctggtaccaacaaaaacccggcaaagtccccaacctcctcatgtacgccgcctccaccctccaatccggcgtcccctcccgcttctccggctccggcttcggcaccgacttcaccctcaccatctcctccctccaacccgaagacgtcgccacctactactgccaaacctacggcggcgtctccaccttcggcggcggcaccaaagtcgaaatccgc

SEQ ID NO: 58169 - RNA, 318 nt, synthetic construct
  misc_feature 1..318: note = derived and/or modified sequence opt11 from anti-influenza_Chain
  source 1..318: mol_type = other RNA
tcctacgtcctcacccaacccccctccgtctccgtcgcccccggccaaaccgcccgcatctcctgcggcggctccaacatcggcggcaaatccgtccactggtaccaacaaaaacccggccaagcccccgtcctcgtcgtctacgacgactccggccgcccctccggcatccccgaacgattctccggctccaactccggcgacaccgccaccctcaccatctcccgcgtcgaagccggcgacgaagccgactacttctgccaagtctgggacaacttcggcggcgtcttcggcaccggaaccaaagtcaccgtcctc

SEQ ID NO: 58170 - RNA, 318 nt, synthetic construct
  misc_feature 1..318: note = derived and/or modified sequence opt11 from anti-influenza_Chain
  source 1..318: mol_type = other RNA
gacatccaaatgacccaatccccctcctccctctccgcctccgtcggcgaccgcgtcaccatcacctgccgcacctcccaatccatctcctcctacctcaactggtaccaacaaaaacccggcaaagcccccaaactcctcatctacgccgcctcctccctccaatccggcgtcccctcccgcttctccggctccggctccggcaccgacttcaccctcaccatctccggcctccaacccgaagacttcgcaacctactactgccaacaatcctactccatgcccgccttcggccaaggaaccaaactcgaaatcaaa

SEQ ID NO: 58171 - RNA, 318 nt, synthetic construct
  misc_feature 1..318: note = derived and/or modified sequence opt11 from anti-influenza_Chain
  source 1..318: mol_type = other RNA
gacatccaaatgacccaatcacccctctccgtctccgtctccgtcggcgaccgcgtcaccatcgcctgccgcgcctcccaatccatcgacaaattcctcaactggtaccaacaaaaacccggcaaagcccccaaactcctcatctacggcgcctccaacctccactccggcgccccctcccgcttctccgcctccggctccggcaccgacttcaccctcaccatcaccaacatacaaaccgaagacttcgcaacctacctctgccaacaatccttctccgtccccgccttcggcggcggcaccaaagtcgaaatcaaa

SEQ ID NO: 58172 - RNA, 318 nt, synthetic construct
  misc_feature 1..318: note = derived and/or modified sequence opt11 from anti-influenza_Chain
  source 1..318: mol_type = other RNA
gacatccaaatgacccaatccccctcctccctctccgcctccgtcggcgaccgcgtcaccatcacctgccgcgcctcccaatccatctccacctacctcaactggtaccaaaaacgccccggcaaagcccccaaactcctcgtctacggcgcctccaccctccaatccggcgtcccctcccgcttctccggctccggctccggcaccgacttcaccctcaccatcgcctccctccaacccgaagactccgccacctactactgccaacaaacctactccatccccctcttcggccaaggcacccgcctcgaaatcaaa

SEQ ID NO: 58173 - RNA, 318 nt, synthetic construct
  misc_feature 1..318: note = derived and/or modified sequence opt11 from anti-influenza_Chain
  source 1..318: mol_type = other RNA
gacatccaaatgacccaatcaccctcctccctctccgcctccgtcggcgaccgcgtcaccatcacctgccgcgcctcccaatccatctccacctacctcaactggtaccaaaaacgccccggcaaagcccccaaactcctcgtctacggcgcctcctccctccaatccggcgtcccctcccgcttctccggctccggctccggcaccgacttcaccctcaccatcgcctccctccaacccgaagactccgccgtctactactgccaacaaacctactccatccccctcttcggccaaggcacccgcctcgaaatcaaa

SEQ ID NO: 58174 - RNA, 318 nt, synthetic construct
  misc_feature 1..318: note = derived and/or modified sequence opt11 from anti-influenza_Chain
  source 1..318: mol_type = other RNA
gacatccaaatgacccaatcaccctcctccctctccgcctccgtcggcgaccgcgtcaccatcacctgccgcgcctcccaatccatctcccgctacctcaactggtaccaacaaaaacccggcaaagcccccaaactcctcatctacggcgcctccaccctccaaaacggcgccccctcccgcttctccggctccggatccggcaccgacttcaccctcaccatctcctcactccaacccgaagactccgccacctacctctgccaacaatcctactccgtccccgccttcggcggcggcaccaaagtcgaagtcaaa

SEQ ID NO: 58175 - RNA, 318 nt, synthetic construct
  misc_feature 1..318: note = derived and/or modified sequence opt11 from anti-influenza_Chain
  source 1..318: mol_type = other RNA
ggcatccaaatgacccaatccccctcctccctctccgcctccgtcggcgaccgcgtcaccatcacctgccgcgcctcccaatccatctcccgctacctcaactggtacctccaaaaacccggcaaagcccccaaactcctcatctccggcgcctcctccctccaatccggcgtcccctcccgcttctccggcaccggctccggcaccgaattcaccctcaccatctcctccctccaacccgaagacttcgccacctactactgccaacaaaccttctccatccccctcttcggccaaggcaccaaagtcgaaatcaaa

SEQ ID NO: 58176 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtctccatcacctgccaagcctcccaagacatctcccgctacctcaactggtaccaacaaaaacccggcgaagcccccaaactcctcatctacgacgcctccaacctcgaaaccggcgtcccctcccgcttctccggctccggctccggcaccgacttcaccttcaccatctcctccctccaacccgaagacatcgccacctacttctgccaacaatacggctacctccccctcaccttcggccccggcaccaaagtcgactccaaa

SEQ ID NO: 58177 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccttctccgtctccctcggcgaccgcgtcaccatcacctgcaaagcctccgaagacatctacaaccgcctcgcctggtaccaacaaaaacccggcaacgccccccgcctcctcatctccgacaccaccaacctctggatcggcgtcccctcccgcttctccggctccggctccggcaaagactacaccctctccatcacctccctccaatccgaagacgtcgccacctactactgccaacaatactggtcctcacgcaccttcggcggcggcaccaaactcgaaatcaaacga

SEQ ID NO: 58178 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccttctccgtctccctcggcgaccgcgtcaccatcacctgcaaagcctccgaagacatctacaaccgcgtcgcctggtaccaacaaaaacccggcaacgccccccgcctcctcatgtccgacgccacctccctcggcgccggcgtcccctcccgcttctccggctccggctcaggcaaagaccacaccctctccatcacctcactccaaaccgaagacgtcgccacatactactgccaacaatactggaacacccgcaccttcggcggcggcaccaaactcgaaataaaacgc

SEQ ID NO: 58179 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatcacctgccgcgcctcccaatccatctccacctacctcaactggtaccaacaaaaacccggcatcccccccaaactcctcatcaacgtcgcctcctcactccaatccggcgtcccctcccgcttctccggctccggctccggcaccgacttcaccctcaccatctcctccctccaacccgaagacttcgcctcctactactgccaacaaacctactcctccccccccaccttcggccaaggcaccaaagtcgaaatcaaa

SEQ ID NO: 58180 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcaaccctctccggctccgtcggcgaccgcgtcaccatcacctgccgcgcctcccaaaacatcggcccctggctcgcctggtaccaacaagaatccggcaaagcccccaaactcctcatctcccgcgcctcaatcctcgaatccggcgtcccctcccgcttctccggcaccggcaccggcaccgaattcaccctcaccatctcctccctccaacccgacgacttcgccacctactactgccaacactacaacgcctactggggcaccttcggccaaggcaccaaagtcgaaatcaac

SEQ ID NO: 58181 - RNA, 321 nt, synthetic construct
  misc_feature 1..321: note = derived and/or modified sequence opt11 from anti-influenza_Chain
  source 1..321: mol_type = other RNA
gtcatctggatgacacaatccccctctctcctctccgcctccaccggcgaccgcgtcaccatctcctgccgcatgtcccaaggcatctcctcctacctagcctggtaccaacaaaaacccggcaaagcccccgaactcctcatccacaccgcctacaccctcaaatccggcgtcccctcccgcttctccggctccggctcaggaaaagacttcaccctcaccatatccggcctccaatccgaagacttcgccacctactactgccaacaatactactccttcccctacaccttcggccaaggcaccaaagtcgaaatcaaa

SEQ ID NO: 58182 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtcggcgaccgcgtcaccatcacctgccgcgcctcccaagacgtctccacctggctcgcctggtaccaactcaaacccggcaaagcccccaaactcctcatctacgccgcctcctccctccaatccggcgtcccctcccgcttctccggctccggctccggcaccgacttcaccctcaccgtctcctccctccaacccgaagacttcgccacctactactgccaacaagccaactccttccccttcaccttcggccccggcaccaaagtcgacatcaaa

SEQ ID NO: 58183 - RNA, 321 nt, synthetic construct
  misc_feature 1..321: note = derived and/or modified sequence opt11 from anti-influenza_Chain
  source 1..321: mol_type = other RNA
gacatccaactcacccaatccccctccttcctctccgcctccgtcggcgacggcgtcaccatcacctgccgcgcctcccaagacatctacatctacctagcctggtaccaacaaaaacccggcaaagcccccaaactcctcatctacgccgcctccaccctccaaggcggcgtcccctcccgcttctccggctccggctccggcaccgaattcaccctcaccatcaacaacctccaacccgaagacttcgccacctacttctgccaacaactcaacggctaccccctcaccttcggcggcggcaccaaagtcgaaatcaaa

SEQ ID NO: 58184 - RNA, 321 nt, synthetic construct
  misc_feature 1..321: note = derived and/or modified sequence opt11 from anti-influenza_Chain
  source 1..321: mol_type = other RNA
gatatccagctcacgcaatcgccctcgagcttgagcgcgagcgtgggcgatcgcgtgaccttgacctgtcaagcgagccaggacatacgcaagttcttgaactggtaccagcaaaagcccgggaaagggcccaagctcttgatctatgacgcgagcaatctccagcgcggggtcccgagcaggttctcgggcgggggctcgggcacggactttaccttgatcataagctcgctccagcccgaggacgtgggcacgtactattgccagcaatatgacgggctcccgttcacgttcgggggcgggaccaagctcgagatcaag

SEQ ID NO: 58185 - RNA, 321 nt, synthetic construct
  misc_feature 1..321: note = derived and/or modified sequence opt11 from anti-influenza_Chain
  source 1..321: mol_type = other RNA
gacatccaactaacccaatctccctcctccctctccgcctccatcggcgaccgcgtcaccatcacctgccaagcctcccaagacatccgcaactccctcaactggtacgaacacaaacccggcaaagcccccaaactcctcatccacgacgcctccaacctcgaaaccggcgtcccctcccgcttctccggcggcggctccggcaccgacttcaccctcaccatctcctccctccaacccgaagacttcgccacctactactgccaacaagccaactccttccccctcaccttcggcggcggcaccaaagtcgaaatcaaa

SEQ ID NO: 58186 - RNA, 321 nt, synthetic construct
  misc_feature 1..321: note = derived and/or modified sequence opt11 from anti-influenza_Chain
  source 1..321: mol_type = other RNA
gacatccaactcacccaatccccctcctccctctccgcctccgtcggcgaccgcgtcaccatcacctgccgcgcctcccaaggcatccgcaacgacctcggctggtaccaacaaaaacccggcaacgcccccaaacgcctcatcttcggcgcctcctccctccaatccggcgtcccctcccgcttctcaggctccggctccggcaccgaattcaccctcaccatctcctccctccaacccgaagacttcgccacctactactgcctccaacacaactcctacccctacaccttcggccaaggcaccaaactcgaaatcaaa

SEQ ID NO: 58187 - RNA, 321 nt, synthetic construct
  misc_feature 1..321: note = derived and/or modified sequence opt11 from anti-influenza_Chain
  source 1..321: mol_type = other RNA
gacatccaactcacccaatccccctcctccctctccgcatccgtcggcgaccgcgtcaccatcacctgccgcgcctcacaatccatctcccgctacctcaactggtaccaacaaaaacccggcaaagcccccaaactcctcctcttcgccgcctccaccctcctcgacggcgtcccctcccgcttctccggctccggctccggcaccgacttcaccctcaccatctcctccctccaacccgaagacttcgccacctactactgccaacgcaaccactccccctcctggaccttcggccaaggcacccgcgtcgaaatcaaa

SEQ ID NO: 58188 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatgacatgccgcgcctcccaaaacatccgctcctacctcaactggtaccaacaacgccccggcaccgcccccaaactcctcatctacgccgcctccaccctccactccggcgtcccctcccgcttctccggcggcggctccggcaccgacttcaccctcaccatcaacaacctccaacccgaagacttcgcctcctactactgccaacaatcctacgacaacccccaaaccttcggccaaggcaccaaagtcgaaatcaaa

SEQ ID NO: 58189 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgagtcaccatcacatgccgcgccaaccaagacatcggcatctacctcaactggtaccaacaaaaccccggcaaagtccccaaactcctcctccacggcgcctcctccctccaaggcggcgtcccctcccgattctcagcctccggctccggcaccgacttcaccctcaccatccactccctccaacccgaagacctcgccacctactactgccaacaatcccgccgcctcccctacaccttcggccaaggcacccgcgtcgaactcaaa

SEQ ID NO: 58190 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctccaccctctccgcctccatcggcgaccgcgtcaccatcacctgccgcgcctcccaatccatcgcctcctggctcgcctggtaccaacaaaaacccggcaaagcccccaaactcctcatctacgaagccgtcaacctcgaatccggcgtcccctcccgcttctccggctcaggctccggcaccgacttcaccctcaccatctcctccctccaacccgacgacttcgccacctacttctgccaacactacggcaccatctcccaaaccttcggcggcggcaccaaagtcgaaatcaaa

SEQ ID NO: 58191 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatcacctgccgcgcctcccaatccatctcctcctacctcaactggtaccaacacaaacccggcaaagcccccaaagtcctcatgtacgccgtctccatcctccaatccggcgtcccctcccgcttctccggctccggctccggcgccgacttcaccctcaccatctcctccctccaacccgaagacttcgccacctactactgccaacaatcctactcctcccccctcaccttcggcggcggcaccaaagtcgaaatcaaa

SEQ ID NO: 58192 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatcacctgccgcgcctcccaaaacatcaaacgctacttcaactggtaccaacaaaaacccggcaaagcccccaaactcctcatctacgccgcctccaacctcgaaaacggcgtcccctcccgcttctccggctccggctccggcaccgacttcaccctcaccatctcctccctccaacccgaagacttcgccacctactactgccaacaatccttctccaaatcctggaccttcggccaaggcaccaacgtcgacatcaaa

SEQ ID NO: 58193 - RNA, 321 nt, synthetic construct
  misc_feature 1..321: note = derived and/or modified sequence opt11 from anti-influenza_Chain
  source 1..321: mol_type = other RNA
gacatccaaatgacccaatccccatcctccctctccgcctccgtcggcgaccgcgtcaccatcacctgccgcgcctcccaaaacatctacaaatacctcaactggtaccaacaacgccccggcaaagcccccaaaggcctcatctccgccgcctccggcctccaatccggcgtcccctcccgcttctccggctccggctccggcaccgacttcaccctcaccatcacctccctccaacccgaagacttcgccacctactactgccaacaatcctactccccccccctcaccttcggcggcggcacccgcgtcgaaatcaaa

SEQ ID NO: 58194 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctcctcatccgtcggcgaccgcgtcaccatcacctgccgcgcctcccaatccatcggcgcctacgtcaactggtaccaacaaaaagccggcaaagccccccaagtcctcatcttcggcgcctccaacctccaatccggcgtcccctcccgcttctccggctccggatccggcaccgacttcaccctcaccatctcctccctccaacccgaagacttcgccacctacttctgccaacaaacctactccacccccatcaccttcggccaaggcacccgcctcgaaatcaaa

SEQ ID NO: 58195 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatctcctgccgcgcctcccaatccatctccacctacctcaactggtaccaacaacaacccggcaaagcccccaaagtcctcatcttcggcgccaccaacctccaatccggcgtcccctcccgcttctccggatccggctccggcaccgacttcaccctcaccatctcctccctccaacccgaagacttcgccacctactactgccaacaatcctacaacacccccctcatcttcggccaaggcaccaaactcgaaatcaaa

SEQ ID NO: 58196 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatctcctgccgcgcctcccaatccatctccacctacctcaactggtaccaacaacaacccggcaaagcccccaaagtcctcatctccggcgccaccaacctccaatccggcgtcccctcccgcttctccggctccggctccggcaccgacttcaccctcaccatctcctccctccaacccgaagacttcgccacctactactgccaacaatcctacaacacccccctcatcttcggccaaggcaccaaactcgaaatcaaa

SEQ ID NO: 58197 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcctcaccatcacctgccgcgcctcccaatccatctccacctacctccactggtaccaacaaaaacccggcaaagcccccaaactcctcatctacgccgcctcctccctccaatcaggcgtcccctcccgcttctcaggctcccgctccggcaccgacttcaccctcaccatctcctccctccaacccgacgacttcgccacctactactgccaacaatcctactcaccccccctcaccttcggccccggcaccaaagtcgacatgaaa

SEQ ID NO: 58198 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatcacctgccgcgcctcccaatccatctccaactacctcaactggtaccaacacaaacccggcgaagcccccaaactcctcaactacgccgcctcctccctccaatccggcgtcccctcccgcttctccgcctccggctccggcaccgacttcaccctcaccatctcctccctccaacccgaagacttcgccacctactactgccaacaatcctacaacacccccatcaccttcggacaaggcacccgcctcgaaatcaaa

SEQ ID NO: 58199 - RNA, 321 nt, synthetic construct
  misc_feature 1..321: note = derived and/or modified sequence opt11 from anti-influenza_Chain
  source 1..321: mol_type = other RNA
gacatccaaatgacccaatcaccctcctccctctccgcctccgtcggcgaccgcgtcaccatcacctgccgcgcctcccaatccatctccaactacctcaactggtaccaacacaaacccggcgaagcacccaaactcctcaactacgccgcctcctccctccaatccggcgtcccctcccgattctccgcctccggctccggcaccgacttcaccctctccatctccggcctccaacccgaagacttcgccacctactactgccaacaatcctacaacacccccatcaccttcggccccggcacccgcctcgaaatcaaa

SEQ ID NO: 58200 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcatccctctccgcctccgtcggcgaccgcgtcaccatcacctgccgcgcctcccaatccatctccacctacctcaactggtaccaacaaaaacccggcaaagcccccaaactcctcatctacgccgcctcctccctccactccggcgtcccctcccgcttctccggctccggctccggcaccgacttcgccctcaccatctcctccctccaacccgaagacttcgccacctactactgccaacaatcctactccccccccatcaccttcggccaaggcacccgactcgaaatcaaa

SEQ ID NO: 58201 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcatccgtcggcgaccgcgtcaccatcacctgccgcgcctcccaaaccatctccacctacctcaactggtaccaacaaaaatccggcaaagcccccaaactcctcatctacgccgcctccggcctccaatccggcgtcccctcccgcttctccggctccggctccggcaccgacttcaccctcaccatctcctccctccaacccgaagacttcgccacctacttctgccaacaatcctacaacacccccctcaccttcggccaaggcaccaaagtcgaaatcaaa

SEQ ID NO: 58202 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccctctccgcctccgtcggcgaccgcgtcaccatctcctgccgcgcctcccaatccatctccacctacctcaactggtaccaacaacaacccggcaaagcccccaaagtcctcatctccggcgccaccgacctccaatccggcgtcccctcccgcttctccggctccggctccggcaccgacttcaccctcaccatctcctccctccaacccgaagacttcgccacctactactgccaacaatcctacaacacccccctcatcttcggccaaggcaccaaactagaaatcaaa

SEQ ID NO: 58203 - RNA, 321 nt, synthetic construct
  misc_feature 1..321: note = derived and/or modified sequence opt11 from anti-influenza_Chain
  source 1..321: mol_type = other RNA
gacatccaagtcacccaatccccctcctccctctccgcctccgtcggcgaccgcgtcaccatcacctgccgcgcctcccaaaacatctacaaatacctcaactggtaccaacaacgccccggcaaagcccccaaaggcctcatctccgccgcctcaggcctccaatccggcgtcccctcccgcttctccggctcaggctccggcaccgacttcaccctcaccatcacctccctccaacccgaagacttcgccacctactactgccaacaatcctactccccccccctcaccttcggcggcggcacccgcgtcgacatcaaa

SEQ ID NO: 58204 - RNA, 321 nt, synthetic construct
  misc_feature 1..321: note = derived and/or modified sequence opt11 from anti-influenza_Chain
  source 1..321: mol_type = other RNA
caatccgtcctcacccaacccccctccgaatccgtctcccccggccaaaccgcctccgtcacctgctccggccacaaactcggcgacaaatacgtctcctggtaccaacaaaaacccggccaatcccccgtcctcctcatctaccaagacaaccgccgcccctccggcatccccgaacgcttcatcggctcaaactccggcaacaccgccaccctcaccatctccggcacccaagccctcgacgaagccgactactactgccaagcctgggactcctccaccgccgtattcggcggcggcaccaaactcaccgtcctcggc

SEQ ID NO: 58205 - RNA, 321 nt, synthetic construct
  misc_feature 1..321: note = derived and/or modified sequence opt11 from anti-influenza_Chain
  source 1..321: mol_type = other RNA
gacatccaactcacccaatccccctcctccctctccgcctccgtcggcgaccgcgtcaccatcacctgccgcgcctcccaaggcatctccacctacctcgcctggtaccaacaaaaacccggcaaagtccccaaactcctcatctacgccgcctccaccctccaatccggcgtcccctcccgcttctccggctccggctccggcaccgacttcaccctcaccatctcctccctccaacccgaagacgtcgccacctactactgccaaaaatacaactccgccccctccttcggccccggcaccaaagtcgacatcaaacgc

SEQ ID NO: 58206 - RNA, 321 nt, synthetic construct
  misc_feature 1..321: note = derived and/or modified sequence opt11 from anti-influenza_Chain
  source 1..321: mol_type = other RNA
tccgtcctcacccaacccccctccgcctccggctcccgcggccaatccatcaccatctcctgcaccggctccacctccgacatcggctcctacaactacgtctcctggtaccaacaacaccccggcaccgcccccaaagtcatcctctacgaagtctcccaacgcccctccggcgtccccgaccgcttctccggctccaaatccggcaacaccgccttcctcaccgtctccggcctccaagccgaagacgaagccgactactactgcgcctcctacgccggcaacaacatctacgtcttcggctccggcaccaaagtcacc

SEQ ID NO: 58207 - RNA, 321 nt, synthetic construct
  misc_feature 1..321: note = derived and/or modified sequence opt11 from anti-influenza_Chain
  source 1..321: mol_type = other RNA
tccgccctcacccaacccccctccgcctccggctcccgcggccaatccatcaccatctcctgcaccggctccacctccgacatcggctcctacaactacgtctcctggtaccaacaacaccccggcaccgcccccaaagtcatcctctacgaagtctcccaacgcccctccggcgtccccgaccgcttctccggctccaaatccggcaacaccgccttcctcaccgtctccggcctccaagccgaagacgaagccgactactactgcgcctcctacgccggcaacaacatctacgtcttcggctccggcaccaaagtcacc

SEQ ID NO: 58208 - RNA, 321 nt, synthetic construct
  misc_feature 1..321: note = derived and/or modified sequence opt11 from anti-influenza_Chain
  source 1..321: mol_type = other RNA
gaaatcgtcctcacccaatcccccgccaccctctccctctcccccggcgaacgcgccaccctctcctgccgcgcctcccaatccgtctccaccttcctcgcctggtaccaacaaaaacccggccaagccccccgactcctcatgtacgacgcctccaaccgcgccaccggcatccccgcccgcttctcaggctccggctccggcaccgacttcaccctcaccatctcctccctcgaacccgaagacttcgccatctactactgccaacaacgctcccactggccccccatcttcggccaaggcacccgcctcgaaatcaaa

SEQ ID NO: 58209 - RNA, 321 nt, synthetic construct
  misc_feature 1..321: note = derived and/or modified sequence opt11 from anti-influenza_Chain
  source 1..321: mol_type = other RNA
gacatccaaatgacccaatcccccgcctccctctccgtctccgtcggcgaaaccgtcaccatcacctgccgcgcctcagaaaaaatctactccaacctcgcctggtaccaacaaaaagaaggcaaatccccccaactcctcgtctacgccgccatccgcctcgccgacggcgtcccctcccgcttctccggctccggctccggcacccaattctccctcaaaatcaactccctccaatccgaagacttcggcacctactactgccaacacttctggggcacccccctcaccttcggcgccggcaccaaactcgaactcaaa

SEQ ID NO: 58210 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtcggcgaccgcgtcaccatcacctgccgcgcctcccaagacatctccacctggctcgcctggtaccaacaaaaacccggcaaagcccccaaactcctcatctacgccgcctcctccctccaatccggcgtcccctcccgcttctccggctccggctccggcaccgacttcaccctcaccatctcctccctccaacccgaagacttcgccacctacttctgccaacaagccaactccttcccccccaccttcggccaaggcaccaaactcgaaatcaaa

SEQ ID NO: 58211 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtcggcgaccgcgtcaccatcacctgccgcgcctcccaagacatctccacctggctcgcctggtaccaacaaaaacccggcaaagcccccaaactcctcatctacgccgcctcctccctccaatccggcgtcccctcccgcttctccggctccggctccggcaccgacttcaccctaaccatctcctccctccaacccgaagacttcgccacctacttctgccaacaagccaactccttcccccccaccttcggctgcggcaccaaactcgaaatcaaa

SEQ ID NO: 58212 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtcggcgaccgcgtcaccatcacctgccgcgcctcccaagacatctccacctggctcgcctggtaccaacaaaaacccggcaaatgccccaaactcctcatctacgccgcctcctccctccaatccggcgtcccctcccgcttctccggctccggctccggcaccgacttcaccctcaccatctcctccctccaacccgaagacttcgccacctacttctgccaacaagccaactccttcccccccaccttcggccaaggcaccaaactcgaaatcaaa

SEQ ID NO: 58213 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtcggcgaccgcgtcaccatcacctgccgcgcctcccaagacatctccacctggctcgcctggtaccaacaaaaacccggcaaagcccccaaactcctcatctacgccgcctcctccctccaatccggcgtcccctcccgcttctccggctccggctccggcaccgacttcaccctcaccatctcctccctccaacccgaagacttcgccacctactactgccaacaagccaactccttcccccccaccttcggccaaggcaccaaactcgaaatcaaa

SEQ ID NO: 58214 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtcggcgaccgcgtcaccatcacctgccgcgcctcccaagacatctccacctggctcgcctggtaccaacaaaaacccggcaaagcccccaaactcctcatctacgccgcatcctccctccaatccggcgtcccctcccgcttctccggctccggctccggcaccgacttcaccctcaccatctcctccctccaacccgaagacttcgccacctactactgccaacaagccaactccttcccccccaccttcggctgcggcaccaaactcgaaatcaaa

SEQ ID NO: 58215 - RNA, 321 nt, synthetic construct
  misc_feature 1..321: note = derived and/or modified sequence opt11 from anti-influenza_Chain
  source 1..321: mol_type = other RNA
gacatccaaatgacccaatccccctcctccgtctccgcctccgtaggcgaccgcgtcaccatcacctgccgcgcctcccaagacatctccacctggctcgcctggtaccaacaaaaacccggcaaatgccccaaactcctcatctacgccgcctcctccctccaatccggcgtcccctcccgcttctccggctccggctccggcaccgacttcaccctcaccatctcctccctccaacccgaagacttcgccacctactactgccaacaagccaactccttcccccccaccttcggccaaggcaccaaactcgaaatcaaa

SEQ ID NO: 58216 - RNA, 321 nt, synthetic construct
  misc_feature 1..321: note = derived and/or modified sequence opt11 from anti-influenza_Chain
  source 1..321: mol_type = other RNA
gaaatcgtcctcacccaatcccccgccaccctctccctctcccccggcgaacgcgccaccctctcctgccgcgcatcccgctccatcaccaccttcctcgcctggtaccaacaaaaacccggccaagccccccgcctcctcatctacgacgcctccaaccgcgccaccggcgtccccgcccgattctccggctccggctccggcaccgacttcaccctcaccatcaactccctcgaacccgacgacttcgccatctactactgccaacaacgcgaccactggccccccatcttcggccaaggcacccgcctcgaaatcaaa

SEQ ID NO: 58217 - RNA, 321 nt, synthetic construct
  misc_feature 1..321: note = derived and/or modified sequence opt11 from anti-influenza_Chain
  source 1..321: mol_type = other RNA
gaaatcgtcctcacacaatcccccgccaccctctccctctcccccggcgaacgcgccaccctctcctgccgcgcctcccgctccatcaccaccttcctcgcctggtaccaacaaaaacccggccaagccccccgcctactcatctacgacgcctccaaccgcgccaccggcgtccccgcccgcttctccggctccggctcaggcaccgacttcaccctcaccatcaactccctcgaacccgacgacttcgccatctactactgccaacaacgcgaccactggccccccatcttcggctgcggcacccgcctcgaaatcaaa

SEQ ID NO: 58218 - RNA, 324 nt, synthetic construct
  misc_feature 1..324: note = derived and/or modified sequence opt11 from anti-influenza_Chain
  source 1..324: mol_type = other RNA
gaaatcgtcctcacccaatcccccggcaccctctccctctcccccggcgaacgcgccaccctctcctgccgcgcctcccaaaccgtctcctcctcctacctcgcctggtaccaacaaaaacccggccaagccccccgcctcctcatctacggcgcctcctcccgcgccaccggcatccccgaccgcttctccggatccggctccggcaccgacttcaccctcaccatctcccgactcgaacccgaagacttcgccgtctactactgccaacaatacggcaactccccctacaccttcggccaaggcaccaaactcgaaatcaaa

SEQ ID NO: 58219 - RNA, 324 nt, synthetic construct
  misc_feature 1..324: note = derived and/or modified sequence opt11 from anti-influenza_Chain
  source 1..324: mol_type = other RNA
gaaatcgtcctcacccaatcccccggcaccctctccgtctcccccggcgaacgcgccaccctctcctgccgcgcctcccaatccatctcctccggctacctcgcctggtaccaacaaaaacccggccaagccccccgcctcctcatctacggcgcctcctcccgcgccaccggcatccccgaccgattctccggctccggctccggcaccgacttcaccctcaccatctcccgcctcgaacccgaagacttcgccgtctactactgccaacaatacggcacctccccccaaaccttcggccaaggcaccaaagtcgaaatcaaa

SEQ ID NO: 58220 - RNA, 324 nt, synthetic construct
  misc_feature 1..324: note = derived and/or modified sequence opt11 from anti-influenza_Chain
  source 1..324: mol_type = other RNA
gaagtcgtcctcacccaatcccccggcaccctctccctctcccccggccaacgcgccaccctctcctgccgcgcctcccaatccgtctcctcctcctacctcgcctggtaccaacaaaaacccggccaagccccccgcctcctcatctacgacgcctcaaaccgcgccaccggcatccccgaccgcttctccggctccggctccggcaccgacttcaccctcaccatctcccgcctcgaacccgaagacttcgccgtctactactgccaacaatacggctcctccccctacaccttcggccaaggcaccaaactcgaaatcaaa

SEQ ID NO: 58221 - RNA, 324 nt, synthetic construct
  misc_feature 1..324: note = derived and/or modified sequence opt11 from anti-influenza_Chain
  source 1..324: mol_type = other RNA
gacatccaactcacccaatcaccctcctccctctccgcctccgtcggcgaccgcgtcaccatcacctgccgcgcctcccaaggcatcatcacctacctcaactggtaccaacaaaaacccggcaaagcccccaaactcctcatctacgccacctactccctccaaaacggcgtcccctcccgcttctccggctccggctccggcaccgacttcaccctcaccatctcctccctccaacccgaagacttcgccacctactactgccaacaatcctactcctccctcatgttcaccttcggccaaggcaccaaactcgacatcaaa

SEQ ID NO: 58222 - RNA, 324 nt, synthetic construct
  misc_feature 1..324: note = derived and/or modified sequence opt11 from anti-influenza_Chain
  source 1..324: mol_type = other RNA
gaaaccgtcctcacccaatcacccggcaccctctccctcacccccggcgaacgcgccaccctctcctgccgcgtcggccaatccgtctccggctcccacctcgcctggtaccaacaaaaacccggccaagccccccgcctcctcatctacggcgcctcctcccgcgccaccggcatccccgaccgcttcggcggctcagtctccggcaccgacttcaccctcaccatctcccgcctcgaacccgaagactccgccgtctactactgccaacaatacggcgactcccgctacaccttcggccaaggcaccaaactcgaaatcaaa

SEQ ID NO: 58223 - RNA, 324 nt, synthetic construct
  misc_feature 1..324: note = derived and/or modified sequence opt11 from anti-influenza_Chain
  source 1..324: mol_type = other RNA
gaaatcgtcctcacccaatcccccggcaccctctccctctcccccggcgaacgcgccaccctctcctgccgcgcctcccaatccgtctcctcctcccaactcgcctggtaccaacaaaaacccggccaagccccccgcctcatcatctacggcgcctccacccgcgccaccggcatccccgaccgcttctccggctccggctccggcaccgacttcaccctcaccatcggccgcctcgaacccgaagacttcgccgtcttcttctgccaacaatactccacctccccccccaccttcggccaaggcaccaaagtcgacttcaaa

SEQ ID NO: 58224 - RNA, 324 nt, synthetic construct
  misc_feature 1..324: note = derived and/or modified sequence opt11 from anti-influenza_Chain
  source 1..324: mol_type = other RNA
gacatcgtcctcacccaatcccccggcaccctctccctctcccccggcgaacgagccaccctctcctgccgcgcctcccaatcagtctcctcctcctacctcgcctggtaccaacaaaaacccggccaagccccacgcctcgtcatgtacggcgccgccacccgagccaccggcatccccgaccgcttctccggctccggctccggccccgacttcaccctcaccatctcccgcctcgaacccgaagacttcgccatgtactactgccaacaatacggcaactcccccatcaccttcggccaaggcacccgcctcgaaatcaaa

SEQ ID NO: 58225 - RNA, 324 nt, synthetic construct
  misc_feature 1..324: note = derived and/or modified sequence opt11 from anti-influenza_Chain
  source 1..324: mol_type = other RNA
gaaatcgtactcacccaatcccccgccaccctctccctctcccccggcgaacgcgccaccctctcctgccgcgcctcccaatccgtctcctcctacctcgcctggtaccaacaaaaacccggccaagccccccgcctcctcatctacgacgcctccaaccgcgccaccggcatccccgcccgcttctccggctccggctccggcaccgacttcaccctcaccatctcctccctcgaacccgaagacttcgccgtctactactgccaacaacgctcccactggccccccatcaccttcggccaaggcacccgcctcgaaatcaaa

SEQ ID NO: 58226 - RNA, 324 nt, synthetic construct
  misc_feature 1..324: note = derived and/or modified sequence opt11 from anti-influenza_Chain
  source 1..324: mol_type = other RNA
tcctacgaactcacccaacccccctccgtctccgtctcacccggccaaaccgcccgcatcacctgctccggcgacgccctccccaaacaaaacgcctactggtaccaacaaaaacccggccaagcccccgtcctcctcatctacaaagactccgaacgcccctccggcatccccgaacgcttctccggctcctcctccggcaccaccgtcaccctaaccatctccggcgtccaagccgaagacgaagccgactactactgccaatccgccgactcctccggcacctcctgggtcttcggcggcggcaccaaactcaccgtcctc

SEQ ID NO: 58227 - RNA, 324 nt, synthetic construct
  misc_feature 1..324: note = derived and/or modified sequence opt11 from anti-influenza_Chain
  source 1..324: mol_type = other RNA
tcctacgtactcacccaagccccctccgtctccgtcgcccccggccaaaccgcccgcatcacctgcggcggcaacgccatcggctcaaaaaaagtccactggtaccaacacaaagccggccaagcccccgtcctcgtcgtctacgacgacaccgaccgcccctccggcatccccgaacgcttctccggctccaactcctggtcaaccgccaccctcaccatcaaccgagtcgaagccggcgacgaagccgactactactgccaagtctgggacttcaccatcgaccacgtcgtcttcggcggcggcaccaaactcaccgtcctc

SEQ ID NO: 58228 - RNA, 324 nt, synthetic construct
  misc_feature 1..324: note = derived and/or modified sequence opt11 from anti-influenza_Chain
  source 1..324: mol_type = other RNA
gaaatcgtcctcacccaatcccccggcaccctctccctctcccccggcgaacgcgccaccctctcctgccgcgcctcccaatccgtctcctcctcctacctcgcctggtaccaaaaaaaacccggccaagccccccgcctcctcatctacggcgcctccacccgcgccaccggcatccccgaccgcttcaccggctccggctccggcaccgacttcaccctctccatctcccgcctcgaacccgaagacttcgccgtctactactgccaacacttcggcacctccgtcttcaccttcggcggcggcaccaaagtcgaaatcaaa

SEQ ID NO: 58229 - RNA, 324 nt, synthetic construct
  misc_feature 1..324: note = derived and/or modified sequence opt11 from anti-influenza_Chain
  source 1..324: mol_type = other RNA
gaaatcgtcatgacccaatcccccgccaccctctccgtctcccccggcgaacgcgccaccctctcctgccgcgcctcccaatcagtcggcaactccctcgcctggtaccaacaacgccccggccaagccccccgcctcctcatctacggcgcctcaacccgcgccaccggcatccccccccgcttctcaggctccggctccggcaccgaattcaccctcaccatctcctccctccaaaccgaagacttcgccgtctactactgccaacaatacatcaactggcgccccctctccttcggcggcggcaccaaagtcgaaatcaaa

SEQ ID NO: 58230 - RNA, 324 nt, synthetic construct
  misc_feature 1..324: note = derived and/or modified sequence opt11 from anti-influenza_Chain
  source 1..324: mol_type = other RNA
caagagagcggggccgagctcgtgcgcccgggcgcgagcgtgaaattgagctgtaaagatagcgggtacacgttcacgacctattggatgaactgggtcaagcaaaggcccgagcaagggctcgagtggataggcaggatcgatccctatgactcggaaacgcactataaccagaaatttaaagataaagcgatcttgaccgtggacaagagctcgaacacggcctatatgcagctcagctcattgacctcggaagatagcgcggtctattactgtgtcaggggcgggagcacggtcgcgtactttggcgtgtgggggcaaggg

SEQ ID NO: 58231 - RNA, 324 nt, synthetic construct
  misc_feature 1..324: note = derived and/or modified sequence opt11 from anti-influenza_Chain
  source 1..324: mol_type = other RNA
gagatcgtgctcacgcaatcgcccgggaccttgagcttaagcccgggcgagcgcgcgaccttgagctgtcgcgcaagccagcgcgtgagctcgtacttggcctggtaccagcaaaagcccgggcaagcgcccaggctcttgatctatggcgcgagcacgcgcgcggccgggatcccggacaggttctcgggctcgggctcgggcacggactttaccttgaccataagcaggctcgagcccgaggactcggccgtgtactattgccagcaatatggcaggaccccgctcacgttcgggggcgggaccaaggtcgagatcaagcgc

SEQ ID NO: 58232 - RNA, 324 nt, synthetic construct
  misc_feature 1..324: note = derived and/or modified sequence opt11 from anti-influenza_Chain
  source 1..324: mol_type = other RNA
gagatcgtgatgacgcaatcgcccgggaccttgagcttgagcccgggcgagcgcgcaaccttgagctgtcgcgcgagccagagcgtgagctcgagctatctcgcgtggtatcaacagaaaccgggccaggccccgcgattgctcatattcggggcctcgagcagggccacgggcatacccgatcgctttagcgggagcgggagcgggaccgatttcacgctcacgatctcgcgcttggaaccggaagatttcgcggtctattactgtcaacagtacgggagctcgctcacgttcgggggcgggaccaagctcgagatcaagcgc

SEQ ID NO: 58233 - RNA, 324 nt, synthetic construct
  misc_feature 1..324: note = derived and/or modified sequence opt11 from anti-influenza_Chain
  source 1..324: mol_type = other RNA
gaaatcgtcctctaccaatcccccggcaccctctccctctcccccggcgaacgcgccaccctctcctgccgcgcctcccaacgcgtctcctcctacctcgcctggtaccaacaaaaacccggccaagcaccccgcctcctcatctacggcgcctccacccgcgccgccggcatccccgaccgcttctccggctccggctccggcaccgacttcaccctcaccatctcccgcctcgaacccgaagactccgccgtctactactgccaacaatacggccgcacccccctaaccttcggcggcggcaccaaagtcgaaatcaaacgc

SEQ ID NO: 58234 - RNA, 324 nt, synthetic construct
  misc_feature 1..324: note = derived and/or modified sequence opt11 from anti-influenza_Chain
  source 1..324: mol_type = other RNA
gacatcgtcctcacccaagccccctccgtctccgtctcccccggccaaaccgcctccatcacctgctccggcgaccgcctcggcgaaaaattcgcctcctggtaccaacaaaaacccggccaatcccccgtcctcgtcatctacgaagactccaaacgcccctccggcatccccgaccgcttctccggctccaactccggcaacaccgccaccctcaccatctccggcacccaaatcatggacgaaggcgacttcttctgccaagcctgggactcctccaccgtcgtattcggcggcggcaccaaactcaccgtcctcggccaa

SEQ ID NO: 58235 - RNA, 324 nt, synthetic construct
  misc_feature 1..324: note = derived and/or modified sequence opt11 from anti-influenza_Chain
  source 1..324: mol_type = other RNA
gacatcgaactcacccaatccccctccgtctccgtctcccccggccaaaccgcctccatcacctgctccggcgacaaactcggcgacaaattcgtctgctggtaccaacaaaaagccggccaatcccccatcgtcgtcatctaccaagacgacaaacgcccctccggcatccccgaacgcttctccggctccaactccggcaacaccgccaccctcaccatctccggcacccaagccatggacgaagccgactacttctgccaagcctgggactccaccaccgtcgtcttcggcggcggcaccaaactaaccgtcctcggccaa

SEQ ID NO: 58236 - RNA, 324 nt, synthetic construct
  misc_feature 1..324: note = derived and/or modified sequence opt11 from anti-influenza_Chain
  source 1..324: mol_type = other RNA
caatccgtcctcacccaaccaccctccgcctccggctcccgcggccaatccatcaccatctcctgcaccggctccacctccgacatcggctcctacaactacgtctcctggtaccaacaacaccccggcaccgcccccaaagtcatcctctacgaagtctcacaacgcccctccggcgtccccgaccgcttctcaggctccaaatccggcaacaccgccttcctcaccgtctccggcctccaaaccgacgacgaagccgactactactgcgcctcctacgccggcaacaacatctacgtcttcggctccggcaccaaagtcacc

SEQ ID NO: 58237 - RNA, 327 nt, synthetic construct
  misc_feature 1..327: note = derived and/or modified sequence opt11 from anti-influenza_Chain
  source 1..327: mol_type = other RNA
aacttcatgctcacccaaccccactccgtctccgaatcccccggcaaaaccgtcaccatctcctgcaccggctccggcggcaacatcgcccgcaactacgtccaatggtaccaacaacgccccggctccgcccccgtaaccgtcatcctcgaagacgacaaacgcccctccggcatccccgaccgcttctccggctccatcgaccgctcatccaactccgcctccctcaccatctccggcctccgaaccgaagacgaagccctctactactgccaatcctacgacgactccgacctcgtcgtcttcggcggcggcaccaaactcacc

SEQ ID NO: 58238 - RNA, 327 nt, synthetic construct
  misc_feature 1..327: note = derived and/or modified sequence opt11 from anti-influenza_Chain
  source 1..327: mol_type = other RNA
atgctcgaacccctccaaatcctctccatctgctccttcatcctctccgccctccacttcatggcctggaccatcggccacctcaaccaaatcaaacgcggcgtcaacctcaaaatccaaatccgcaaccccaacaaagaagccatcaaccgcgaagtctccatcctccgccacaactaccaaaaagaaatccaagccaaagaaaccatgaaaaaaatcctctccgacaacatggaagtcctcggcgaccacatcgtcgtcgaaggcctctccaccgacgaaatcatcaaaatgggcgaaaccgtcctcgaagtcgaagaactccaa

SEQ ID NO: 58239 - RNA, 327 nt, synthetic construct
  misc_feature 1..327: note = derived and/or modified sequence opt11 from anti-influenza_Chain
  source 1..327: mol_type = other RNA
gacatccgcctcacccaatcccccgccaccctctccgtctcccccggcgaacgagccaccctctcctgccgcgcctcccactccgtctcccgcaacctcgcctggtaccaacaaaaacccggccgcgccccccgcctcctcgtctacgacacctcctcccgagccaccggcatccccgcccgcttctccggctccggctccggcaccgaattcaccctcaccatctcctccctccaatccgaagacttcgccgtctactactgccaacaatacaacaactggccccgcaccttcggccaaggcaccaaagtcgacatcaaacgcacc

SEQ ID NO: 58240 - RNA, 327 nt, synthetic construct
  misc_feature 1..327: note = derived and/or modified sequence opt11 from anti-influenza_Chain
  source 1..327: mol_type = other RNA
gaaatcgtaatgacacaatcacccggaaccctaagcctaagcccaggcgaacgcgcaaccctgagctgccgcgcaagccaaagcgtaagctcgagctacctcgcatggtaccaacaaaaaccaggccaggccccacgcctactcatatacggggcctcaaccagagccacaggcgtacccgaccgcttccacggaggcggaagcggaaccgacttcacactcacaatctcgcgcctagaaccggaagacttcgcagtctactactgccaacaatacgacacctcaagcggactcacattcggaggcggaaccaaagtcgaaatcaaa

SEQ ID NO: 58241 - RNA, 327 nt, synthetic construct
  misc_feature 1..327: note = derived and/or modified sequence opt11 from anti-influenza_Chain
  source 1..327: mol_type = other RNA
gaaatcgtcatgacccaattccccgccaccctctccgtctcccccggcgaacgagtcaccctatcctgccgcgcctcccaatccgtctccaacaacctcgcctggtaccaacaaaaacccggccaacccccccgactcctcatctacgacgcctccacccgcgccaccggcgtccccgccaaattctccggcaccggctccggcaccgaattcaccctctccatctcctccctccaatccgaagacttcgcagtctactactgccaacaataccacaactggcccccctcctactccttcggcctcggcaccaaactcgaaatcaaa

SEQ ID NO: 58242 - RNA, 327 nt, synthetic construct
  misc_feature 1..327: note = derived and/or modified sequence opt11 from anti-influenza_Chain
  source 1..327: mol_type = other RNA
gaaatcatcctcgcccaatcccccggcaccctctccctatcccccggcgaacgcgccaccctctcctgccgcgcctcccaattcgtctccacccgctcactcgcctggtaccaacaacgccccggccaagccccacgcctcctcatctacggcgcctcatcccgagccaccggcatccccgaccgcttctccggctccggctccggcaccgacttcaccctcaccatctcccgcctagaacccgaagacttcgccgtctactactgccaacactacggctactcaccccgctacgccttcggccaaggctccaaagtcgaaatcaaa

SEQ ID NO: 58243 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccggcaccctctccctctcccccggcgaacgcgccaccctctcctgccgcgcctcccacttcgtcaactaccgctccctcgcctggtaccaacaaacccccggccaagtcccccgcctcctcatctacggcgcctccacccgcgccaccggcatccccgaccgcttctccggctccggctccggcaccgacttcaccctcaccatctcccgcctcgaacccgaagacttcgccgtctacttctgccaacaatacggcggctccccccgctacaccttcggccaaggcacccgcctcgaaatcaaa

SEQ ID NO: 58244 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccggcaccctctccctctcacccggcgaacgcgccaccctctcctgccgcgcctcccacttcgtcatcggacgcgccgtcgcctggtaccaacaaaaacccggccaagccccccgcctcctcatctacggcgcctcctcccgcgccaccggcatccccgaccgcttctccggctccggctccggcaccgacttcacactcaccatctcccgcctcgaaaccgaagacttcgccgtcttctactgccaacactacggctcctccccccgctacgccttcggccaaggcaccaaactcgaaatcaaa

SEQ ID NO: 58245 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccctctcccccggcgaacgcgccaccctctcctgccgcgcatcccaatccgtcggcaactacctcgcctggtaccaacaaaaacccggccaagccccccgcctcctcatctacgactcctccaaccgcgcccccggcatccccgcccgattctccggctccggctccggcaccgacttcaccctcaccatctcctccctcgcccccgaagacttcgccgtctactactgccaacaacgctccaaatggccccccatgtactccttcggccacggcaccaaactcgaaatcaaa

SEQ ID NO: 58246 - RNA, 327 nt, synthetic construct
  misc_feature 1..327: note = derived and/or modified sequence opt11 from anti-influenza_Chain
  source 1..327: mol_type = other RNA
caagccgtcgtcacacaagaaccctccctcaccgtctcccccggcggcaccgtcaccctcacctgcggctcctccaccggccccgtcacctccggccactacccctactggttccaacaaaaacccggccaagccccccgcaccctcatctccgccacctccaacacccactcctggacccccgcccgcttctccggctccctcctcggcggccgcgccgccctcaccctctccggcgcccaacccgaagacgaagccgactactactgcttcctctcctactccggcgcctgggtcttcggcggcggcaccaccctcaccgtcctc

SEQ ID NO: 58247 - RNA, 327 nt, synthetic construct
  misc_feature 1..327: note = derived and/or modified sequence opt11 from anti-influenza_Chain
  source 1..327: mol_type = other RNA
gccatccaaatgacccaatccccctcctccctctccgcctccgtcggcgaccgcgtcaccatcacctgccgcgcctcccaaaacatccgctcctacctcaactggtaccaacaaaaacccggcaaagcccccaacctcctcatctacggcaccacctccctcgaatccggcgtcccctcccgcttctccggctccggctccggcaccgacttcaccctcaccatctcctccctccaacccgaagacttcgccacctactactgccaacaatcataccacaccccccaaaccttcggccaaggcaccaaagtcgaaatcaaacgcacc

SEQ ID NO: 58248 - RNA, 327 nt, synthetic construct
  misc_feature 1..327: note = derived and/or modified sequence opt11 from anti-influenza_Chain
  source 1..327: mol_type = other RNA
gacatccaaatgacccaatccccctcctccctctccgcctccgtcggcgaccgcatcaccatcacctgccgcgcctcccaaggcatcgacaactacctcgcctggttccaacaaaaacccggcaaagtccccgaactcctcatctacgccgcctccaccctccaatccggcgtcccctcccgcttctccggctccggctccggcaccggcttcaccctcaccatctcctccctccaacccgaagacgtcgccacctactactgccaaaaatacgactccgcccccctcaccttcggcggcggcaccaaagtcgacatcaaacgcacc

SEQ ID NO: 58249 - RNA, 327 nt, synthetic construct
  misc_feature 1..327: note = derived and/or modified sequence opt11 from anti-influenza_Chain
  source 1..327: mol_type = other RNA
gacatccaactcacccaatccccctcctccctctccgcctccgtcggcgaccgcgtcaccatcacctgccgcgcctcacaaggcatcaccgactacctcgcctggtaccaacaaaaacccggcaccatccccaaactcctcatctacgccgcctccaccctccaatccggcgtcccctcccgcttctccggcggcggctacggcaccgacttcaccctcaccatctcctccctccaacccgaagacgtcgccacctactactgccaaaaatacaactccgcccccctcaccttcggcggcggcaccaaagtcgaaatcaaacgcacc

SEQ ID NO: 58250 - RNA, 327 nt, synthetic construct
  misc_feature 1..327: note = derived and/or modified sequence opt11 from anti-influenza_Chain
  source 1..327: mol_type = other RNA
gacatcgtcatgacccaatcccccttctccctctcactctcccccggcgaacgcgccaccctctcctgccgcgcctcccaatccatctccaactacctcgcctggtaccaacaaaaacccggccaagccccccgcctcctcatctacgactcctccaaccgcgccaccggcgtccccgcccgcttctcaggctccggctccggcaccgacttcaccctcaccatctcctccctcgaacccgaagacttcgccgtctactactgccaacaacgctccaactggatgtacaccttcggccaaggcaccaaagtcgaaatcaaacgcacc

SEQ ID NO: 58251 - RNA, 327 nt, synthetic construct
  misc_feature 1..327: note = derived and/or modified sequence opt11 from anti-influenza_Chain
  source 1..327: mol_type = other RNA
gacatccaaatgacccaatccccctcctccctctccgcctccgtcggcgaccgcgtcaccatcacctgccgcgcctcccaaggcatctcctcctacctcgcctggtaccaacaaaaacccggcaaagtccccaccctcctcatctacgacgcctccaccctccgatccggcgtcccctcacgcttctccggctccggctccgccaccgacttcaccctcaccatctcctccctccaacccgaagacgtcgccacctactactgccaacgctacaactccgccccccccatcaccttcggccaaggcacccgcctcgaaatcaaacgc

SEQ ID NO: 58252 - RNA, 327 nt, synthetic construct
  misc_feature 1..327: note = derived and/or modified sequence opt11 from anti-influenza_Chain
  source 1..327: mol_type = other RNA
gaaatcgtcatgacccaatcccccggcaccctctccctctcccccggcgaacgcgccaccctctcctgccgcgcctcccaatccgtctcctcctcctacctcgcctggtaccaacaaaaacccggccaagccccccgcctcctcatctacgacgcctcctcccgcgccaccgacatccccgaccgcttctccggctccggctccggcaccgacttcaccctcaccatctcacgcctcgaacccgaagacttcgccgtctactactgccaacaatacggctcctccctctggaccttcggccaaggcaccaaagtcgaaatcaaacgc

SEQ ID NO: 58253 - RNA, 327 nt, synthetic construct
  misc_feature 1..327: note = derived and/or modified sequence opt11 from anti-influenza_Chain
  source 1..327: mol_type = other RNA
tcctacgtcctcacccaacccccctccgtctccgtcgcccccggccaaaccgcccgcatcacctgcggcggcaacaacatcggctccaaatccgtccactggtaccaacaaaaacccggccaagcccccgtcctcgtcgtctacgacgactccgaccgcccctccggcatccccgaacgcttctccggctccaactccggcaacaccgccaccctcaccatctcccgcgtcgaagccggcgacgaagccgactactactgccaagtctgggactcctcctccgaccacgccgtcttcggcggcggcacccaactcaccgtcctcggc

SEQ ID NO: 58254 - RNA, 327 nt, synthetic construct
  misc_feature 1..327: note = derived and/or modified sequence opt11 from anti-influenza_Chain
  source 1..327: mol_type = other RNA
gaaatcgtactcacccaatcccccggcaccctctccctctcccccggcgaacgcgccaccctctcctgccgcgcctcccaatccgtctcctcctcctacctcgcctggtaccaacaaaaacccggccaagccccccgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggctcctccccccgcaccttcggcggcggcaccaaagtcgaaatcaaacgc

SEQ ID NO: 58255 - RNA, 327 nt, synthetic construct
  misc_feature 1..327: note = derived and/or modified sequence opt11 from anti-influenza_Chain
  source 1..327: mol_type = other RNA
tcctacgtcctcacccaacccccctccgtctcagtcgcccccggccaaaccgcccgcatcacctgcggcggcaacaacatcggctccaaaggcgtccactggtaccaacaaaaacccggccaagcccccgtcctcgtcgtctacgacgactccgaccgcccctccggcatccccgaacgcttctccggctccaactccggcaacaccgccaccctcaccatctcccgcgtcgaagccggcgacgaagccgactactactgccaagtctgggactcctcctccgaccacgtcgtcttcggcggcggcaccaaactcaccgtcctcggc

SEQ ID NO: 58256 - RNA, 327 nt, synthetic construct
  misc_feature 1..327: note = derived and/or modified sequence opt11 from anti-influenza_Chain
  source 1..327: mol_type = other RNA
gaaatcgtcctcacacaatcccccggaaccctcagcctcagccccggcgaacgcgcaaccctctcctgccgcgccagccaatccgtcagctcaaactacctcggctggacacaacaaaaaccaggccaagcaccccgcctactcatatacggcgcctcaagccgcgcctccggcatccccgaccgcttcagcggcggcggcagcggcaccgacttcacactcacaatctcacgcctagaaccagaagacttcgccgtctactactgccaacaatacggcagctcacccctaaccttcggcggcggcaccaaagtcgaaataaaaaga

SEQ ID NO: 58257 - RNA, 327 nt, synthetic construct
  misc_feature 1..327: note = derived and/or modified sequence opt11 from anti-influenza_Chain
  source 1..327: mol_type = other RNA
caatccgtcgtcacccaacccccctccgtctccgtcgcccccggccaaaccgcccgcatcacctgcggcggcaacaacatcggctccaaatccgtccactggtaccaacaaaaacccggccaagcccccgtcctcgtcgtctacgacgactccgaccgcccctccggcatccccgaacgattctccggctccaactccggcaacaccgccaccctcaccatctcccgcgtcgaagccggcgacgaagccgactactactgccaagtctgggactcctcctccgaccactacgtcttcggcaccggcaccaaagtcaccgtcctcggc

SEQ ID NO: 58258 - RNA, 327 nt, synthetic construct
  misc_feature 1..327: note = derived and/or modified sequence opt11 from anti-influenza_Chain
  source 1..327: mol_type = other RNA
tcctacgtcctcacccaacccccctccgaatccgtcgcccccggccaaaccgcccgcatcacctgcggcggcaacaacatcggccgcaactccgtccactggtaccaacaaaaacccggccaagcccccgtcctcgtcgtctacgacgactccgaccgcccctccggcatccccgaacgcttctccggatccaaatccggcaacaccgccaccctcatcatctcccgcgtcgaagtcggcgacgaagccgactactactgccaagtctggcactcctcctccgaccactacgtattcggcaccggcaccaaagtcaccgtcctcggc

SEQ ID NO: 58259 - RNA, 327 nt, synthetic construct
  misc_feature 1..327: note = derived and/or modified sequence opt11 from anti-influenza_Chain
  source 1..327: mol_type = other RNA
gaaatcgtcatgacccaatcccccggcaccctctccctctcccccggccaacgcgccaccctctcctgccgcgcctcccaatccgtctcctcctcctacctcgcctggtaccaacaaaaacccggccaagccccccgcctcctcatgtacggcgcctcctcccgcgccaccggcatccccgaccgcttctccggctccggctccggcaccgacttcaccctcaccatctcccgcctagaacccgaagacttcgccgtctactactgccaacaatacggctcctcctccctcaccttcggcggcggcaccaaactcgaaatcaaacgc

SEQ ID NO: 58260 - RNA, 327 nt, synthetic construct
  misc_feature 1..327: note = derived and/or modified sequence opt11 from anti-influenza_Chain
  source 1..327: mol_type = other RNA
caagccggcctcacccaacccccctccgtctccgtcgcacccggccaaaccgcccgcatcacctgcggcggcaacaacatcggctccaaatccgtccactggtaccaacaaaaacccggccaagcccccgtcctcgtcgtctacgacgactccgaccgcccctccggcatccccgaacgcttctccggctcaaactccggcaacaccgccaccctcaccatctcccgcgtcgaagccggcgacgaagccgactactactgccaagtctgggactcatcctccgaccacgtcgtcttcggcggcggcaccaaactcaccgtcctcggc

SEQ ID NO: 58261 - RNA, 327 nt, synthetic construct
  misc_feature 1..327: note = derived and/or modified sequence opt11 from anti-influenza_Chain
  source 1..327: mol_type = other RNA
caatccgtcgtcacccaacccccctccgaatcagtcgcccccggccaaaccgcccgcatcacctgcggcggccacaacatcggctccaactccgtccactggtaccaacaaaaacccggccaagcccccgtcctcgtcgtctacgacaactcagaccgcccctccggcatccccgaacgcttctccggctccaactccggcaacaccgccaccctcaccatctcccgcgtcgaagccggcgacgaagccgactactactgccaagtctggggctcctcctccgaccactacgtcttcggcaccggcaccaaagtcaccgtcctcggc

SEQ ID NO: 58262 - RNA, 327 nt, synthetic construct
  misc_feature 1..327: note = derived and/or modified sequence opt11 from anti-influenza_Chain
  source 1..327: mol_type = other RNA
gaaatcgtcctcacacaatcccccggcaccctctccctctcccccggcgaacgcgccaccctctcctgccgcgcctcccaatccgtctcctccaactacctcggctggtaccaacaaaaacccggccaagccccccgactcctcatctacggagcctcctcccgcgcctccggcatccccgaccgcttctccggcggcggctccggcaccgacttcaccctaaccatctcccgcctcgaacccgaagacttcgccgtctactactgccaacaatacggctcctcccccctcaccttcggcggcggcaccaaagtcgaaatcaaacgc

SEQ ID NO: 58263 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgcgcctcccaatccgtcgactccaacctcgcctggtaccaacaaaaacccggacaagccccccgcctcctcgtctactcagcctcaacccgcgccaccggcatccccgcccgcttctccggctccggctccggcaccgaattcaccctcgccatctcctccctccaatccgaagacttcgccgtctactactgccaacactacaccaactggcccccccgcctcaccttcggcggcggctccaaagtcgaaatcaaa

SEQ ID NO: 58264 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgcgcctcccaatccgtctcccacaacctcgcctggtaccaacaaaaacccggccaagccccccgcctcctcgtctactcagcctccacccgcgccaccggcatccccgcccgcttctccggctccggctccggcaccgaattcaccctcgccatctcctcactccaatccgaagacttcgccgtctactactgccaacactacaccaactaccccccccgcctcaccttcggcggcggctccaaagtcgaaatcaaa

SEQ ID NO: 58265 - RNA, 327 nt, synthetic construct
  misc_feature 1..327: note = derived and/or modified sequence opt11 from anti-influenza_Chain
  source 1..327: mol_type = other RNA
gaaatcgtcatgacccaatcccccgccaccctatccgtctcccccggcgaacgcgccaccctctcctgccgcgcctcccaatccgtcgactccaacctcgcctggtaccaacaaaaacccggccaagccccccgcctcctcgtctactccgcctccacccgcgccaccggcatccccgcccgcttctccggctccggctccggcacagaattcaccctcgccatctcctccctccaatccgaagacttcgccgtctactactgccaacactacaccaactggcccccccgcctcaccttcggcggcggctccaaagtcgaaatcaaa

SEQ ID NO: 58266 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgcgcctcccaatccgtctcctccaacctcgcctggtaccaacaaaaacccggccaagccccccgcctcctcgtctactccgcctcaacccgcgccaccggcatccccgcccgcttctcaggctccggctccggcaccgaattcaccctcgccatctcctccctccaatccgaagacttcgccgtctactactgccaacactacaccaactggcccccccgcctcaccttcggcggcggctccaaagtcgaaatcaaa

SEQ ID NO: 58267 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgcaaccctctccgtctcccccggcgaacgcgccaccctctcctgccgcgcctcccaatccgtcgaccacaacctagcctggtaccaacaaaaacccggccaagccccccgcctcctcgtctactccgcctccacccgcgccaccggcatccccgcccgcttctccggctccggctccggcacagaattcaccctcgccatctcatccctccaatccgaagacttcgccgtctactactgccaacactacaccaactggcccccccgcctcaccttcggcggcggctccaaagtcgaaatcaaa

SEQ ID NO: 58268 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcacccggcgaacgcgccaccctctcctgccgcgcctcccaatccgtctcccacaacctcgcctggtaccaacaaaaacccggccaagccccccgcctcctcgtctactccgcctccacccgcgccaccggcatcccagcccgcttctccggctccggctccggcaccgaattcaccctcgccatctcctccctccaatccgaagacttcgccgtctactactgccaacactacaccaactggcccccccgcctcaccttcggcggcggctccaaagtcgaaatcaaa

SEQ ID NO: 58269 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcacccgccaccctctccgtctcccccggcgaacgcgccaccctctcctgccgcgcctcccaatccgtctcccacaacctcgcctggtaccaacaaaaacccggccaagccccccgcctcctcgtctactccgcctccacccgcgccaccggcatcccagcccgcttctccggctccggctccggcaccgaattcaccctagccatctcctcactccaatccgaagacttcgccgtctactactgccaacactacaccaacttccccccccgcctcaccttcggcggcggctccaaagtcgaaatcaaa

SEQ ID NO: 58270 - RNA, 327 nt, synthetic construct
  misc_feature 1..327: note = derived and/or modified sequence opt11 from anti-influenza_Chain
  source 1..327: mol_type = other RNA
gagatcgtgctcacgcaatcgcccgcgaccttgagcgtgagcccgggcgagcgcgcgaccttgagctgtcgcgcgagccagagcgtggactcgaacctggcctggtaccagcaaaagcccgggcaagcgcccaggctcctggtctatagcgcgagcacgcgcgcgaccgggatcccggccagattctcaggctcgggctcgggcacggaatttaccttggccataagctcgctccagagcgaggactttgccgtgtactattgccagcactataccaatttcccacccaggctcacgttcggaggcgggagcaaggtcgagatcaag

SEQ ID NO: 58271 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgagcctcccaatccgtcgactccaacctcgcctggtaccaacaaaaacccggccaagccccccgcctcctcgtctactccgcctccacccgcgccaccggcatccccgcccgcttctccggctccggctccggcacagaattcaccctcgccatctcctccctccaatccgaagacttcgccgtctactactgccaacactacaccaactaccccccccgcctcaccttcggcggcggctccaaagtcgaaatcaaa

SEQ ID NO: 58272 - RNA, 327 nt, synthetic construct
  misc_feature 1..327: note = derived and/or modified sequence opt11 from anti-influenza_Chain
  source 1..327: mol_type = other RNA
gaaaccaccctcactcaatcccccgccaccctctccgtctcccccggcgaacgcgccaccctctcctgccgcgcctcccaagtcatctcccacaacctcgcctggtaccaacaaaaacccggccaagccccccgcctcctcatctacggcgcctccacccgcgcctccggcatccccgcccgcttctccggctccggctccggcacagactacaccctcaccatcacctccctccaatccgaagacttcgccgtctactactgccaacactactccaactggccaccccgcctcaccttcggcggcggcaccaaagtcgaaatcaaa

SEQ ID NO: 58273 - RNA, 327 nt, synthetic construct
  misc_feature 1..327: note = derived and/or modified sequence opt11 from anti-influenza_Chain
  source 1..327: mol_type = other RNA
gaaatcgtcctaacccaatcccccgccaccctctccgtctcccccggcgaacgcgcaaccctctcctgccgcgcctcccaagtcatctcccacaacctcgcctggtaccaacaaaaacccggccaagccccccgcctcctcatctacggcgcctccacccgcgcctccggaatccccgcccgcttctccggctccggctccggcaccgactacaccctcaccatcacctccctccaatccgaagacttcgccgtctactactgccaacactactccaactggcccccccgcctcaccttcggcggcggcaccaaagtcgaaatcaaa

SEQ ID NO: 58274 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgcgcctcccaagtcatctcccacaacctcgcctggtaccaacaaaaacccggccaagccccccgcctcctcatctacggcgcctccacccgcgcctccggcatccccgcccgcttctccggctccggctccggcaccgactacaccctcaccatcacctccctccaacccgaagacttcgccgtctactactgccaacactactccaactggcccccccgactcaccttcggcggcggcaccaaagtcgaaatcaaa

SEQ ID NO: 58275 - RNA, 327 nt, synthetic construct
  misc_feature 1..327: note = derived and/or modified sequence opt11 from anti-influenza_Chain
  source 1..327: mol_type = other RNA
gaaatcgtcatgacccaatcccccgccaccctctccgtctcccccggcgaacgcgccaccctctcctgccgcgcctcccaagtcatctcccacaacctcgcctggtaccaacaaaaacccggccaagccccccgcctcctcatctacggcgcatccacccgcgcctccggcatccccgcccgcttctccggctccggctccggcaccgactacaccctcaccatcacctccctccaatccgaagacttcgccgtctactactgccaacactactccaactggcccccccgcctcaccttcggcggcggcaccaaagtcgaaatcaaa

SEQ ID NO: 58276 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgcgcctcccaagtcatctcccacaacctcgcctggtaccaacaaaaacccggccaagccccccgcctcctaatctacggcgcctccacccgcgcctccggcatccccgcccgcttctccggctccggctccggcaccgactacaccctcaccatcacctccctccaatccgaagacttcgccgtctactactgccaacactactccaacttccccccccgcctcaccttcggcggcggcaccaaagtcgaaatcaaa

SEQ ID NO: 58277 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctccgtctcccccggcgaacgcgccaccctctcctgccgcgcctcccaagtcatctcccacaacctcgcctggtaccaacaaaaaccaggccaagccccccgcctactcatctacggcgcctccacccgcgcctccggcatccccgcccgcttctccggctccggctccggcaccgactacaccctaaccatcacctccctccaatccgaagacttcgccgtctactactgccaacactactccaactaccccccccgcctcaccttcggcggcggcaccaaagtcgaaatcaaa

SEQ ID NO: 58278 - RNA, 327 nt, synthetic construct
  misc_feature 1..327: note = derived and/or modified sequence opt11 from anti-influenza_Chain
  source 1..327: mol_type = other RNA
gaaatcgtcctcacccaatcccccgccaccctctcagtctcccccggcgaacgcgtcaccctctcctgccgcgcctcccaatccgtcgccaacaacctcgcctggtaccaacaaaaacccggccaatccccccgcctcctcatctacggcgcctccacccgcgacaccggcatccccgcccgcttctccggctccggctccggcaccgaattcaccctcaccatctcctccctccaatccgaagacttcgccgtctactactgccaacaatacaacaactggccccccatgtacaccttcggccaaggcaccaaactcgaaatcaaa

SEQ ID NO: 58279 - RNA, 327 nt, synthetic construct
  misc_feature 1..327: note = derived and/or modified sequence opt11 from anti-influenza_Chain
  source 1..327: mol_type = other RNA
gacatcgtcatgacccaatccccctccaccctctccgcctccgtcggcgaccgcgtcaccatcacctgccgcgcctcccaatccatcggcaactggctcgcctggtaccaacaaaaacccggcaaagcccccaaactcctcatctacaaagtctccaccctcgaatccggcgtcccctcccgcttctcaggctccggctccggcaccgaattcaccctcaccatcaactccctccaacccgacgacttcgccacctactactgccaacgctacacctccaactcccaaggcttcaccttcggccaaggcaccaaactcgaaatcaaa

SEQ ID NO: 58280 - RNA, 327 nt, synthetic construct
  misc_feature 1..327: note = derived and/or modified sequence opt11 from anti-influenza_Chain
  source 1..327: mol_type = other RNA
gacatcgtcatgacccaatcccccgccaccctctccgtctcccccggcgaacgcgccaccctctcctgccgcgcctcccaagtcgtcggcaccaacctcgcctggtaccaacaaaaacccggccaagccccacgcctcctcatctacgccgcctccacccgcgccaccggcatccccgcccgcttctccggctccggcttcggcaccgacttcaccctcaccatctcctccctccaatccgaagacttcgccgtctactactgccaacaatacaacaactggcccctctccttcggcggcggcaccaaagtcgaaatccgccgcacc

SEQ ID NO: 58281 - RNA, 327 nt, synthetic construct
  misc_feature 1..327: note = derived and/or modified sequence opt11 from anti-influenza_Chain
  source 1..327: mol_type = other RNA
gacatccaaatgacccaatccccctcatccctctccgcctccgtcggcgaccgcgtcaccatcgtctgccgcgcctcccaaggcatcaacacccacctccactggtaccaacaaaaaccaggcaaagcccccaaactcctcatctactccgcctccaccctccacaccggcgtcccctcccgcctctccggctccggctccggcaccgacttcaccctctccatctcctccctccaacccgaagacttcgccacctactactgccaacaatcctacaactacccccgcaccttcggccaaggcaccaacgtcgacatcaaacgcacc

SEQ ID NO: 58282 - RNA, 327 nt, synthetic construct
  misc_feature 1..327: note = derived and/or modified sequence opt11 from anti-influenza_Chain
  source 1..327: mol_type = other RNA
gacatcctcatgacccaatccccctcctccctctccgcctccgtcggcgaccgcgtcaccatcacctgccgcgcctcccaagacatccgcaaccgcctcgcctggtaccaacaaaaacccggcaaagcccccaaacgcctcatctacgccgcctcctccctccaatccggcgtcccctcccgcttctccggctccggctccggcaccgaattcaccctcaccatcaactccctccaacccgaagacttcgccacctactactgcctccaacacaactcctacccctggaccttcggccccggcaccaaagtcgaaatcaaacgcacc

SEQ ID NO: 58283 - RNA, 327 nt, synthetic construct
  misc_feature 1..327: note = derived and/or modified sequence opt11 from anti-influenza_Chain
  source 1..327: mol_type = other RNA
gacatcgtcatgacccaatcccccgccaccctctccgtctcccccggcgaaggcgccaccctctcctgccgcgcctcccaaggcatcggctccaacctcgcctggtaccaacacaaacccggccaagccccccgcctcctcatctacgccgcctccacccgcgccaccggcgtccccgcccgcttctccggctccggctccggcaccgaattcaccctcaccatctcctccctccaatccgaagacctcgccgtctacttctgccaacaatacaacacctggcccctcaccttcggcggcggcaccaaagtcgaaatcatccgcacc

SEQ ID NO: 58284 - RNA, 327 nt, synthetic construct
  misc_feature 1..327: note = derived and/or modified sequence opt11 from anti-influenza_Chain
  source 1..327: mol_type = other RNA
gacatcgtcatgacccaatccccctccaccctatccgcctccgtcggcgaccgcgtcaccatcacctgccgcgcctcccaaaccatctaccgctggctcgcctggtaccaacaaaaacccggcaaagcccccaaagtcctcatctacaaagcctccaccctcgaatccggcgtcccctcccgcttctccggctccggctccggcaccgaattcaccctcgccatctcctccctccaacccgacgacttcgccacctactactgccaacaatacaactccttcccctaccgcttcggccaaggcaccaaagtcgaaatcaaacgcacc

SEQ ID NO: 58285 - RNA, 327 nt, synthetic construct
  misc_feature 1..327: note = derived and/or modified sequence opt11 from anti-influenza_Chain
  source 1..327: mol_type = other RNA
gacatcgtcatgacccaatccccctcctccctctccgcctccgtcggcgaccgcgtctccatcacctgccgcgcctcacaaaccatcacccgcttcctcaactggtaccaacaaaaacccggcaaaggccccaaactcctcatctacgccgcctccaccgtccaccgcggcgtcccctcccgcttctccggctccggctccggcaccgacttcaccctcaccatctcctcactccaacccgaagacttcgccacctactactgccaacaatcctactccgcccccttcaccttcggccccggcaccaccgtcgacatccgccgcacc

SEQ ID NO: 58286 - RNA, 327 nt, synthetic construct
  misc_feature 1..327: note = derived and/or modified sequence opt11 from anti-influenza_Chain
  source 1..327: mol_type = other RNA
gacatcgtcatgacccaaccccccgccaccctctccgtctcccccggcgaacgcgccaccctctcctgcggcgcctcccaaggcctcggctccaacctcgcctggtaccaacaaaaacccggccaagccccccgcctcctcatctacgccgcctccacccgcgccaccggcatcaccgcccgcttctccggctccggctccggcaccgaattcaccctcaccatcaactccctccaatccgaagacttcgccctatactactgccaacaatacacctactggcccctcaccttcggcggcggcaccaaagtcgaaatcaaacgcacc

SEQ ID NO: 58287 - RNA, 327 nt, synthetic construct
  misc_feature 1..327: note = derived and/or modified sequence opt11 from anti-influenza_Chain
  source 1..327: mol_type = other RNA
gatatcgtgctcacgcaatcgcccgcgaccttgagcgtgagcccgggcgagcgcgcgaccttgagctgtcgcgcgagccagagcgtgaacaggaacttggcctggttccagcaaatacccgggcaagcgcccaggctcttgatctttgacgcgagcacgcgcgcggccgatatcccggccaggttctcgggcggaggctcgggcgcggaatttaccttgaccgtgagctcgctccagcccgaggactttgccgtgtactattgccagcaatatgacaagtggccgcccgggttcgggcaagggaccaaggtcgagatcaagcgcacg

SEQ ID NO: 58288 - RNA, 330 nt, synthetic construct
  misc_feature 1..330: note = derived and/or modified sequence opt11 from anti-influenza_Chain
  source 1..330: mol_type = other RNA
caatcagtcctcacccaacccccctccgcctccggcgcccccggccaacgcgtcaccctctcctgctccggctccggctccaacatcggctccaacaccgtctcctggtaccaacaactccccggcaccgcccccaaactcctcgtcttcaccaacaaccaacgcccctccggcgtccccgaccgcttctccggctccaaatccggcacctcagcctccctcgccatctccggcctccaatccgaagacgaagccgactactactgcgccgcctgggacgactccctcaacggccaactcttcggcggcggcaccaaactcaccgtcctc

SEQ ID NO: 58289 - RNA, 330 nt, synthetic construct
  misc_feature 1..330: note = derived and/or modified sequence opt11 from anti-influenza_Chain
  source 1..330: mol_type = other RNA
caatccgtcctaacccaacccccctcagtctccgccgcccccggccaacgcgtcaccatctcctgctccggcacctcctccaacatcggcaaaaactacgtctcctggtaccaacaactccccggcgccgcccccaaactcctcatctacgacaacgacaaacgcccctccggcatccccgaccgcttctccggctccaaatccggcacctccgccaccctcggcatcaccggcctccaaaccggcgacgaagccgactactactgcggcacctgggactcctccctctccgtcggcatgttcggcggcggcacccgcctcaccgtcctc

SEQ ID NO: 58290 - RNA, 330 nt, synthetic construct
  misc_feature 1..330: note = derived and/or modified sequence opt11 from anti-influenza_Chain
  source 1..330: mol_type = other RNA
gaaaccaccctcacccaatcccccgccaccctatccgtctcccccggcgaacgcgccaccctctcctgccgcgcctcccaatccgtatcccgcaacctcgcctggtaccaacaaaaacccggccaagccccccgcctcctcatctacggcgcctcctcccgcgccaccggcatccccgaccgcttctccggctccggctccggcaccgacttcaccctcaccatctcccgcctcgaacccgaagacttcgccgtctactactgccaacaatacggctcctcatccatcaccttcggacaaggcacccgcctcgaaatcaaacgcaccgtc

SEQ ID NO: 58291 - RNA, 330 nt, synthetic construct
  misc_feature 1..330: note = derived and/or modified sequence opt11 from anti-influenza_Chain
  source 1..330: mol_type = other RNA
caatcagtcctgacccagcccccgagcgcaagcgggaccccgggccagcgcgtgaccataagctgcagcggaagctcaagcaacatcggaagcaacaccgtaaactggtacaaacaactgcccgggaccgcgcccaggctcctaatctacagcaacgaccagcgcccaagcggagtcccggacagattctcaggctcaaaatcaggcacaagcgcaagcctggccataagcggactccagagcgaagacgaggccaactactactgcgcggcctgggacgacagcctgagcggatgggtattcggaggcggaaccaaactcacagtccta

SEQ ID NO: 58292 - RNA, 330 nt, synthetic construct
  misc_feature 1..330: note = derived and/or modified sequence opt11 from anti-influenza_Chain
  source 1..330: mol_type = other RNA
caatccgccctcacccaaccccgctccgtctccggctcccccggccaatccgtcaccatctcctgcaccggctcctcctccgacgtcggcgcctccaactccgtctcctggtaccaacaacaccccggcaaagcccccaaactcgtcatctacgacgtcaccgaacgcccatccggcgtcccccaccgcttctccggctccaaatccggcaacaccgcctccctcaccgtctccggcctccaacccgaagacgaagccgactacttctgctgcgcctacggcggcaaatacctcgtcgtcttcggcggcggcaccaaagtcaccgtcctc

SEQ ID NO: 58293 - RNA, 330 nt, synthetic construct
  misc_feature 1..330: note = derived and/or modified sequence opt11 from anti-influenza_Chain
  source 1..330: mol_type = other RNA
caatccgcactcacccaacccgcctccgtctccggctcacccggccaatccatcaccatctcctgcaccggcacctcctcagacgtcggcggctacaactacgtctcctggtaccaacaacaccccggcaaagcccccaaactcctcatctacgaagtcaccaactggccctccggcgtctccaaccgcttctccggctccaaatccggaaacaccgcctccctcaccatctccggcctccaagccgaagacgaagccgactactactgctcctcctacgccggctcctccacctgggtcttcggcggcggcacccgcgtcaccgtcctc

SEQ ID NO: 58294 - RNA, 330 nt, synthetic construct
  misc_feature 1..330: note = derived and/or modified sequence opt11 from anti-influenza_Chain
  source 1..330: mol_type = other RNA
caaaccgtcgtcacccaagaaccctccctcaccgtctcccccggcggcaccgtcaccctcacctgcgcctcctccaccggcgccgtcacctcctcctacttccccaactggttccaacaaaaacccggccaagccccccgccccctcatctactccaccaccatccgccactcctggacccccgcccgcttctccggctccctcctcggcggcaaagccgccctaaccctctccggcgtccaacccgaagacgaagccgactactactgcctcctctactccggcggcgaccccgtcgccttcggcggcggcaccaaactcaccgtcctc

SEQ ID NO: 58295 - RNA, 330 nt, synthetic construct
  misc_feature 1..330: note = derived and/or modified sequence opt11 from anti-influenza_Chain
  source 1..330: mol_type = other RNA
caatccgtcctcacccaatccccctccgtctccgccgcccccggccaaaaagtcaccatctcctgctccggctccgactccaacatcggcgactacttcgtctgctggtaccaacacctccccggcaaacccccccaactcctcatctacgaaaacaacaaacgcccctccggcatccccgaccgcttctccggctccaaatcaggcacctccgccaccctcggcatcaccggcatccaaaccggcgacgaagccgactactactgcgccacctgggacggctccctctccgcctgggtcttcggcggcggcaccaaactcaccgtcctc

SEQ ID NO: 58296 - RNA, 330 nt, synthetic construct
  misc_feature 1..330: note = derived and/or modified sequence opt11 from anti-influenza_Chain
  source 1..330: mol_type = other RNA
cagagcgcactcacgcaaccgcgctcggtctcgggctcgcccgggcaatcgatcacgatctcgtgcacgggcgggagctcggacataggcgcgagcaatagcgtgagctggtaccagcaacatcccgggaaagcgcccaagctcgtgatctttgacgtgaccgagcgcccgagcggggtcccgcacaggttctcgggctcgaaatcgggcaataccgcgagcttgaccgtgagcgggctccagcccgatgacgaggccgattacttttgctgtgcctatggcgggaaatatctcgtggtctttggcgggggcacgaaagtgaccgtgctc

SEQ ID NO: 58297 - RNA, 330 nt, synthetic construct
  misc_feature 1..330: note = derived and/or modified sequence opt11 from anti-influenza_Chain
  source 1..330: mol_type = other RNA
caagccgtcgtcacccaagaaccctccctcgccgtatcccccggcggcaccgtcaccctcacctgcggctcctccaccggcgccgtcacccgcggccactacccatactggttccaacaaaaacccggccaagccccccgcgccctcatctacgactccgccggcaaccgccactcctggacccccgcccgcttctccggctccctcctcggcggcaaagccgccctcaccctctccggcgcccaacccgaagacgaagccgaatactactgcctcctctcctactccggcgtctgggtcttcggcggcggcaccaaactcaccgtcctc

SEQ ID NO: 58298 - RNA, 330 nt, synthetic construct
  misc_feature 1..330: note = derived and/or modified sequence opt11 from anti-influenza_Chain
  source 1..330: mol_type = other RNA
gaaatcgtcatgacccaatcccccgccaccctctccgtctcccccggcgaacgcgtcaccctctcctgccgcgcctcccaatccatcaccgacggcctcgcctggtaccaacaaaaatccggccaagccccccgcctcctcatctacggcgcctccacccgcgccaccggcatccccgcccgcttctccggctccggctccggcaccgaattcacactcaccatctcctccctccaatccgaagacttcgccgtctactactgccaacaatacaacaactggccccccgtcaccttcggccaaggcaccaaagtcgaaatcaaacgcacc

SEQ ID NO: 58299 - RNA, 330 nt, synthetic construct
  misc_feature 1..330: note = derived and/or modified sequence opt11 from anti-influenza_Chain
  source 1..330: mol_type = other RNA
tcctcagaactcacccaacccccctccgcctccggcacccccggccaacgcgtcaccatctcctgctccggctccacctccaacatcggctacaaccccgtctcctggtaccaacaagtccccggcaccgcccccaaactcctcatctactccaacaccgaacgcccctccggagtccccgaccgcttctccggctccaaatccggcacctccgcctccctcgccatctccggcctccaatccgaagacgaagccgactactactgcgccgcctgggacgacaccctcaacggccccgtcttcggcggcggcaccaaagtcaccgtcctc

SEQ ID NO: 58300 - RNA, 330 nt, synthetic construct
  misc_feature 1..330: note = derived and/or modified sequence opt11 from anti-influenza_Chain
  source 1..330: mol_type = other RNA
caatccgccctcacccaacccgcctccgtctccggctcccccggccaatccatcaccatctcctgcaccggcacctcctccgacgtcggcggctacaactacgtctcctggtaccaacaacaccccggcgaagcccccaaactcatgatctccgacgtctccaaccgcccctccggcgtctccaaccgcttctccggctccaaatccggcaacaccgcctctctcaccatctccggcctccaagccgaagacgaagccgactactactgcacctcctacacctcctccaacaccctcgtcttcggcggcggcaccaaactcaccgtcctc

SEQ ID NO: 58301 - RNA, 330 nt, synthetic construct
  misc_feature 1..330: note = derived and/or modified sequence opt11 from anti-influenza_Chain
  source 1..330: mol_type = other RNA
caatccgtcctcacccaacccccctccgtctccgccgcccccggacaaaaagtcaccatctcctgctccggctcctcctccaacatcggccacaacttcgtctcctggtaccaacaactccccgccaccgcccccaaactcctcatctacgacaccgacaaacgcccctccggcatccccgaccgcttctccggctccaaatccggcacctccgccaccctcggcatcaccggcctccaaaccggcgacgaagccgactactactgcggcacctgggactcctccctatcctccgtcatcttcggcggcggcaccaaactcaccgtcctc

SEQ ID NO: 58302 - RNA, 330 nt, synthetic construct
  misc_feature 1..330: note = derived and/or modified sequence opt11 from anti-influenza_Chain
  source 1..330: mol_type = other RNA
gacatccaaatgacccaatccccctccaccctctccgcctccgtcggcgaccgcgtcaccatcacctgccgcgcctcacaaaccatcaacaactacctcgcctggtaccaacaaaaacccggcaaagcccccaaactcctcatctacaaagcctcctccctcgaatccggcgtcccctcccgcttctccggctccggctccggcaccgaattcaccctcaccatctcctccctccaacccgacgacttcgccacctactactgccaagaatacaacaacgactcccccctaaccttcggcggcggcaccaaagtcgaaatcaaacgcacc

SEQ ID NO: 58303 - RNA, 330 nt, synthetic construct
  misc_feature 1..330: note = derived and/or modified sequence opt11 from anti-influenza_Chain
  source 1..330: mol_type = other RNA
gacatcgaactcacccaagacccctccgtctccgtcgcccccggccaaaccgcccgcatcccctgcgtccgcttcaacatgggccccacctccgtccactggtaccaacaaaaacccggccaagcccccgtcctcgtcgtctacgacgactccgaccgcccctccggcatccccgaacgcttctccggctccaactccggcgactccgccaccctcaccatctcccgcgtcgaagccggcgacgaagccgactactactgccaagtctgggacatgtcatccgaccgacgcgtcttcggaggcggcaccaccctcaccgtcctcggccaa

SEQ ID NO: 58304 - RNA, 330 nt, synthetic construct
  misc_feature 1..330: note = derived and/or modified sequence opt11 from anti-influenza_Chain
  source 1..330: mol_type = other RNA
gacatcgtcatgacccaatcccccggcaccctctccctctcccccggcgaacgcgccaccctctactgccgcgcctcccaatccgtccgctccggctacctcgcctggtaccaacacaaacccggccaagcccccctcctcctcttctacgacgcctccggccgagccaccggcatccccgaccgcttctccggctccggctccggcaccgacttcacactcaccatctcccgcctcgaacccgaagacttcgccgtctactactgcctccaatacggctcctccccccgcaccttcggccaaggcaccaaagtcgaaatcaaacgcacc

SEQ ID NO: 58305 - RNA, 330 nt, synthetic construct
  misc_feature 1..330: note = derived and/or modified sequence opt11 from anti-influenza_Chain
  source 1..330: mol_type = other RNA
gacatcgtcctcacccaatccccctccttcctatccgcctccgtcggcgaccgcgtcaccatcacctgccgcgcctcccaactcatctcctcctacttcgcctggtaccaacaaaaacccggcaaaccccccaaactcctcatctacgccgcctccaccctccaatccggcgtcccctcccgcttctccggctccggctccggcacccaattctccctcaccatctcctccctccaacccgaagacttcgccacctactactgccaacaactcaactcctacccccccatcaccttcggccaaggcacccgcctcgaaatcaaacgcacc

SEQ ID NO: 58306 - RNA, 330 nt, synthetic construct
  misc_feature 1..330: note = derived and/or modified sequence opt11 from anti-influenza_Chain
  source 1..330: mol_type = other RNA
gacatcaccctcacccaatcccccgccaccctctccgtctcacccggcgaacgcgccaccctctcctgccgcgcctcccaatccgtctcctccaacctcgcctggtaccaacaaaaacccggccaagccccccgcctcctcatctacggcgcctccaaccgcgccaccgacatccccgcccgcttctccggctccggctccggcaccgaattcaccctcaccatctcctccctccaatccgaagacttcgccgtctactactgccaacaattcaacgactggcccttcctcaccttcggcggcggcaccaaagtcgaaatcaaacgcacc

SEQ ID NO: 58307 - RNA, 330 nt, synthetic construct
  misc_feature 1..330: note = derived and/or modified sequence opt11 from anti-influenza_Chain
  source 1..330: mol_type = other RNA
gacatcgtcatgacccaatccccctccttcctctccgcctccgtcggcgaccgcgtcaccatcacctgccgcacctcccaagtcatctcctcctacctcgcctggtaccaacaacgccccggcaaagcccccaaactcctcatctacgccgcctccaccctccaatccggcgtcccctcccgcttctccggctccggctccggcacccgcttctccctcaccatctcaaacctccaacccgaagacttcgccacatacttctgccaacaactcaccacctacccccccatcaccttcggccaaggcacccgcctcgaaatcaaacgcacc

SEQ ID NO: 58308 - RNA, 330 nt, synthetic construct
  misc_feature 1..330: note = derived and/or modified sequence opt11 from anti-influenza_Chain
  source 1..330: mol_type = other RNA
gacatagtcttgacccagagcccgagcgtgagcgtggccccgggccagaccgcgcgcataacctgtggcgggaacgatatcgggagcaagagcgtgcactggtaccagcaaaagcccgggcaagcgcccgtgctcgtggtctttgacgatcgcgatcgcccgagcgggatcccggaaaggttctcgggctcgaactcgggcaataccgcgaccctgaccataagcagggtcgaggccggggacgaggccgattactattgccaggtctgggacataacctcggacttggtcgtgttcgggggcgggaccaagctcacggtcgtgggccag

SEQ ID NO: 58309 - RNA, 330 nt, synthetic construct
  misc_feature 1..330: note = derived and/or modified sequence opt11 from anti-influenza_Chain
  source 1..330: mol_type = other RNA
gacatcgtcatgacccaaccccccggcaccctctccgtctcccccggcgaacgcgccaccctctcatgccgcgcctcccaatccgtctccaccaacctcgcctggtaccaacaaaaacccggccaagccccccgcctcctcatccacggcgcctccacccgcgccaccggcatccccgcccgcttctccggctccggctccggcgccgaattcaccctcaccatctcctccctccaatccgaagacgtcgccgtctactactgccaacaatacgacaactggctccccatcaccttcggccccggcaccaaagtcgacatccaacgcacc

SEQ ID NO: 58310 - RNA, 330 nt, synthetic construct
  misc_feature 1..330: note = derived and/or modified sequence opt11 from anti-influenza_Chain
  source 1..330: mol_type = other RNA
gaccccatgctcacgcaaacggcctcgcccgtgagcgcggccgtgggcgggaccgtgaccataaactgccaagcgagccagagcgtgtacaacaaaaacaacctggcctggtaccagcaaaagctcgggcaaccgcccaagctcctgatctacgccgcgagcacgctcacgagcggggtcccgagcagattcaaaggctcaggctcaggcacacaattcaccctgaccataagcgacctcgagtgcgacgacgcagccacatactactgcgcaggcgactactcgggcgggatctacgccttcggcggaggcacaaaagtagaaataaaa

SEQ ID NO: 58311 - RNA, 330 nt, synthetic construct
  misc_feature 1..330: note = derived and/or modified sequence opt11 from anti-influenza_Chain
  source 1..330: mol_type = other RNA
gagctcgtgatgacgcaaacgcccgcgagcgtgagcgcggccgtgggcgggaccgtgaccataagctgtcaatcgagcgagagcgtgtacaagaacaataacttggcctggttccagcaaaagctcgggcaaccgcccaagctcttgatctatgacgcgagcaagctcgcgagcggagtcccgagcaggttctcgggctcgggctcgggcacgcaatttaccttgaccataagcgatctcgagtgcgatgacgcggccacgtactattgcgcgggcgattactcgggctcgaactatgcctttggcgggggcacgaaattggaaataaaa

SEQ ID NO: 58312 - RNA, 330 nt, synthetic construct
  misc_feature 1..330: note = derived and/or modified sequence opt11 from anti-influenza_Chain
  source 1..330: mol_type = other RNA
gagcccatgctcacgcaaacggcctcgagcgtaagcgcggccgtgggcgggagcgtgaccataagctgtcaatcgagccagagcgtggactcgaacaatcaattgagctggtaccagcaaaagcccgggcaaccgcccaagctcctgatctatgccgcgagcacgctcacgagcggggtcccgagcaggttcaagggctcgggctcaggcacgcaatttaccttgaccataagcgatctcgagtgcgatgacgcggccacgtactattgcgcgggcgattactcgggcgggatctatgcctttggcgggggcacggaagtggtcgtgaaa

SEQ ID NO: 58313 - RNA, 330 nt, synthetic construct
  misc_feature 1..330: note = derived and/or modified sequence opt11 from anti-influenza_Chain
  source 1..330: mol_type = other RNA
gatcccatgctaacgcaaacggccgcgagcgtgagcgcggccgtgggcgggaccgtgaccataagctgtcaatcgagcgagagcgtgtacaagaacaataacttggcctggttccagcaaaagctcgggcaaccgcccacgctcttgatctgggacgcgagcaagctcgcgagcggggtcccgagcaggttctcgggctcgggctcgggcacgcaatttaccttgaccataagcgatctcgagtgcgatgacgcggccacgtactattgcgcgggcgattactcgggcgtgaactatgcctttggcgggggcacggaagtggtcgtgaaa

SEQ ID NO: 58314 - RNA, 330 nt, synthetic construct
  misc_feature 1..330: note = derived and/or modified sequence opt11 from anti-influenza_Chain
  source 1..330: mol_type = other RNA
gagctcgtgatgacgcaaacgcccgcgagcgtgagcgcggccgtgggcgggaccgtgaccataagctgtcaatcgagcgagagcgtgtacaagaacaataacttggcctggttccagcaaaagctcgggcaaccgcccaagctcttgatctatgacgcgagcaagctcgcgagcggggtcccgagcaggttctcgggctcgggctcgggcacgcaatttaccttgaccataagcgatctcgagtgcgatgacgcggccacgtactattgcgcgggcgattactcgggctcgaactatgcctttggcgggggcacggaagtggtcgtgaaa

SEQ ID NO: 58315 - RNA, 330 nt, synthetic construct
  misc_feature 1..330: note = derived and/or modified sequence opt11 from anti-influenza_Chain
  source 1..330: mol_type = other RNA
gaccccatgctcacccaaaccgcctcctccgtctccgccaccgtcggcggcaccgtcaccatctcctgccaatcctcccaatccgtcgacaacaacaaagacctcgcctggttccaacaaaaacccggccactcccccaaactcctcatctacttcgcctcccgcctcgcctccggcgtcccctcccgcttcaaaggctccggctccggcacccacttcaccctcaccatctccgacctcgaatgcgacgacgccgccacctactactgcgccggcgactactccggcgccaactacgccttcggcggcggcaccaaactagaaatcaaa

SEQ ID NO: 58316 - RNA, 330 nt, synthetic construct
  misc_feature 1..330: note = derived and/or modified sequence opt11 from anti-influenza_Chain
  source 1..330: mol_type = other RNA
gaccccatgctcacccaaaccgcctcccccgtctccgccgccgtcggcggcaccgtcaccatcaactgccaatcctcccaatccgtctacaacaacaaccgcctctcctggttccaacaaaaacccggccaaccccccaaactcctcatctactccgcctcaaccctcgcctccggcgtctcctcccgcttcaaaggctccggctccggcacccaattcaccctcaccatctccgacctcgaatgcgacgacgccgccacctactactgcgccggcgactactccggcggcatctacgccttcggcggcggcaccgaactcgaaatactc

SEQ ID NO: 58317 - RNA, 330 nt, synthetic construct
  misc_feature 1..330: note = derived and/or modified sequence opt11 from anti-influenza_Chain
  source 1..330: mol_type = other RNA
gagctcgtgctcacgcaaacgcccgcgagcgtgagcgcggccgtgggcgggaccgtgagcataagctgtcaatcgagccagagcgtgtacaagaacaataacttggcctggttccagcaaaagctcgggcaaccgcccacgctcttgatctgggacgcgagcaagctcgcgagcggggtcccgagcaggttctcgggctcgggctcgggcacgcaatttaccttgaccataagcgatctcgagtgcgatgacgcggccacgtactattgcgcaggcgattactcgggcgtgaactatgcctttggcgggggcacgaaattggaaataaaa

SEQ ID NO: 58318 - RNA, 330 nt, synthetic construct
  misc_feature 1..330: note = derived and/or modified sequence opt11 from anti-influenza_Chain
  source 1..330: mol_type = other RNA
gagctcgatctcacgcaaacgcccgcaagcgtgagcgcggccgtgggcgggaccgtgaccataagctgtcaatcaagcgagagcgtgtacaagaacaataacttggcctggttccagcaaaagctcgggcaaccgcccacgctcttgatctgggacgcgagcaagctcgcgagcggggtcccgagcaggttctcgggctcaggctcgggcacgcaatttaccttgaccataagcgatctcgagtgcgatgacgcggccacgtactattgcgcgggcgattactcgggcgtgaactatgcctttggcgggggcacggaagtggtcgtgaaa

SEQ ID NO: 58319 - RNA, 330 nt, synthetic construct
  misc_feature 1..330: note = derived and/or modified sequence opt11 from anti-influenza_Chain
  source 1..330: mol_type = other RNA
gatatccagatgacacaatcgccctcgagcctgagcgcgagcgtaggcgatcgcgtgaccataacctgtcaatcgagcgagagcgtgtacaagaacaataacttggcctggtaccagcaaaagcccggaaaaccgcccaagctcctgatctgggacgcgagcaagctcgcgagcggggtcccgagcaggttctcgggctcgggctcgggcacggacttcaccctgaccataagctcgctccagcccgaggacgtggccacgtactattgcgcgggcgattactcgggcgtgaactatgcctttggcggaggcacggaagtggtcgtgaaa

SEQ ID NO: 58320 - RNA, 333 nt, synthetic construct
  misc_feature 1..333: note = derived and/or modified sequence opt11 from anti-influenza_Chain
  source 1..333: mol_type = other RNA
gacatcgtcatgacccaatcccccgactccctcgccgtctccctcggcgaacgcgccaccatcaactgcaaatcctcccaatccgtcaccttcaacaacaaaaactacctcgcctggtaccaacaaaaacccggccaaccccccaaactcctcatctactgggcctccacccgcgaatccggcgtccccgaccgcttctccggctccggctccggcaccgacttcaccctcaccatctcctccctacaagccgaagacgtcgccgtctactactgccaacaacactaccgcaccccccccaccttcggccaaggcaccaaagtcgaaatcaaa

SEQ ID NO: 58321 - RNA, 333 nt, synthetic construct
  misc_feature 1..333: note = derived and/or modified sequence opt11 from anti-influenza_Chain
  source 1..333: mol_type = other RNA
caatccgccctcacccaacccgcctccgtctccggctcccccggccaatccatcaccatctcctgcaccggcaccggctccgacgtcggctcctccaacctcgtctcctggtaccaacaacaccccgccaaagcccccaaactcatcatctacgaagtcaccaaacgcccctccggcgtctccaaccgcttctccggctccaaatccggaaacaccgcatccctcaccatctccggcctccaagccgaagacgaagccgactactactgctgctcctacgccggctcctcctcctcccgcgtcttcggcaccggcaccaaagtcaccgtcctc

SEQ ID NO: 58322 - RNA, 333 nt, synthetic construct
  misc_feature 1..333: note = derived and/or modified sequence opt11 from anti-influenza_Chain
  source 1..333: mol_type = other RNA
caatccgtcctcacccaacccccctccgcctccggcacccccggccaacgcgtcaccatctcctgctccggctccacctcaaacatcggctccaacgccgtcaactggtaccaacaactccccggcaccgcccccaaactcctcatctactccaacaaccaacgcccctccggcgtccccgaccgcttctccggctccaaatccggcacctccgcctccctcgccatctccggcctccaatccgaagacgaagccgactactactgcgccgcctgggacgactccctctccggctcctgggtcttcggcggcggcaccaaactcaccgtcctc

SEQ ID NO: 58323 - RNA, 333 nt, synthetic construct
  misc_feature 1..333: note = derived and/or modified sequence opt11 from anti-influenza_Chain
  source 1..333: mol_type = other RNA
gaaaccaccctcacccaatcacccggcaccctctccctctcccccggcgaacgcgccaccctctcctgccgcgtctcccaatccgtctcctccaactacctcgcctggtaccaacaaaaacccggccaagccccccgcctcctcatctacggcgcctcctcccgcgccaccggcatccccgaccgcttctccggctccggctccggcacagacttcaccctcaccatctcccgcctcgaacccgaagacttcgccgtctactactgccaacaatacggcacctccccccgcgccttcggccacggcaccaaagtcgaaatcaaacgcaccgtc

SEQ ID NO: 58324 - RNA, 333 nt, synthetic construct
  misc_feature 1..333: note = derived and/or modified sequence opt11 from anti-influenza_Chain
  source 1..333: mol_type = other RNA
caatccgtcctcacccaacccccctccgtctccggcgcccccggccaacgcgtcaccatctcatgcggcggctcccgctcaaacatcggcgccggctacgacgtccactggtaccaacaattccccggcaccgcccccaaagtcgtcatctacggcaacaacaaccgcccctccggcgtccccgaccgcttctccggctccaaatccggcacctccgcctccctcgccatcaccggcctccaagccgaagacgaagccaactactactgccaatcatacgacaccaacctcggcggctccatcttcggcggcggcacccaagtcaccgtcctc

SEQ ID NO: 58325 - RNA, 333 nt, synthetic construct
  misc_feature 1..333: note = derived and/or modified sequence opt11 from anti-influenza_Chain
  source 1..333: mol_type = other RNA
aacttcatgctcacccaaccccactccgtctccgaatcccccggcaaaaccgtcaccatctcctgcaccggatcctccggctccatcgcctccaactacgtccaatggtaccaacaacgccccggctccgcccccaccaccgtcatctacgaagactaccaacgcccctccggcgtccccgaccgcttctccggctccatcgactcctcctccaactccgcctccctcaccatctccggcctcaaaaccgaagacgaagccgactactactgccaatcctacgacgactccgaccacctcatcttcggcggcggcaccaaactcaccgtcctc

SEQ ID NO: 58326 - RNA, 333 nt, synthetic construct
  misc_feature 1..333: note = derived and/or modified sequence opt11 from anti-influenza_Chain
  source 1..333: mol_type = other RNA
caatccatgctcacccaacccccctccgcctccggcacccccggccaacgcgtcactatctcctgctccggctcctcctccaacatcggctccaacaccgtcaactggttcaaacacctccccggcaccgcccccaaactcctcatctaccgcaacgacctccgcccctccggcgtccccgaccgcttctccggctccaaatccggcacctccgcctccctcgccatctccggcctccaatccgaagacgaagccgactactactgcgccacctgggacgactccctcaacggattctacgtcttcggcaccggcaccaaagtcaccgtcctc

SEQ ID NO: 58327 - RNA, 333 nt, synthetic construct
  misc_feature 1..333: note = derived and/or modified sequence opt11 from anti-influenza_Chain
  source 1..333: mol_type = other RNA
gacatccaactcacccaatccccctcctccctctccgcatccgccggcgaccgagtctccatgacctgccgcgcctcccaaatcatctcctcctccctcaactggtaccaacaaaaacccggcaaagcccccaaactcctcatatacgccgcctccaacctccaatccggcgtcccctcccgcttctccggctccggctccggcaccgacttcaccctcaccatctcctccctccaacccgaagacttcgccacctactactgccaacaatcctactccaccccccccgaactcaccttcggcggcggcaccaaagtcgacatcaaacgcacc

SEQ ID NO: 58328 - RNA, 333 nt, synthetic construct
  misc_feature 1..333: note = derived and/or modified sequence opt11 from anti-influenza_Chain
  source 1..333: mol_type = other RNA
tcctacgtcctcacccaacccccctccgcctccggcacccccggccaacgcgtcaccatctcctgctccggctccaccttcaacatcggctccaacgccgtcgactggtaccgccaactccccggcaccgcccccaaactcctcatctactccaacaaccaacgcccctccggcgtccccgaccgcttctccggctcccgctccggcacctccgcctccctcgccatctccggcctccaatccgaagacgaagccgactactactgcgccgcctgggacgacatcctcaacgtccccgtcttcggcggcggcaccaaactcaccgtcctcggc

SEQ ID NO: 58329 - RNA, 333 nt, synthetic construct
  misc_feature 1..333: note = derived and/or modified sequence opt11 from anti-influenza_Chain
  source 1..333: mol_type = other RNA
caatccgccctcacccaacccgccgccgtctccggctcccccggccaatccatcaccatctcctgcaccggcacctcctccgacgtcggcggctacaactacgtctcctggtaccaacaacaccccggcaaagcccccaaactcatgatctacgaagtctccaaccgcccctccggcgtctccaaccgcttctccggctccaaatccggcaacaccgcctccctcaccatctccggcctccaagccgaagacgaagccgactactactgctcctcctacacctcctcctccacctacgtcttcggcaccggcaccaaagtcaccgtcctcggc

SEQ ID NO: 58330 - RNA, 333 nt, synthetic construct
  misc_feature 1..333: note = derived and/or modified sequence opt11 from anti-influenza_Chain
  source 1..333: mol_type = other RNA
tcctacgtcctcacccaacccccctccgtctccggcacccccggccaacgcgtcaccatctcctgctccggctcccgctccaacgtcggcgacaactccgtctactggtaccaacacgtccccgaaatggcccccaaactcctcgtctacaaaaacacccaacgcccctccggcgtccccgcccgcttctccggctccaaatccggcacctccgcctccctcgccatcatcggcctccaatccggcgacgaagccgactactactgcgtcgcctgggacgactccgtcgacggctacgtcttcggctccggcaccaaagtcacagtcctcggc

SEQ ID NO: 58331 - RNA, 333 nt, synthetic construct
  misc_feature 1..333: note = derived and/or modified sequence opt11 from anti-influenza_Chain
  source 1..333: mol_type = other RNA
tccgtcctcacccaaccaccctccgtctccgccgcccccggccaaaaagtcaccatctcctgctccggctcctcctccaacatcggcaacgactacgtctcctggtaccaacaactccccggaaccgcccccaaactcctcatctacgacaacaacaaacgcccctccggcatccccgaccgcttctccggctccaaatccggcacctccgccaccctcggcatcaccggcctccaaaccggcgacgaagccaactactactgcgccacctgggaccgccgccccaccgcctacgtcgtcttcggcggcggcaccaaactaaccgtcctcggc

SEQ ID NO: 58332 - RNA, 333 nt, synthetic construct
  misc_feature 1..333: note = derived and/or modified sequence opt11 from anti-influenza_Chain
  source 1..333: mol_type = other RNA
caatccgccctcacccaaccccgctccgtctccggctcccccggccaatccgtcaccatctcctgcaccggcacctcctccgacgtcggcggctacaactacgtctcctggtaccaacaacaccccggcaaagcccccaaactcatgatctacgacgtctccaaacgcccctccggcgtccccgaccgcttctccggctccaaatccggcaacaccgcctccctcaccatctccggcctccaagccgaagacgaagccgactactactgctcctcctacacctcctcctccacccacgtcttcggcaccggcaccaaagtcaccgtcctcggc

SEQ ID NO: 58333 - RNA, 333 nt, synthetic construct
  misc_feature 1..333: note = derived and/or modified sequence opt11 from anti-influenza_Chain
  source 1..333: mol_type = other RNA
tcctacgtcctcacccaaccaccctcagcctccggcacccccggccaacgcgtcaccatctcctgctccggctcctcctcaaacatcggctccaactacgtctactggtaccaacaactccccggcaccgcacccaaactcctcatctaccgcgacggccaacgcccctccggcgtccccgaccgcttctccggctcaaaatccggcacctccgcctccctcgccatctccggcctccgctccgacgacgaagccgactactactgcgccacctgggacgacaacctctccggccccgtcttcggcggcggcaccaaactcaccgtcctcggc

SEQ ID NO: 58334 - RNA, 333 nt, synthetic construct
  misc_feature 1..333: note = derived and/or modified sequence opt11 from anti-influenza_Chain
  source 1..333: mol_type = other RNA
caatccgccctcacccaacccgcctccgtctccggctcccccggccaatccatcacaatctcctgcaccggcacctcctccgacgtcggcggctacaactacgtctcctggtaccaacaacaccccggcaaagcccccaaactcatgatctacgaagtctccaaccgcccctccggcgtctccaaccgcttctccggctccaaatccggcaacaccgcctccctcaccatctccggcctccaagccgaagacgaagccgactactactgctcctcctacacctcctcatccaccctagtcttcggcaccggcaccaaagtcaccgtcctcggc

SEQ ID NO: 58335 - RNA, 333 nt, synthetic construct
  misc_feature 1..333: note = derived and/or modified sequence opt11 from anti-influenza_Chain
  source 1..333: mol_type = other RNA
accgtgctaacgcaaccgccctcggtctcgggcgcgcccgggcaaagggtcacgatctcgtgcacgggctcgagctcgaacattggcgcgggctatgacgtgcactggtaccagcaattgcccgggaccgcgcccaagctcttgatctatggcaatagcaatcgcccgagcggggtcccggacaggttctcgggctcgaaatcaggcacgagcgcaaccttgggcataaccgggctccagaccggggacgaggccgattactattgcgggacctgggactcgagcttgagcgcgtacgtgttcgggaccgggaccaaggtcacggtcttgggc

SEQ ID NO: 58336 - RNA, 333 nt, synthetic construct
  misc_feature 1..333: note = derived and/or modified sequence opt11 from anti-influenza_Chain
  source 1..333: mol_type = other RNA
gggagcgcgctcacgcaaccgcgctcggtctcgggctcgcccgggcaatcggtcacgatctcgtgcacgggcacgagctcggacgtgggcgggtacaattacgtgagctggtaccagcaacatcccgggaaagcgcccaagctcatgatctatgacgtgagcaagcgcccgagcggggtcccggacaggttctcgggctcgaaatcgggcaataccgcgagcttgaccataagcgggctccaggccgaggacgaggccgattactattgctcgagctatacctcgagctcgacccatgtctttggcacgggcacgaaagtgaccgtgctcggg

SEQ ID NO: 58337 - RNA, 333 nt, synthetic construct
  misc_feature 1..333: note = derived and/or modified sequence opt11 from anti-influenza_Chain
  source 1..333: mol_type = other RNA
gaaatcgtcctcacccaatcccccggcaccctctcactctcccccggcgaacgcgccaccctctcctgccgcgcctcccaatccgtctcctcctcctacctcgcctggtaccaacaaaaacccggccaagcaccccgcctactcatcttcggcgcctccacccgcgccaccggcatccccgaccgcttctccggctccggctccggcaccgacttcaccctcaccatctcccgcctcgaacccgaagacttcgccgtcttctactgccaacaatacggctccctacccctcaccttcggcggcggcaccaaagtcgaaatcaaaggcaccgtc

SEQ ID NO: 58338 - RNA, 333 nt, synthetic construct
  misc_feature 1..333: note = derived and/or modified sequence opt11 from anti-influenza_Chain
  source 1..333: mol_type = other RNA
gaaatcgtcctaacccaatcccccggcaccctctccctctcccccggcgaacgcgccaccctctcctgccgcgcctcccaatccgtccgctccaacaacctcgcctggtaccaacacaaacccggccaagccccccgcctcctcatcttcggcgcctcctcccgcgccaccggcatccccgaccgcttctccggctccggctccggcaccgacttcaccctcaccatctcccgcctcgaacccgaagacttcgccgtctactactgccaacaatacggctcctcccccgccctcaccttcggaggcggcaccaaagtcgaaatcaaacgcacc

SEQ ID NO: 58339 - RNA, 333 nt, synthetic construct
  misc_feature 1..333: note = derived and/or modified sequence opt11 from anti-influenza_Chain
  source 1..333: mol_type = other RNA
cagagcttggaagagagcgggggcgggctcgtgaaaccgggcgggagcttgaccttgacctgtaccgtgagcgggctatcactctatagcaatgaaataaactgggtcaggcaagcgcccgggaacggactcgagtggataggcgcgatcgcgggctcgggctcggccgattacgcgagctgggccaagggcaggagcacgatcacgcgcaataccgatctcaataccgtgacattgaaaatgacctcgctcacggccgcggacacggccacgtacttttgcgcgagcttttgggatctctggggcccgggcacgctcgtgaccgtgagctcg

SEQ ID NO: 58340 - RNA, 333 nt, synthetic construct
  misc_feature 1..333: note = derived and/or modified sequence opt11 from anti-influenza_Chain
  source 1..333: mol_type = other RNA
cagagcgtggaagagagcgggggcgggctcgtgaaaccgggcgggagcctgaccttgacctgtaccgtgagcgggctctcgctctatagcaatgaaataaactgggtcaggcaagcgcccgggaacgggctcgagtggataggcgcgatcgcgggctcgggatcggccgattacgcgagctgggccaagagcaggagcacgatcacgcgcaataccaatctcaataccgtgaccttgaaaatgacctcgctcacggccgcggacacggccacgtacttttgcgcgagcttttgggatctctggggcccgggcacgctcgtgaccgtgagctcg

SEQ ID NO: 58341 - RNA, 333 nt, synthetic construct
  misc_feature 1..333: note = derived and/or modified sequence opt11 from anti-influenza_Chain
  source 1..333: mol_type = other RNA
cagagcttggaagagagcgggggcgggctagtgaaaccgggcgggagcctgaccttgacctgtacagtgagcgggctctcgctctatagcaatgaaataaactgggtcaggcaagcgcccgggaacgggctcgagtggataggcgcgatcgcgggctcgggctcggccgattacgcgagctgggccaagagcaggagcacgatcacgcgcaataccaatctcaataccgtgaccctgaaaatgacctcgctcacggccgcggacacggccacgtacttttgcgcgagcttttgggatctctggggcccaggcacgctcgtgaccgtgagctcg

SEQ ID NO: 58342 - RNA, 333 nt, synthetic construct
  misc_feature 1..333: note = derived and/or modified sequence opt11 from anti-influenza_Chain
  source 1..333: mol_type = other RNA
aatatcgtgctcacgcaatcgcccgcgagcttggccgtgagcttgggccagcgcgcgaccataagctgtcgcgcgagcgagagcgtggacatatacgggaactcgttcatgcactggtaccagcaaaagcccgggcaaccgcccaagctcttgatctatctcgcgagcaagctcgagtgcggggtctgtgccaggttcaatggctcgggctgtcgcacggactttaccttggccatagacccggtcgagggcgatgacggggccacgtactattgccagcaaaattacgaggacccgtggacgttcgggggcgggaccaagctcgagatcaag

SEQ ID NO: 58343 - RNA, 333 nt, synthetic construct
  misc_feature 1..333: note = derived and/or modified sequence opt11 from anti-influenza_Chain
  source 1..333: mol_type = other RNA
aatatcgtgctcacgcaatcgcccgcgagcttggccgtgagcccgggccagcgcgcgaccataagctgtcgcgcgagcgagagcatagacatatacgggaactcgttcatgcactggtaccagaaaaagcccgggcaaccgcccaagctcttgatctatcgcgcgagcaatctcgagagcggggtcccggccaggttcaatggctcgggctcgcgcacggactttaccctgaccatagacccggtcgagggcgatgacggggccacgtactattgccagcaaaattacgaggacccgtggacgttcgggggcgggaccaagctcgagatcaag

SEQ ID NO: 58344 - RNA, 333 nt, synthetic construct
  misc_feature 1..333: note = derived and/or modified sequence opt11 from anti-influenza_Chain
  source 1..333: mol_type = other RNA
gaaatcgtcctaacccaatcccccgccaccctctccctctaccccggcgaacgcgccaccctctcctgccgcgcctcccaatccgtctcccgctacctcgcctggtaccaacaaaaacccggccaagccccccgcctcctcatctacgacgcctccaaccgcgccaccggcatccccgcccgcttctccggctccggctccggcaccgacttcaccctcaccatctcctccctcgaacccgaagacttcgccgtctactactgccaacaacgctccaactggctaaaaatcaccttcggccaaggcacccgcctcgaaatcaaaggcaccgtc

SEQ ID NO: 58345 - RNA, 336 nt, synthetic construct
  misc_feature 1..336: note = derived and/or modified sequence opt11 from anti-influenza_Chain
  source 1..336: mol_type = other RNA
gacatcgtcatgacccaatcccccgactccctcgccgtctccctcggcgaacgcgccaccatcaactgcaaatcctcccaatccgtcctctactcctccaacaacaaaaactacctcgcctggtaccaacaaaaacccggccaaccccccaaactcctcatcgactgggcctccacccgcgaatccggcgtccccgaccgcttctccggctccggctccggcaccgacttcaccctcaccatctccaacctccaagtcgaagacgtcgccgtctactactgccaacaatactaccgctccccctccttcggccaaggcaccaaactcgaaatcaaa

SEQ ID NO: 58346 - RNA, 336 nt, synthetic construct
  misc_feature 1..336: note = derived and/or modified sequence opt11 from anti-influenza_Chain
  source 1..336: mol_type = other RNA
gacatcgtcatgacccaaacccccctctccctctccgtcacccccggccaacccgcctccatctcctgcaaatcctcccaatccctcctccactccgacggcaaaacctacctctactggtacctccaaaaacccggccaatccccccaactcctcatctacgaagtctccaaccgcttctccggcgtccccgaccgcttctccggctccggctccggcaccgacttcaccctcaaaatctcccgcgtcgaagccgaagacgtcggcgtctactactgcatgcaaaacatcctcctccccctcaccttcggcggcggcaccaaagtcgaaatcaaa

SEQ ID NO: 58347 - RNA, 336 nt, synthetic construct
  misc_feature 1..336: note = derived and/or modified sequence opt11 from anti-influenza_Chain
  source 1..336: mol_type = other RNA
gaaatcgtcatgacccaaacacccctctccctctccgtcacccccggccaacccgcctccatctcctgccgctcctcccaatccctcctccactccgacggcaaaacctacctctactggtacctccaaaaacccggccaaccaccccaactcctcatctccgaagtcttcaaccgcttctccggcgtccccgaccgcttctccggctccggctccggcaccgacttcaccctcaaaatctcccgcgtcgaagccgaagacgtcggcgtctactactgcatgcaatccctccaactccccctcaccttcggcggcggcaccaaagtcgaaatcaaa

SEQ ID NO: 58348 - RNA, 336 nt, synthetic construct
  misc_feature 1..336: note = derived and/or modified sequence opt11 from anti-influenza_Chain
  source 1..336: mol_type = other RNA
gacatcgtcatgacccaatcccccctatccctccccgtcacccccggcgaacccgcctccatctcctgccgcgcctcccaatccctcctccactccaacggctacaactacctcgactggtacctccaaaaacccggccaatccccccaactcctcatccaactcggctccacccgcgcctccggcgtccccgaccgcttctcaggctccggctccggcaccgacttcaccctcgaaatatcccgcgtcgaagccgaagacgtcggcgtctactactgcatgcaagccctccaactccccctcgccttcggccaaggcacccgcctcgaaatcaaa

SEQ ID NO: 58349 - RNA, 336 nt, synthetic construct
  misc_feature 1..336: note = derived and/or modified sequence opt11 from anti-influenza_Chain
  source 1..336: mol_type = other RNA
gacatcgtaatgacccaatcccccctctccctccccgtctcccccggcgaacccgcatccatctcctgccgctcctcacaatccctcctccacggcaacggctacaactacctcgactggtacctccaaaaacccggccaatccccccgcctactcatctacctcggctccaaccgcgcctccggcgtccccgaccgcttctccggctccggctccggcaccgacttcaccctcaaaatctcccgcgtcgaagccgaagacgtcggcgtctactactgcatgcaagccctccaaacccccctcaccttcggcggcggcaccaaagtcgaaatcaaa

SEQ ID NO: 58350 - RNA, 336 nt, synthetic construct
  misc_feature 1..336: note = derived and/or modified sequence opt11 from anti-influenza_Chain
  source 1..336: mol_type = other RNA
caatccgtcctcacccaacccccctccgtctccggcgcccccggccaacgcgtcaccatctcctgcaccggctcctcatcaaacatcggcgccggctacgacgtccactggtaccaacaactccccggcaccgcccccaaactcctaatctacgacaacaacaaccgcccctccggcgtccccgaccgcttctccggctccaaatccggcgcctcagcctccctcgccatcaccggcctccaagccgaagacgaagcccactactactgccaatcctacgacaactccctctccggctccgtcttcggcggcggcacccaactcaccgtcctctcc

SEQ ID NO: 58351 - RNA, 336 nt, synthetic construct
  misc_feature 1..336: note = derived and/or modified sequence opt11 from anti-influenza_Chain
  source 1..336: mol_type = other RNA
caatccgtcctcacccaacccccctccgtctccggcgcccccggccaacgcgtcaccatctcctgcaccggctcctcctccaacatcggctccgactacgacgtccactggtacaaacaactccccggcaccgcccccaaactcctcatcttcggcaactccaaccgcccctccggcgtccccgaccgcttctccggctccaaatccggcacctccgcctccctcgccatcaccggcctccaagccgaagacgaagccgactactactgccaatcctacgactcctccctctccggcttccacgtcttcggctccggcaccaaagtcaccgtcctc

SEQ ID NO: 58352 - RNA, 336 nt, synthetic construct
  misc_feature 1..336: note = derived and/or modified sequence opt11 from anti-influenza_Chain
  source 1..336: mol_type = other RNA
caatccgtcctcacccaacccccctccgtctccgccgcccccggccaaaaagtcaccatctcctgctccggctcctcctccaacatcggcaacgactacgtctcctggtaccaacaactacccggaaccgcccccaaactcctcatctacgacaacaacaaacgcccctccggcatccccgaccgcttctccggctccaaatccggcacctccgccaccctcggcatcaccggcctacaaaccggcgacgaagccaactactactgcgccacctgggaccgccgccccaccgcctacgtcgtcttcggcggcggcaccaaactcaccgtcctcggc

SEQ ID NO: 58353 - RNA, 336 nt, synthetic construct
  misc_feature 1..336: note = derived and/or modified sequence opt11 from anti-influenza_Chain
  source 1..336: mol_type = other RNA
gaaatcgtactaacccaatcccccggcaccctctccctatcccccggcgaacgcgccaccctctcctgccgcgcctcccaatcagtctcctcctcctacctcgcctggtaccaacaaaaacccggccaagccccccgcctcctaatctacggcgcctccacccgcgccaccggcatccccgaccgcttctccggccgcggctccggcacagacttcaccctcaccatctcctccctcgaacccgaagacttcgccgtctactactgccaaaactacggctcccccttcctcttcaccttcggccccggcaccaaagtcgacatcaaacgcaccgtc

SEQ ID NO: 58354 - RNA, 336 nt, synthetic construct
  misc_feature 1..336: note = derived and/or modified sequence opt11 from anti-influenza_Chain
  source 1..336: mol_type = other RNA
gacatccaactcacccaatcccccctctccccccccgtcaccctcggccaacccgcctccatctcctgccgctcctcccaatccctcctctacaccgacggcttcacctacctctcctggtaccaccaacgccccggccaatccccccgccgcctcatctacaaaatctccaaccgcgactccggcgtccccgaccgcttctccggctccggctccggcaccgacttcaccctcaaaatctcccgagtcgaagccgaagacgtcggcgtctactactgcatgcaagccacccactggcccctcaccttcggcgaaggcacaaaagtcgaaatcaaa

SEQ ID NO: 58355 - RNA, 336 nt, synthetic construct
  misc_feature 1..336: note = derived and/or modified sequence opt11 from anti-influenza_Chain
  source 1..336: mol_type = other RNA
gacatcgaactcacccaagaaccctccgcctccggcacccccggccaacgcgtcaccatctcctgctccggcgacacctccaacatcggctccaacaccgtctcctggttccaactcctccccggcaccgcccccaaactcctaatcttcaccgacaaccaacgcccctccggagtccccggccgcttctcaggctccaaatccggcacctcagcctccctcgccatctccggcctccaatccgaagacgaaaccgactactactgcgccgcctgggacgactccctcaacggctgggtcttcggcggcggcacaaaactcaccgtcctcggccaa

SEQ ID NO: 58356 - RNA, 336 nt, synthetic construct
  misc_feature 1..336: note = derived and/or modified sequence opt11 from anti-influenza_Chain
  source 1..336: mol_type = other RNA
gacatcgtcctcacccaatccccctccgcctccggctcccccggccaatccgtcaccatctcctgcacaggcacctcctccgacgtcggcggctacgactacgtctcctggtaccaacaacaccccggcaaagcccccaaactcatgatctacgaagtccgcaaacgcccctccggcgtccccgaccgcttctccggctccaaatccggcaacaccgcctccctcaccgtctccggcctccaagccgaagacgaagcctactactactgcgcctcctacgccggcacctacatccacctcttcggcggcggaaccaaactcaccgtcctcggccaa

SEQ ID NO: 58357 - RNA, 336 nt, synthetic construct
  misc_feature 1..336: note = derived and/or modified sequence opt11 from anti-influenza_Chain
  source 1..336: mol_type = other RNA
caagagcaattgatggagagcgggggcgggctcgtgaaaccgggcgggagcttgaccttgacctgtaccgtgagcgggctctcgctctatagcaatgaaataaactgggtcaggcaagcgcccgggaacgggctcgagtggataggcgcgatagcgggctcgggctcggccgattacgcgagctgggccaagagcaggagcacgatcacgcgcaataccaatctcaataccgtgaccttgaaaatgacctcgctcacggccgcggacacggccacgtacttttgcgcgagcttttgggatctctggggcccgggcacgctcgtgaccgtgagctcg

SEQ ID NO: 58358 - RNA, 336 nt, synthetic construct
  misc_feature 1..336: note = derived and/or modified sequence opt11 from anti-influenza_Chain
  source 1..336: mol_type = other RNA
caacagcaattgatggagagcgggggcgggctcgtgaaaccgggcgggagcttgaccttgacctgtaccgtgagcgggctctcgctctatagcaatgaaataaactgggtcaggcaagcgcccgggaacgggctcgagtggataggcgcgatcgcgggctcgggctcggccgattacgcgagctgggccaagagcaggagcacgatcacgcgcaataccgatctcaataccgtgaccttgaaaatgacctcgctcacggccgcggacacggccacgtacttttgcgcgagcttttgggatctctggggcccgggcacgctcgtgaccgtgagctcg

SEQ ID NO: 58359 - RNA, 336 nt, synthetic construct
  misc_feature 1..336: note = derived and/or modified sequence opt11 from anti-influenza_Chain
  source 1..336: mol_type = other RNA
caacagcaattggtcgagagcgggggcgggctcgtgaaaccgggcgggagcttgaccttgacctgtcgcgtgagcgggctctcgctctttagcaatgaaataaactgggtcaggcaagcgcccgggaacgggctcgagtggataggcgcgatcgggggcgggggctcggccgattacgcgagctgggccaagagcaggagcacgatcacgcgcaataccaatctcaataccgtgaccttgcgcatgacctcgctcacggccgcggacacggccgcgtacttttgcgcgagcttttgggatctctggggcccgggcacgctcgtgaccgtgagctcg

SEQ ID NO: 58360 - RNA, 336 nt, synthetic construct
  misc_feature 1..336: note = derived and/or modified sequence opt11 from anti-influenza_Chain
  source 1..336: mol_type = other RNA
gaagtgcaattggtcgagagcgggggcgggctcgtgaaaccgggcgggagcttgcgcttgagctgtgccgcgagcgggctctcgctctttagcaatgaaataaactgggtcaggcaagcgcccgggaaagggctagagtggataggcgcgatcgggggcgggggctcggccgattacgcgagctgggccaagagcaggttcacgatctcgcgcgataacgcgaaaaatagcttgtacttgcaaatgaactcgctcagggccgaggacacggccgtgtacttttgcgcgagcttttgggatctctggggcccgggcacgctcgtgaccgtgagctcg

SEQ ID NO: 58361 - RNA, 336 nt, synthetic construct
  misc_feature 1..336: note = derived and/or modified sequence opt11 from anti-influenza_Chain
  source 1..336: mol_type = other RNA
gacatcgtcatgacccaatcccccctatccctccccgtcacccccggcgaacccgcctccatctcctgccgctcctcccaatccctcctccgctccaacggctacaactacctcgactggtacctacaaaaacccggccaatccccccaactcctcatctacctcggctccaaccgcgcctccggcgtccccgaccgcttctccggctccggctccggcaccgacttcaccctcaaaatctcccgcgtcgaagccgaagacgtcggcgtctactactgcatgcaagccctccaaaccccctacaccttcggccaaggcaccaaactcgaaatcaaa

SEQ ID NO: 58362 - RNA, 339 nt, synthetic construct
  misc_feature 1..339: note = derived and/or modified sequence opt11 from anti-influenza_Chain
  source 1..339: mol_type = other RNA
gacatcgtcatgacccaatccccagacttcctccccgtctccctcggcgaacgcgccaccatcaactgcaaatcctcccaacgcgtcctctactcctccaacaacaaaaactacctcgcctggtaccaactcaaacccggccaaccccccaaactcatcatctactgggcctccacccgcgaatccggcgtccccgaccgcttctccggctccggctccggcaccgaattcaccctcaccatctcctccctccaagccgaagacgtcgccgtctactactgccaacaatactactcccgcccctacaccttcggccaaggcaccaaactcgaaatcaaa

SEQ ID NO: 58363 - RNA, 339 nt, synthetic construct
  misc_feature 1..339: note = derived and/or modified sequence opt11 from anti-influenza_Chain
  source 1..339: mol_type = other RNA
gacatcgtcatgacccaatcccccgactccctcgccgtctccctcggcgaacgcgccaccatcaactgcaaatcctcccaatccgtcctctactcctccaacaacaaaaactacctcgcctggtaccaacaaaaacccggccaaccccccaaactcctcatctactgggcctccacccgcgaatccggcgtccccgaccgcatctccggctccggctccggcgccgacttcaccctcaccatctcctccctccaagccgaagacgtcgccgtctactactgccaacaatacttcgccaccccccgcaccttcggccaaggcaccaaagtcgaaatcaaa

SEQ ID NO: 58364 - RNA, 339 nt, synthetic construct
  misc_feature 1..339: note = derived and/or modified sequence opt11 from anti-influenza_Chain
  source 1..339: mol_type = other RNA
gacatcgtcatgacccaatcccccgactccctcgccgtctccctcggcgaacgcgccaccatcaactgcaaatcctcccaatccgtcctctactcatccaacaacaaatcccacctcgcctggtaccaacaaaaacccggccaaccccccaaactcctcatctactgggcctccacccgcgaatccggcgtccccgaccgcttctccggctccggctcaggcaccgacttcaccctcatcatctcctccctccaagccgaagacgtcgccgtctactactgccaacaatactacttctcccccctcaccttcggcggcggcaccaaagtcgaaatcaaa

SEQ ID NO: 58365 - RNA, 339 nt, synthetic construct
  misc_feature 1..339: note = derived and/or modified sequence opt11 from anti-influenza_Chain
  source 1..339: mol_type = other RNA
gacatcgtcatgacccaatcccccgactccctcgccgtctccctcggcgaacgcgccaccatcaactgccgctcctcccaatccatcttccacaactccaacaacgaaaactacctcgcctggtaccaacaaaaacccggccaaccccccaaactcctcatctactgggcctccacccgcgaatccggcgtccccgaccgcttctccggctccggctcaggcaccgacttcaccctcaccatctcctccctccaagccgaagacgtcgccgtctacttctgccaacaatactacaacgcccccctcaccttcggcggcggcaccaaagtcgaaatcaaa

SEQ ID NO: 58366 - RNA, 339 nt, synthetic construct
  misc_feature 1..339: note = derived and/or modified sequence opt11 from anti-influenza_Chain
  source 1..339: mol_type = other RNA
gaaatcgtcctcacacaatcccccctctccctccccgtcacccccggcgaacccgcctccatctcctgccgctcatcccaatccctcctccactccaacggctacaactacctcgactggtacctccaaaaacccggccaatccccccaactcctcatctacctcggctccaaccgcgcctccggcgtccccgaccgcttctccggctccggctccggcaccgacttcaccctcaaaatctcccgcgtcgaagccgaagacgtcggcgtctactactgcatgcaagccctccaaacccccctcaccttcggcggcggcaccaaagtcgaaatcaaacgc

SEQ ID NO: 58367 - RNA, 339 nt, synthetic construct
  misc_feature 1..339: note = derived and/or modified sequence opt11 from anti-influenza_Chain
  source 1..339: mol_type = other RNA
gacatcgtcctcacccaacccccctccgtatccgtcgcccccggccaaaccgccaccatcacctgcggcggcaactacatcggctccaaatcagtcaactggtaccaacaacgacccggccacgcccccgtcctcgtcgtctacgacgactccgaccgcccctccggcatcccagaccgcttctccggctccaactcccgctccaccgccaccaccgccaccctcaccatctcccgcgtcgaagcaggcgacgaagccgactactactgccaagtctgggaaacctccgaagacctctgggtcttcggcggcggcaccaaactcaccgtcctcggccaa

SEQ ID NO: 58368 - RNA, 342 nt, synthetic construct
  misc_feature 1..342: note = derived and/or modified sequence opt11 from anti-influenza_Chain
  source 1..342: mol_type = other RNA
gacgtcgtcatgacccaatcccccgactccctcgccgtctccctcggcgaacgcgccaccatcaactgcaaatcctcccaatccgtcctctactcctccaacaacaaaaactacctcgcctggtaccaacaaaaacccggccaaccccccaaactcctcatctactgggcctccacccgcgaatccggcgtccccgaccgcttctccggctccggctccggcaccgacttcaccctcaccatctcctccctccaagccgaagacgtcgccgtctactactgccaacaatactactccacccccctcaccttcggcggcggcaccaaagtcgacatcaaacgc

SEQ ID NO: 58369 - RNA, 342 nt, synthetic construct
  misc_feature 1..342: note = derived and/or modified sequence opt11 from anti-influenza_Chain
  source 1..342: mol_type = other RNA
gacatccaaatgacccaatcccccgactccctcgccgtctccctcggcgaaaaagccaccatcaactgcaaatcctcccaatccatcctcaactcctccaacaacaaaaactacctcgcctggtaccaacaaaaacccggccaaccccccaaactcctcatctactgggcctccacccgcgaatccggcgtccccgaccgcttctccggctccggctccggcaccgacttcaccctcaccatctcctccctccaagccgaagacgtcgccgtctactactgccaacaatactactcctccccccccacattcggccaaggcaccaaagtcgaaatcaaacgc

SEQ ID NO: 58370 - RNA, 342 nt, synthetic construct
  misc_feature 1..342: note = derived and/or modified sequence opt11 from anti-influenza_Chain
  source 1..342: mol_type = other RNA
gagatcgtgctcacacaatcgcccgcgaccttgagcttgtacccgggcgagcgcgcgaccttgagctgtcgcgcgagccagagcgtgagcaggtacttggcctggtaccagcaaaagcccgggcaagcgcccaggctcttgatctatgacgcgagcaatcgcgcgaccgggatcccggccagattctcgggctcgggctcgggcacggactttaccctgaccataagctcgctcgagcccgaggactttgccgtgtactattgctgtgacaggcaacagcgctcgaactggctcaagatcacgttcgggcaagggaccaggctcgagatcaagggcacggtc

SEQ ID NO: 58371 - RNA, 342 nt, synthetic construct
  misc_feature 1..342: note = derived and/or modified sequence opt11 from anti-influenza_Chain
  source 1..342: mol_type = other RNA
gacatcgtcatgacccaatcccaaaaattcgtctccacctccgtcggcgaccgcgtctccgtcacctgcaaagcctcccaaaacgtcggctccaacgtcgcctggtaccaacacaaacccggccactcccccaccgccctcatctactccgcctcccaccgctactccggcgtccccgaccgcttcaccggctccgaatccggcaccgacttcaccctcaccatctccaacgtccaatccgaagacctcgccgaatacttctgccaacaatactactcctacccctacaccttcggcggcggcaccaaactcgaaatcaaacgcgccgacgccgcccccacc

SEQ ID NO: 58372 - RNA, 342 nt, synthetic construct
  misc_feature 1..342: note = derived and/or modified sequence opt11 from anti-influenza_Chain
  source 1..342: mol_type = other RNA
gacatcgaaatgacccaatcccccctctccctccccgtcacccccggcgaatccgcctccatctcctgccgctcctcccaatccctcctccactccaacggctacaactacctcgactggtacctccaaaaacccggccaatccccccaactcctcatctacctcggctcctcccgcgcctccggcgtccccgaccgcttctccggctccggctccggcaccgacttcaccctcaaaatctcccgcgtcgaagccgaagacgtcggcgtctactactgcatgcaaggcctccaaaccccctacaccttcggccaaggcaccaaactcgaaatcaaacgcacc

SEQ ID NO: 58373 - RNA, 342 nt, synthetic construct
  misc_feature 1..342: note = derived and/or modified sequence opt11 from anti-influenza_Chain
  source 1..342: mol_type = other RNA
gacatcgaaatgacccaatcccccctctccctccccgtcacccccggcgaacccgcctccatctcctgccgctcctcccaatccctcctccactccaacggctacaaccacctcgcctggtacctccaaaaacccggccgctccccccacctcctcatctacctcgcctccacccgcgcctccggcgtccccgaccgcttctccggctccggctccggcaccgacttcaccctcaaaatctcccgcgtcgaagccgaagacgtcggcatctactactgcatgcaatccctacaaacctccatcaccttcggccaaggcacccgcctcgaaatcaaacgaacc

SEQ ID NO: 58374 - RNA, 345 nt, synthetic construct
  misc_feature 1..345: note = derived and/or modified sequence opt11 from anti-influenza_Chain
  source 1..345: mol_type = other RNA
caagtgcaattggtccagagcggggccgaggtcaagaaaccgggctcgagcgtgcgcgtgagctgtaaaacgagcgggggcacgttctcgagctatgccgtgacctgggtcaggcaagcgcccgggcaagggctcgagtggatgggcgggatcataggcatgttcgggaccacgaactatgcccagaaatttcaagggcgcttgaccataaccgcggacgagatgacgagcacggcctatatggagctctcgagcttgcgctcggaagataccgcggtctattactgtgccaggggctcgtactattacgagaccacgctcgattactggggcaggggcacgctc

SEQ ID NO: 58375 - RNA, 345 nt, synthetic construct
  misc_feature 1..345: note = derived and/or modified sequence opt11 from anti-influenza_Chain
  source 1..345: mol_type = other RNA
gaagtgcaattggtccagagcggggccgaggtcaagaaaccgggctcgagcgtgaaagtgagctgtaaaacgagcgggggcacgttctcgagctatgccgtgacctgggtcaggcaagcgccagggcaagggctcgagtggatgggcgcgatcataggcatgttcgggaccacgaactatgcccagaaatttcaagggcgcgtgaccataaccgcggacgagctcacgagcacggcctatatggagctctcgagcttgcgctcggacgataccgcggtctattactgtgccaggggctcgtactattacgagagctcgctagattactggggcaagggcacgctc

SEQ ID NO: 58376 - RNA, 345 nt, synthetic construct
  misc_feature 1..345: note = derived and/or modified sequence opt11 from anti-influenza_Chain
  source 1..345: mol_type = other RNA
caggtccagctcgtgcaatcgggcgcggaagtgaaaaagcccgggagctcggtcaaggtctcgtgcaagacctcgggcgggacctttagctcgtacgcggtcacgtgggtgcgccaggccccgggccagggcttggaatggatgggcgggataatcgggatgtttggcacgaccaattacgcgcaaaagttccagggcagggtcacgatcacggccgatgaattgacctcgaccgcgtacatggaattgagctcgctcaggagcgaggacacggccgtgtactattgcgcgcgcgggagctattactatgaatcgagcttggactattgggggcgcgggaccttg

SEQ ID NO: 58377 - RNA, 345 nt, synthetic construct
  misc_feature 1..345: note = derived and/or modified sequence opt11 from anti-influenza_Chain
  source 1..345: mol_type = other RNA
gaagtgcaactggtccagagcggggccgaggtcaagaaaccgggcgcgagcgtgaaagtgagctgtaaagcgagcgggtacacgttcacgggctattacgtgtactgggtcaggcaagcgcccgggcaagggctcgagtggatgggctggatctcggcctataacgggaacacgaactatgcccagaaatttcaagggcgcgtgaccataaccgcggacaagagcacgagcacggcctatatggagctctcgagcttgcgctcggaagataccgcggtctattactgtgccagaagcaggagcttggacgtgtgggggcaagggaccacggtcacggtctcgagc

SEQ ID NO: 58378 - RNA, 345 nt, synthetic construct
  misc_feature 1..345: note = derived and/or modified sequence opt11 from anti-influenza_Chain
  source 1..345: mol_type = other RNA
gacatcgtcatgacccaatcccccctctccctccccgtcacccccggcgaacccgcctccatctcctgccgctcctcccaatccctcctccactccaacggccacatctacttcgactggtacctacaaaaacccggccaatccccccaactcctcatctacctcgtctccaaacgcgcctccggcgtccccgaccgcttctccggctccggctccggcaccgacttcaccctcaaaatctcacgcgtcgaagccgaagacgtcggcgtctactactgcatgcaagccctcgaaacccccttcaccttcggccccggcaccaaagtccacatcaaacgcaccgtc

SEQ ID NO: 58379 - RNA, 345 nt, synthetic construct
  misc_feature 1..345: note = derived and/or modified sequence opt11 from anti-influenza_Chain
  source 1..345: mol_type = other RNA
caatccgccctcacccaacccgcctccgtctccggctcccccggccaatccatcaccatctcctgcaccggcacctcctccgacgtcggcgcctacaactacgtctcctggtaccaacaccaccccggcaaagcccccaaactcatgatctacgacgtcacctaccgcccctccggcgtctccacccgcttctccggctccaaatccggcaacaccgcctccctcaccatctccggcctacaagccgaagacgaagccgactactactgctcctcccaatcccgctcctccaccctcgtcatcttcggcggcggcaccaaactcaccgtcctcggccaacccaaa

SEQ ID NO: 58380 - RNA, 345 nt, synthetic construct
  misc_feature 1..345: note = derived and/or modified sequence opt11 from anti-influenza_Chain
  source 1..345: mol_type = other RNA
gacatcgtcctcacccaatcacccgtctccctcgccgtctccctcggcgaatccgccaccgtcaactgcaaatcctcccaatccgtcctctccaactccaaaaacctcaactacctcgcctggtaccaacacaaacccggccaaccccccaaactcctcatctactgggcctccacccgcgaatccggcgtccccgaccgtttctcaggctccggctccggcaccgacttcaccctcaccatctcctcactccaagccgaagacgtcgccgtctactactgccaacaacactactccatccccctcaccttcggccccggcaccaaagtcgacatcaaacgcacc

SEQ ID NO: 58381 - RNA, 348 nt, synthetic construct
  misc_feature 1..348: note = derived and/or modified sequence opt11 from anti-influenza_Chain
  source 1..348: mol_type = other RNA
gacatcgtcctcacccaatcccccctctccctccccgtcacccccggcgaacccgcctccatctcctgccgctcctcccaatccctcctcgactccaacggctacaactacctcgactggtacctccaaaaacccggccaatccccccaactcctcatctacctcgcctcctaccgcgcccccggcgtccccgaccgcttctccggctccggctccggcaccgacttcaccctcaaaatctcccgcgtcgaagccgaagacgtcggcctctactactgcatgcaagccctccaaaccccccccatgtacaccttcggccaaggcaccaaactcgaaatcaaacgcaca

SEQ ID NO: 58382 - RNA, 351 nt, synthetic construct
  misc_feature 1..351: note = derived and/or modified sequence opt11 from anti-influenza_Chain
  source 1..351: mol_type = other RNA
ctcgagagcgggggcgggctcgtgcaaccgggcgggagcttgcgcttgagctgtgccgcgagcgggatcacattctcgagctatgccatgagctgggtcaggcaagcgcccgggaaagggctcgagtgggtgagcacggtcaatagcgggggcgggagcacgtactatggcgatagcgtgcgcgggcgctttaccataagcagggacaatagcaagagcacgctctatctccagctcaatagcttgcgcgcggaagataccgcgatctattactgtgccaaggacaagggcaggcccatattcgggctcgtgaccccgagctattacatggacgtgtgggggaacgggacc

SEQ ID NO: 58383 - RNA, 351 nt, synthetic construct
  misc_feature 1..351: note = derived and/or modified sequence opt11 from anti-influenza_Chain
  source 1..351: mol_type = other RNA
caagagcaattggtacagagcggggccgaggtcaagaaaccgggcgcgagcgtgaaagtgagctgtaaagcgagcaggaaatcgttcataggctattacgtgcactgggtcagacaagcgcccgggcaagggctcgagtggatgggctggatctcgcccgatagcgatgccacgaaatatgcccagaaatttcaagggagcgtgatcatgaccagggacacgagcgtgagcacggtctatatggagctctcgcgcttgacctcggacgataccgcgctctattactgtctcttgttcaggggcgggaactcgctctcgtgggggcaagggaccttggtcacggtctcgagc

SEQ ID NO: 58384 - RNA, 351 nt, synthetic construct
  misc_feature 1..351: note = derived and/or modified sequence opt11 from anti-influenza_Chain
  source 1..351: mol_type = other RNA
caagtgcaattgcaagagagcgggcccgggctcgtgaaaccaagcgagaccctgagcttgacctgtaccgtgagcgggagctcgatctcgaactattactggagctggatcaggcaatcgcccgggaaagggctcgagtggataggctttatctattacgggggcaataccaagtacaatccctcgctcaagagcagggtcacgatctcgcaagatacctcgaaatcgcaagtgagcttgaccatgagctcggtcacggccgcggaatcggccgtgtacttttgcgcgcgagcgagctgtagcgggggctattgcatactcgattactggggccagggcacgctcgtgacc

SEQ ID NO: 58385 - RNA, 351 nt, synthetic construct
  misc_feature 1..351: note = derived and/or modified sequence opt11 from anti-influenza_Chain
  source 1..351: mol_type = other RNA
gaggtccagctcgtggaatcgggcgggggcctggtccagcccgggggctcgctcaggctatcgtgcgcggcctcgggctttacctttagcatatacgcgatgtcgtgggtgcgccaggccccgggcaagggcttggaatgggtctcagccataagctcgagcggggactcgacctattacgcggactcggtcaagggcaggttcacgatctcgcgcgataacgcgcgcaataccttgtacttgcaaatgaactcgctcagggccgaggacacggccgtgtactattgcgcgcgcgcgtacgggtacacgttcgatccctggggccagggcacgctcgtgaccgtaagctcg

SEQ ID NO: 58386 - RNA, 354 nt, synthetic construct
  misc_feature 1..354: note = derived and/or modified sequence opt11 from anti-influenza_Chain
  source 1..354: mol_type = other RNA
caagtccaactccaagaatccggccccggcctcgtcaaaccctccgaaaccctctccctaacctgcaccgtctccggctactccttcgactccggctactactggggctggctccgccaacccccaggcaaaggcctcgaatggatcggctccatctaccactcacgcaacacctactacaacccctccctcaaatcccgcgtcaccatctccgtcgacacctccaaaaaccaattctccctccaactctcctccgtcaccgccgccgacaccgcagtctactactgcgcccgcggcacctggtactcctcaaacctccgctactggttcgacccctggggcaaaggcaccctc

SEQ ID NO: 58387 - RNA, 354 nt, synthetic construct
  misc_feature 1..354: note = derived and/or modified sequence opt11 from anti-influenza_Chain
  source 1..354: mol_type = other RNA
caacccgtcctcacccaacccccctccgcctcagcctccctcggcgcctccgtcaccctcacctgcaccctctcctccgcctactccaactacaaagtcgactggtaccaacaacgccccggcaaaggcccccgattcgtcatgcgcgtcggcacaggcggcatcgtcggctccaaaggcgacggcatccccgaccgcttctccgtcctcggctccggcctcaaccgctacctcaccatcaaaaacatccaagaagaagacgaatcagactaccactgcggcgccgaccacggctccggctccaacttcgtctccccctacgtcttcggcggcggcaccaaactcaccgtccta

SEQ ID NO: 58388 - RNA, 354 nt, synthetic construct
  misc_feature 1..354: note = derived and/or modified sequence opt11 from anti-influenza_Chain
  source 1..354: mol_type = other RNA
caagtccaactcgtccaatccggcgccgacgtcaaaaaacccggctcctccgtcaccgtctcctgcaaagcctccggcggctccttctccaactacggcatcaactgggtccgccaagcccccggccaaggcctcgaatggatgggcggcatcatccccctcatcaacgcccccaactacgcccccaaattccaaggccgcgtcaccatcaccgccgacatgttctccaacatcgtctccctccaactcacctccctacgcaccgacgacaccgccgtctactactgcgcccgccgcaaaatgaccaccgccatagactactggggccaaggcaccctcgtcaccgtctcctcc

SEQ ID NO: 58389 - RNA, 354 nt, synthetic construct
  misc_feature 1..354: note = derived and/or modified sequence opt11 from anti-influenza_Chain
  source 1..354: mol_type = other RNA
caggtccagctcgtgcaatcgggcgcggaagtgaaaaagcccgggagctcggtcaaggtctcatgcagggaatcgggcgggacctttaacgggtacacgatcacgtgggtgcgccaggccccgggccagggcctggaatggatgggcgggataatcccgatgatgggcacggtcaattacgcgcaaaagctccagggcagggtcacgatcacgaccgactactttaccaagaccgcgtacatggacttgaacaatctcaggagcgaggacacggccatgtactattgcgtgaaaatacgctataccgggcaacagctcctgtgggggcaagggaccctggtcacggtctcgagc

SEQ ID NO: 58390 - RNA, 354 nt, synthetic construct
  misc_feature 1..354: note = derived and/or modified sequence opt11 from anti-influenza_Chain
  source 1..354: mol_type = other RNA
caagtgcaattggtccagagcggggccgaggtcaagaaaccgggcgcgagcgtgaaagtgagctgtaaagcgagcgggcacacgttcacgggctattacatacactgggtcagacaagcgcccgggcaagggctcgagtggatgggctggatcaatcccgatagcggggccacgagctcggcccagaactttcaagggcgcgtgaccatgaccggggacacgagctcgagcacggcctatatggagctctcgcgcttgagctttgacgataccgcggtctattactgtgccagggtcctgttcacgagcccgttcgatttctggggcgagggcacgctcgtgaccgtgagctcg

SEQ ID NO: 58391 - RNA, 354 nt, synthetic construct
  misc_feature 1..354: note = derived and/or modified sequence opt11 from anti-influenza_Chain
  source 1..354: mol_type = other RNA
caacccgtcctctcccaacccccatccgcctccgcctccctcggcgcatccgtcaccctaacctgcaccctctcatccggcttcgacaactaccaagtcgcctggtaccaacaacgccccggcaaaggcccccgcttcgtcatgcgcgtcggcaacggcggcaacgtcgcctcaaaaggcgacggcatccccgaccgcttctccgtctccggctccggcctcaaccgatacctaaccatcaaaaacatccaagaagacgacgaatccgactactactgcggcgcagaccacggctccggcaacaacttcgtctccccctacgtcttcggcggcggcaccaaactcaccgtcctc

SEQ ID NO: 58392 - RNA, 354 nt, synthetic construct
  misc_feature 1..354: note = derived and/or modified sequence opt11 from anti-influenza_Chain
  source 1..354: mol_type = other RNA
gaagtgcaattggtcgagagcggggccgaggtcaagaaaccgggcgcgagcgtgaaagtgagctgtaaagcgagcgggtacacgttctcgcgctattacatacactgggtcaggcaagcgcccgggcaagagctcgagtggatgggctggatcaatcccgatagcggggacacgaactatgcccagaaatttcgcgggcgcgtgaccatggcaagagacacgagcataagcacagtctatatggagctcaatagcttgcgctatgacgataccgcggtctatttctgtgccaggatcatatggtcgagctcgggcatggacgtgtgggggcaagggaccacggtcacggtctcg

SEQ ID NO: 58393 - RNA, 354 nt, synthetic construct
  misc_feature 1..354: note = derived and/or modified sequence opt11 from anti-influenza_Chain
  source 1..354: mol_type = other RNA
gaagtgcaattgctcgagagcgggggcggggtcgtgcaaccgggcaggagcttgcgcttgagctgtgccgcgagcgggttcacgttcaggacctatggcatgcactgggtcaggcaagcgcccgggaaagggctcgagtgggtggccgtgatctcgcacgatggcaatctcaagtactatggcgggagcgtgaaagggcgctttaccataagcagggacaatagcaagaacgcgctctatctccagatgaatagcttgcgagtggacgataccgcgctctattactgtgccaggggcataggcataaccgatgcctttgacatacgcgggcaagggaccatggtcgtggtctcg

SEQ ID NO: 58394 - RNA, 354 nt, synthetic construct
  misc_feature 1..354: note = derived and/or modified sequence opt11 from anti-influenza_Chain
  source 1..354: mol_type = other RNA
gaagtgcaattggtcgagagcggaggcgggctcgtgcaaccgggcgggagcttgcgattgagctgtaccgcgagcgggctatcggtctcgagcacgtacatgaactgggtcaggcaagcgcccgggaaagggctcgagtgggtaagcgtgttctatagcgagaccaggacctattacgcggactcggtcaagggcaggttcacggtctcgcgccataactcgaacaataccctgtacctgcaaatgaactcgctcagggtagaggacacggccgtgtactattgcgcgcgcgtgcaaaggctctcgtacgggatggatgtctggggccagggcacgaccgtgaccgtgagctcg

SEQ ID NO: 58395 - RNA, 354 nt, synthetic construct
  misc_feature 1..354: note = derived and/or modified sequence opt11 from anti-influenza_Chain
  source 1..354: mol_type = other RNA
gaagtgcaattggtcgagagcgggggcgggctcgtgcaaccgggagggagcttgcgcttgagctgtaccgcgagcgggctctcggtctcgagcacgtacatgaactgggtcaggcaagcgcccgggaaagggctcgagtgggtgagtgtgttctatagcgagaccaggacctattacgcggactcggtcaagggcaggttcacggtctcacgccataactcgaacaataccttgtacttgcaaatgaactcgctcagggccgaggacacggccgtgtactattgcgcgcgcgtgcaaaggctctcgtacgggatggatgtctggggccagggcacgaccgtgaccgtgagctcg

SEQ ID NO: 58396 - RNA, 354 nt, synthetic construct
  misc_feature 1..354: note = derived and/or modified sequence opt11 from anti-influenza_Chain
  source 1..354: mol_type = other RNA
gacatgcaattggtcgagagcgggggcggactcgtgcccccgggcgggagcttgcgcttgagctgtgccgcgagcgggttctcggtctcggacaattacataaactgggtcaggcaagcgcccgggaaaggactcgattgggtgagcgtgttctatagcgcggacaggacctcgtacgcggactcggtcaagggcaggttcacggtctcgagccatgactcgaaaaatacagtgtacttgcaaatgaactcgctcagggccgaggacacggccgtgtactattgcgcacgcgtgcaaaagagctattacgggatggatgtctggggccagggcacgaccgtgaccgtgagctcg

SEQ ID NO: 58397 - RNA, 357 nt, synthetic construct
  misc_feature 1..357: note = derived and/or modified sequence opt11 from anti-influenza_Chain
  source 1..357: mol_type = other RNA
gaagtccaactcgtcgaatccggccccgtcctagtcaaacccaccgaaacactcaccgtcacctgcaccgtctccggcttctccgtcgacaacgaccgcatgggcgtctcctggatacgccaaccccccggcaaagccctcgaatggctagcccacatcttctccaacgacgaaaaatcctactccacctccctccgctcccgcctcaccatctccaaagacacctccaaacgccaagtcgtcctctccatgaccgacatggaccccgtcgacaccgccacctactactgcgcccgcgccccctccgaatacgccgccatggacgtctggggccaaggcaccatggtcaccgtctcc

SEQ ID NO: 58398 - RNA, 357 nt, synthetic construct
  misc_feature 1..357: note = derived and/or modified sequence opt11 from anti-influenza_Chain
  source 1..357: mol_type = other RNA
caggtgcaggtggtgcagagtgggacggaggtgaagaagccggggagtagtgtgaaggtgagttgtcagacgagtggggggaggtttatgagttatgcgataacgtgggtgaggcaggcgccgggacaggggctggagtggatgggggggatagtgccggtatttgggacggcgaattacgcgcagaagtttcaggggagggtgacgataacgacggatgatagtacgaggacggcgtatatggagttgagtagtctgaggagtgaggatacggcagtgtattattgtgggtttaggtatgggagcgggtatgggtttgatagctgggggcaggggacgttggtgacggtgagcagt

SEQ ID NO: 58399 - RNA, 357 nt, synthetic construct
  misc_feature 1..357: note = derived and/or modified sequence opt11 from anti-influenza_Chain
  source 1..357: mol_type = other RNA
gaagtccaactcgtcgaatcaggcgccggcgtcaaaaaacccggctcctccgtcaaagtctcctgcaaagcctccggcaacaccttctcctccaacgccatctcctgggtccgccaagcccccggccaaggcctcgaatggatgggcggcatcctcggcatgctccgcaccaccaactacgcccaaaaattccaaggccgcgtcaccatcaccgccgacgaattcatgaacaccgcctacatggaactctcctccctcacctccgaagacaccgccgtctactactgcgcccgctcctccggctactaccccgactacttccacctctggggccaaggcaccctagtcaccgtctcc

SEQ ID NO: 58400 - RNA, 357 nt, synthetic construct
  misc_feature 1..357: note = derived and/or modified sequence opt11 from anti-influenza_Chain
  source 1..357: mol_type = other RNA
caagtgcaattgcaagagagcgggcccgggctcgtgaaaccgagcgagaccttgagcttgacctgtaccgtgagcgggagctcgatctcaaactattactggagctggatcaggcaatcgcccgggaaagggctcgagtggataggctttatctattacgggggcaacaccaagtacaatccctcgctcaagagcagggtcacgatctcgcaagatacctcgaaatcgcaagtgagcctgaccatgagctcggtcacggccgcggaatcggccgtgtacttttgcgcgcgcgcgagctgtagcgggggctattgcatactcgattactggggccagggcacgctcgtgaccgtgagc

SEQ ID NO: 58401 - RNA, 357 nt, synthetic construct
  misc_feature 1..357: note = derived and/or modified sequence opt11 from anti-influenza_Chain
  source 1..357: mol_type = other RNA
gaagtgcaattggtcgagagcgggggcgggctcgtgcaaccgggcgggagcttgcgcataagctgtgccgcgagcgggttcacggtctcgagcaattacatgagctgggtcaggcaagcgcccgggaaagggctcgagtgggtgagcgtgatctatagcgggggctcgacctattacgcggactcagtcaagggcaggttctcgttctcgcgcgataactcgaaaaataccgtgttcttgcaaatgaactcgctcagggccgaggacacggccgtgtactattgcgcgcgctgtctctcgcgcatgcgcgggtacgggctcgatgtctggggccagggcacaaccgtgaccgtgagc

SEQ ID NO: 58402 - RNA, 357 nt, synthetic construct
  misc_feature 1..357: note = derived and/or modified sequence opt11 from anti-influenza_Chain
  source 1..357: mol_type = other RNA
caagtccaactccaagaatccggccccggcctagtcaaaccctccgaaaccctctccctcacctgcaccgtctccggcgcctccatctcctccgactactggtcctggatccgcctcccccccggcaaaggcctcgaatggatcggctacatctacaaccgcggctccaccaaatacaccccctccctcaaatcacgcgtcaccatctccctcgacaccgccgaaaaccaattctccctccgcctccgctccgtcaccgccgccgacaccgccatctactactgcgcccgccacgtcggcggccacacatacggcatcgactactggggccaaggcaccctcgtcaccgtctcctcc

SEQ ID NO: 58403 - RNA, 357 nt, synthetic construct
  misc_feature 1..357: note = derived and/or modified sequence opt11 from anti-influenza_Chain
  source 1..357: mol_type = other RNA
caagtccaactccaagaatccggccccggccttgtcaaaccctccgaaaccctctccctcacctgcaccgtctccggcgcctccatctcctccgactactggtcctggatccgcctcccccccggcaaaggcctcgaatggatcggctacatctacaaccgcggctccaccaaatacaccccctcactcaaatcccgagtcaccatctccctcgacaccgccgaaaaccaattctccctccgcctccgctccgtcaccgcagccgacaccgccgtctactactgcgcccgccacgtcggcggccacacctacggcatcgactactggggccaaggcaccctcgtcaccgtctcctcc

SEQ ID NO: 58404 - RNA, 357 nt, synthetic construct
  misc_feature 1..357: note = derived and/or modified sequence opt11 from anti-influenza_Chain
  source 1..357: mol_type = other RNA
caggtccagctccaggaatcgggcccgcgcctagtcaagccctcagaatcgctctcactcacgtgcacggtctcgggcgggagcataagcaatagcttttgggggtggatacgccagcccccgggcgagggcctggaatggatcgggtacgtgtacaacagcgggaacacaaaatacaacccgagcctgaaatcgcgcgtgaccataagcagggacacaagcaagagccagctctatatgaagctcaggagcgtgaccgcggccgataccgcagtctattactgtgccaggcacgatgacgcaagccatggctacagcataagctggggccatggcacgctcgtgaccgtgagctcg

SEQ ID NO: 58405 - RNA, 357 nt, synthetic construct
  misc_feature 1..357: note = derived and/or modified sequence opt11 from anti-influenza_Chain
  source 1..357: mol_type = other RNA
gaggtccatctccagcaatcgggcccggaattggtcaagcccggggcctcggtcaagatgtcgtgcgaggcctcaggctatacctttaccgattactatgtcgcgtgggtgaaacagagcccgggcgagagctttgaatggatcgggcgcgtgaacccgtactcgggcgggacctcgtacaatcaaaagttcaagggcaaggccacgctcatagtcgataaatcgagctcgaccgcgtacatggaattgagctcgctcacgagcgaggactcagccgtgtactattgcgcacgctgggactatggcgtgtacgagggctatatcgattactggggccagggctcggccttgaccgtg

SEQ ID NO: 58406 - RNA, 360 nt, synthetic construct
  misc_feature 1..360: note = derived and/or modified sequence opt11 from anti-influenza_Chain
  source 1..360: mol_type = other RNA
caagtccaactcgtccaacccggcgccgaagtcaaaaaacccggctcctccgtcaaagtctcctgcaaagcctccggcggcatcttctccccctacgccatctcctgggtccgccaagcccccggccaaggcctcgaatggatgggcggcatcatcgccatcttcggcaccaccaactacgcccaaaaattccaaggccgcgtcaccatcaccgccgacaaatccaccaccaccgcctacctcgaactcaactccctccgcttcgaagacaccgccgtctactactgcgcccgcggcggccgctactacgtcgactacttcgactactggggccaaggcaccctcgtctccgtctcctcc

SEQ ID NO: 58407 - RNA, 360 nt, synthetic construct
  misc_feature 1..360: note = derived and/or modified sequence opt11 from anti-influenza_Chain
  source 1..360: mol_type = other RNA
caagtgcaattgcaagagagcgggcccgatctcgtgaaaccgggcgcgagcgtgaaaatgagctgtaaagcgagcgggtactcgttcacgtactatcacatgcactgggtcaagcaaacgcacgggaaatcgctcgagtggataggcaggatcccgtacaatggcgggaccaattactcgcaaaggttcaagggcaaggccgtgttcacggtcgatatgtcgagctcgaccgcgtacatggaattgcgctcgctcacgagcgaggactcggccgtgtactattgcgcgcgcgatgccaattacgagggcgattggtatttcgatgtctggggccagggcacgaccgtgaccgtgagctca

SEQ ID NO: 58408 - RNA, 360 nt, synthetic construct
  misc_feature 1..360: note = derived and/or modified sequence opt11 from anti-influenza_Chain
  source 1..360: mol_type = other RNA
caagtgcaattggtccagagcggggccgaggtcaaggaaccgggctcggccatgaaagtgagctgtaaagcgagcgggggcacgttctcgagcgatgccttttgctgggtcaggcaagcgcccgggcgcgggctcgagtggatgggcgggatcatacccgtgttccagaccgcgaactatggcccgaactttcaagggcgcgtgaccataagcgcggacgtatacacgaccacgctctatctcgagctctcgggcttgacctcggaagataccgcggtctatttctgtgccaggagcggggacgggtacaattactatttcccgctctggggccagggcacgctcgtgaccgtgagctcg

SEQ ID NO: 58409 - RNA, 360 nt, synthetic construct
  misc_feature 1..360: note = derived and/or modified sequence opt11 from anti-influenza_Chain
  source 1..360: mol_type = other RNA
caaatcaccctccgcgaatccggccccaccctcgtcaaacccacccaaaccctcaccctaacctgcaccttctccggcttctccctctccaccaacggcgtcaacgtcggctggatccgccaaccccccggcaaagccctcgaatggctcgccctcatctactgggacgacgacaaacgctactccccctccctcaaacgccgactcaccatcaccaaagacacctccaaaaaccaagtcgtcctcaccctcaccaacatggaccccgtcgacaccgccacctactactgcgcccaccgccccgacttctacggcgacttcgaatactggggccccggcaccctcgtcaccgtctcctcc

SEQ ID NO: 58410 - RNA, 360 nt, synthetic construct
  misc_feature 1..360: note = derived and/or modified sequence opt11 from anti-influenza_Chain
  source 1..360: mol_type = other RNA
caagtgcaattggtccagagcgggagcgaggtcaagaaaccgggcacgagcgtgaaagtgagctgtaccgcgagcgggagcgtgttcacgaactatggcataagctgggtcagacaagcgcccgggcaagggctcgagtggatgggcgggatcatacccttgttcggggccgcgaaatatgcccagaaatttcaagggcgcgtgaccataaccgcggacgagagcacgaaaacggtctatatggagctctcgcgcttgacctcgaaagataccgcgatctatttctgtgccaaggccccgcgagtgtacgagtactatttcgatcaatggggccagggcacgcccgtgaccgtgagctcg

SEQ ID NO: 58411 - RNA, 360 nt, synthetic construct
  misc_feature 1..360: note = derived and/or modified sequence opt11 from anti-influenza_Chain
  source 1..360: mol_type = other RNA
caagtgcaattggtccagagcggggccgatctcaagaaaccgggcgcgagcgtgaaagtgagctgtaaagcgagcgggtacacgttcacggactattacatacactgggtcaggcaagcgcccgggcaagggctcgagtggatgggctggatcaatcccgagagcggggacacgaaatatgcccagaaattccaagggcgcgtgaccatgaccagggacacgagcataaccacggcctatatggagctcgggcgactgcgatcggacgataccgcggtctattactgtgccagggacgtgagcacgacctggagctggttcgcgccctggggccagggcacgctcgtgaccgtgagctcg

SEQ ID NO: 58412 - RNA, 360 nt, synthetic construct
  misc_feature 1..360: note = derived and/or modified sequence opt11 from anti-influenza_Chain
  source 1..360: mol_type = other RNA
caagtccaactccaagaatccggccccggcctcgtcaaaccctccgaaaccctctcactaacctgctccgtctccggcggctccatcaactactactactggtcctggatccgccaaccccccggcaaaggcctcgaatgcatcggctacatctccgacaccggccgcacctactacaacccctccctccgctcccgcgtcacaatctccgtcgacacctccaaaaaccaattctccctcaacctcacctccatgaccgccgccgacaccgccgtctactactgcgcccgcgaccccaccggctcccgccaaaaaaacgccttcgacatgtggggccaaggcaccatggtcaccgtctcc

SEQ ID NO: 58413 - RNA, 360 nt, synthetic construct
  misc_feature 1..360: note = derived and/or modified sequence opt11 from anti-influenza_Chain
  source 1..360: mol_type = other RNA
caagtccaactccaagaatccggcccccgagtcgtccgcccctcagaaaccctctccctcacctgcaccgtctcaggcggctcaatctcctcctacaactggatctggatccgccaaccccccggcaaaggcctcgaatggatcggccacatctacgactacggccgcaccttctacaactcctccctccaatcccgccccaccatctccgtcgacgcctccaaaaaccaactatccctccgcctcacctccgtcaccgcctccgacaccgccgtctactactgcgcccgccccctcggcatcctccactactacgccatggacctctggggccaaggcaccaccgtcaccgtctcctcc

SEQ ID NO: 58414 - RNA, 360 nt, synthetic construct
  misc_feature 1..360: note = derived and/or modified sequence opt11 from anti-influenza_Chain
  source 1..360: mol_type = other RNA
caagtccaactccaagaatccggccccggcctcgtcaaaccctccgaaaccctctccctcacctgctccgtctccggcggctcaatctcctccgacttctggtcctggatccgacaaccccccggcaaaggcctcgaatggatcggctacgtctacaaccgcggctccaccaaatactccccctccctcaaatcacgcgtcaccatctccgccgacatgtccaaaaaccaattctccctcaacatgtcatccgtcacagccgccgacaccgccgtctactactgcgccaaaaacggccgctcatcaacctcctggggcatcgacgtctggggcaaaggcaccaccgtcaccgtctcctcc

SEQ ID NO: 58415 - RNA, 360 nt, synthetic construct
  misc_feature 1..360: note = derived and/or modified sequence opt11 from anti-influenza_Chain
  source 1..360: mol_type = other RNA
caagtccaactccaagaatccggccccggcctcgtcaaaccctccgaaaccctctccctcacctgcaccgtctccggcggctccatctccgcctaccactggtcctggatccgccaaccccccggcaaaggcctcgaatggatcggccacatcttcgactccggctccacctactacaacccctccctcaaatcccgcgtcaccatctccctcgacgcctccaaaaaccaactctccctccgactcacctccgtcaccgcctccgacaccgccatctactactgcgcccgccccctcggctcccgctactactacggcatggacgtctggggccaaggcaccacagtcaccgtctcctcc

SEQ ID NO: 58416 - RNA, 360 nt, synthetic construct
  misc_feature 1..360: note = derived and/or modified sequence opt11 from anti-influenza_Chain
  source 1..360: mol_type = other RNA
gaagtgcaattagtcgagagcgggggcgggctcgtgcaaccgggcgggagcttgcgcataagctgtgccgcgagcgggttcacggtctcgagcaattacatgagctgggtcaggcaagcgcccgggaaagggctcgagtgggtgagcgtgatctatagcgggggctcgacctattacgcggactcggtcaagggcaggttctcgttctcgcgcgataactcgaaaaataccgtgttcttgcaaatgaactcgctcagagccgaggacacggccgtgtactattgcgcgcgctgtctctcgcgcatgcgcgggtacgggctcgatgtctggggccagggcacgaccgtgaccgtgagctcg

SEQ ID NO: 58417 - RNA, 360 nt, synthetic construct
  misc_feature 1..360: note = derived and/or modified sequence opt11 from anti-influenza_Chain
  source 1..360: mol_type = other RNA
caagtgcaattgcaagagagcgggcccgggctcgtgaaaccgagcgagaccctgagcttgacctgtaccgtgagcgggagctcaatctcgaactattactggagctggatcaggcaatcacccgggaaagggctcgagtggataggctttatctattacgggggcaataccaagtacaatccctcgctcaagagcagggtcacgatctcacaagatacctcaaaatcgcaagtgagcttgaccatgagctcggtcacggccgcggaatcggccgtgtacttttgcgcgcgcgcgagctgtagcgggggctattgcatactcgattactggggccagggcacgctcgtgaccgtgagctcg

SEQ ID NO: 58418 - RNA, 360 nt, synthetic construct
  misc_feature 1..360: note = derived and/or modified sequence opt11 from anti-influenza_Chain
  source 1..360: mol_type = other RNA
caggtccagctccagcaatcgggcgcggaagtgaaaaagcccgggagctcggtcaaggtctcgtgcaaggtctcgggcgtgatctttagcgggagcgcgatctcgtgggtgcgccaggccccgggccagggcttggaatggatgggcgggataagcccgctctttggcacgaccaattacgcgcaaaagttccagggcagggtcacgatcacggccgatcaatcgaccaatacaacgtacatggaagtgaactcgctcaggtacgaggacacggccgtgtacttttgcgcgcgcgggcccaagtactatagcgagtacatggacgtgtgggggaaagggaccacggtcacggtctcgagc

SEQ ID NO: 58419 - RNA, 360 nt, synthetic construct
  misc_feature 1..360: note = derived and/or modified sequence opt11 from anti-influenza_Chain
  source 1..360: mol_type = other RNA
caagtgcaattggtccagagcggggccgaggtcaagaaaccgggctcgagcgtgaaagtgagctgtaaagcgagcgggggcacgttctcgagctatgccataagctgggtcaggcaagcgcccgggcaagggctcgagtggatgggcgggatcatgggcatgttcgggaccacgaactatgcccagaaatttcaagggcgcgtgaccataaccgcggacgagttcacgagcgcggcctatatggagctcaggagcttgcgctcggaagataccgcggtctattactgtgccaggagctcgggctattacccggaatatttccaggactggggccagggcacgctcgtgaccgtgagctcg

SEQ ID NO: 58420 - RNA, 360 nt, synthetic construct
  misc_feature 1..360: note = derived and/or modified sequence opt11 from anti-influenza_Chain
  source 1..360: mol_type = other RNA
caaatgcaattggtccagagcggggccgaggtcaagaaaccgggctcgagcgtgaaagtgagctgtaaagcgagcgggggcacgttctcgagctatgccataacctgggtcaggcaagcgcccgggcaagggctcgagtggatgggcgggatcataggaatgttcgggagcacgaactatgcccagaactttcaagggcgcgtgaccataaccgcggacgagagcacgagcacggcctatatggagctctcgagcttgcgctcggaagataccgcggtctattactgtgccaggagcacgggctattacccggcctatctccatcactggggccagggcacgctcgtgaccgtgagctcg

SEQ ID NO: 58421 - RNA, 360 nt, synthetic construct
  misc_feature 1..360: note = derived and/or modified sequence opt11 from anti-influenza_Chain
  source 1..360: mol_type = other RNA
gaagtgcaattggtcgagagcggggccgaggtcaagaaaccgggctcgagcgtgaaagtgagctgtaaagcgagcgggggcacgttctcgagctatggcataagctgggtcaggcaagcgcccgggcaagggctcgagtggatgggcgatatcataggcatgttcgggagcacgaactatgcccagaactttcaagggcgcttgaccataaccgcggacgagagcacgagcacggcctatatggagctcagctcattgcgctcggaagataccgcggtctattactgtgccaggagctcgggctattacccggcctatctcccgcactggggccagggcacgctcgtgaccgtgagctcg

SEQ ID NO: 58422 - RNA, 360 nt, synthetic construct
  misc_feature 1..360: note = derived and/or modified sequence opt11 from anti-influenza_Chain
  source 1..360: mol_type = other RNA
gaagtgcaattggtcgagagcggggccgaggtcaagaaaccgggctcgagcgtgaaagtgagctgtaaagcgagcgggggcacgttctcgagctatgccataagctgggtcaggcaagcgcccgggcaagggctcgagtggatgggcgggatcataggcatgttcgggaccgcgaactatgcccagaaatttcaagggcgcgtgaccataaccgcggacgagttcacgagcacggcctatatggagctctcgagcttgcgctcggaagataccgcggtctattactgtgccaggggcaattactattacgagagctcactcgattactggggccagggcacgctcgtgaccgtgagctcg

SEQ ID NO: 58423 - RNA, 360 nt, synthetic construct
  misc_feature 1..360: note = derived and/or modified sequence opt11 from anti-influenza_Chain
  source 1..360: mol_type = other RNA
caagtccaactagtccaaagcggagccgaagtcaaaaaaccaggctccagcgtcaaagtcagctgcaaagccagcggcggcccattcagaaacttcgccataaactgggtcagacaagcacccggacaaggactcgaatggatgggcggcatcatcgccgtcttcggcaccacaaaatacgcccacaaattccaaggccgcgtaaccataaccgcagacgacagcacaaacacagcctacatggaactcggcagcctaaaatcagaagacacagccgtctactactgcgccagaggcccacactactactcaagctacatggacgtctggggcgaaggcacaaccgtaaccgtcagcagc

SEQ ID NO: 58424 - RNA, 360 nt, synthetic construct
  misc_feature 1..360: note = derived and/or modified sequence opt11 from anti-influenza_Chain
  source 1..360: mol_type = other RNA
gaggtggcgttggtggagacgggggcggaggtgaagaagccggggagtagtgtgaaggtgccgtgtaagagtagtgggagcccgtttaggagtaatgcggtgagctgggtgaggcaggcgccggggcaggggttggagtgggtgggggggatattgggggtgtttgggagtccgagttatgcgcagaagtttcaggggagggtgacgataacggcggatgagagcacgaatacggtgcatatggagttgagagggttgaggagtgaggatacggcggtgtattattgtgcgagggggccgacgtattattatagctatatggatgtatgggggaaggggacgacggtgacggtgagtagt

SEQ ID NO: 58425 - RNA, 360 nt, synthetic construct
  misc_feature 1..360: note = derived and/or modified sequence opt11 from anti-influenza_Chain
  source 1..360: mol_type = other RNA
caaatgcaattggtccagagcggggccgaggtcaagaaaccgggctcgagcgtgaaagtgagctgtaaagcgagcgggggcacgttctcgagctatgccataagctgggtcaggcaagcgcccgggcaagggctcgagtggatgggcgggatctttggcatgttcgggaccgcgaactatgcccagaaatttcaagggcgcgtgacaataaccgcggacgagttcacgagcgcggcctatatggagctctcgagcctgggctcggaagataccgcgatgtattactgtgccaggagctcgggctattacccgcaatatttccaggactggggccagggcacgctcgtgaccgtgagctcg

SEQ ID NO: 58426 - RNA, 360 nt, synthetic construct
  misc_feature 1..360: note = derived and/or modified sequence opt11 from anti-influenza_Chain
  source 1..360: mol_type = other RNA
caggtccagctcgtgcaatcgggcgcggaagtgaaaaagcccgggagctcggtcaaggtctcgtgcaaggcctcgggcgtgacctttagctattacgcgatgtcgtgggtgcgacaggccccgggccagggcttggaatggatgggcgggataagcccgatgtttggcacgaccacgtacgcgcaaaagttccagggcagggtcacgatcacggccgatgactcgacctcgaccgcgtacatggaagtgcgctcgctcaggagcgaggacacggccgtatactattgcgcgcgctcgagcaactactatgactcggtctatgactattgggggcaagggaccttggtcacggtctcgagc

SEQ ID NO: 58427 - RNA, 360 nt, synthetic construct
  misc_feature 1..360: note = derived and/or modified sequence opt11 from anti-influenza_Chain
  source 1..360: mol_type = other RNA
gaggtccagctcgtggaaacgggcgcggaagtgaaaaagcccgggagctcggtcaaggtcccgtgcaagagctcgggctcgccctttcgctcgaacgcggtctcgtgggtgcgacaggccccgggccagggcttggaatgggtcgggggcatactcggggtctttggctcgccctcgtacgcgcaaaagttccagggcagggtcacgatcacggcagatgaatcgaccaataccgtgcacatggaattgcgcgggctaaggagcgaggacacggccgtgtactattgcgcgcgcgggcccacgtactattactcgtacatggacgtgtgggggaaagggaccacggtcacggtctcgagc

SEQ ID NO: 58428 - RNA, 360 nt, synthetic construct
  misc_feature 1..360: note = derived and/or modified sequence opt11 from anti-influenza_Chain
  source 1..360: mol_type = other RNA
caagtgcacttggtccagagcggggccgaggtcaggaaaccgggcgcgagcgtgaaagtgagctgtaaagtgagcgggtacacgctcaatgaattgagcatacactggctcaggcaagcgcccgggcgcgggctagagtggatgggatcgttcgatcccgaggacggggaaacgatctatgcccagaaatttcaagggcgcgtgaccatgaccggggacacgagcacggacacagcctatctagagctcacgagcttgcgctcggaagataccgcgctctattactgtgccaggggctggggcgcggtcacgagcccgttcgatttctggggccagggcacgctcgtgaccgtgagctcg

SEQ ID NO: 58429 - RNA, 360 nt, synthetic construct
  misc_feature 1..360: note = derived and/or modified sequence opt11 from anti-influenza_Chain
  source 1..360: mol_type = other RNA
gaagtgcaattggtccagagcggggccgaggtcaagaaaccgggctcgagcatgaaagtgagctgtaaagcgagcgggagcatattctcgaactatggcataagctgggtcaggcaagcgcccgggcaagggctcgagtggatgggcgggatcatacccatattcggggccgcgaactatgcccagaaatttcaagggcgcgtgaccataaccgcggacgagagcacgagcacggtctatatggaggtcaggagcttgcgctcggaagataccgcggtctattactgtgccaggcgccagcaattgtacaagggctattaccatcactggggccagggcacgctcgtgaccgtgagctcg

SEQ ID NO: 58430 - RNA, 360 nt, synthetic construct
  misc_feature 1..360: note = derived and/or modified sequence opt11 from anti-influenza_Chain
  source 1..360: mol_type = other RNA
caagtgcaattggtccagagcggggccggggtcaagaaaccgggctcgagcatgaaagtgagctgtaaagcgagcgggagcatattctcgaactatggcataagctgggtcaggcaagcgcccgggcaagggctcgagtggatgggcgggatcatacccatattcggggccgcgaactatgcccagaaatttcaagggcgcgtgaccataaccgcggacgagagcacgagcacggtctatatggaggtcaggagcttgcgctcggaagataccgcggtctattactgtgccaggcgccagcaattgtacaagggctattaccatcactggggccagggcacgctcgtgaccgtgagctcg

SEQ ID NO: 58431 - RNA, 360 nt, synthetic construct
  misc_feature 1..360: note = derived and/or modified sequence opt11 from anti-influenza_Chain
  source 1..360: mol_type = other RNA
caagtccaactccaagaatccggccccggcctcgtcaaaccctccgaaaccctctccctcacctgcaccgtctccggcggcctcatcggcaccggctcctactactggggctggatccgccaaacccccggcaaaggcatggaatggatcggctccatctcctactccggctccacctactaccacccctccctcaaatcccgcgtcaccatctccgacgacacctccaaaaaccaactcttcctcaaactccgctccgtcaccgccgccgacaccgcccaatactactgcgcccgctacaactggggcatccgctacttcgacttctggggccgcggcaccctcgtcaccgtctcctcc

SEQ ID NO: 58432 - RNA, 360 nt, synthetic construct
  misc_feature 1..360: note = derived and/or modified sequence opt11 from anti-influenza_Chain
  source 1..360: mol_type = other RNA
caggtccagctagtgcaatcgggcgcggaagtgcgcaagcccgggagctcggtaaaggtctcgtgcaaggtctcgggcgggatcatacgcaagtacgcgatcaattgggtgcgccaggccccgggccagggcttggaatggatgggcgggataatcgcgatctttaacacggccaattacgcgcaaaagttccagggcagggtcacgatcacggccgatgaatcgacctcgaccgtgtacatggaattgagctcgctcaggagcgaggacacggccttgtactattgcgcgcgcgggatgaattactatagcgattactttgactattgggggcaagggagcttggtcacggtctcgccc

SEQ ID NO: 58433 - RNA, 360 nt, synthetic construct
  misc_feature 1..360: note = derived and/or modified sequence opt11 from anti-influenza_Chain
  source 1..360: mol_type = other RNA
caagtccaactcgtccaatccggcggcggcgtcgtccaacccggccgctccctccgcctctcctgcgccgcctccggcttcaccttccgctcccacgccatgcactgggtccgccaagcccccggcaaaggccccgaatgggtcgccctcatctcctacgacgaagtcaacaaattctacgccgactccgtcaaaggccgcttcaccatctcccgcgacgtctccaaaaacaccgtcttcctccaaatgaactccctctccgccgacgacaccgccgtctactactgcgcccgcggccactccggctcctaccgactcttcgacttctggggccaaggaaccctcgtcaccgtctcctcc

SEQ ID NO: 58434 - RNA, 360 nt, synthetic construct
  misc_feature 1..360: note = derived and/or modified sequence opt11 from anti-influenza_Chain
  source 1..360: mol_type = other RNA
caagtgcaattggtcgagagcgggggagggctcgtgcaaccgggcgggagcttgcgcctgagctgtgcagcgagcgggttcatattcggggactttgccatacactgggtcaggcaagcgagcgggaaagggctcgagtgggtggccaggatcaggagcgggctcaaccgctttgaaacggcctatgccgcgagcgtggaagggcgcttgaccataagcagggacgatagcaagagcatggcctatctccagatgaataacgtgaaagcggaagataccgcggtctatctctgtacctatctcgtgggcgcggtcgggttccagcactggggccagggcacgctcgtgaccgtgagctcg

SEQ ID NO: 58435 - RNA, 360 nt, synthetic construct
  misc_feature 1..360: note = derived and/or modified sequence opt11 from anti-influenza_Chain
  source 1..360: mol_type = other RNA
caagtgcaattggtcgagagcgggggcggggtcgtgcaaccgggcaggagcttgcgcttgagctgtgccgcgagcgggttcacgttctcgagctatggcatatactgggtcaggcaagcgcccggaaaagggctcgagtgggtggcctttatctcgtacgatgaaataaacaagttctatgccgatagcgtgaaagggcgctttaccataagcagggacaatagcaagaacacggtctttctccagatgaatagcttgcgcgatgaagataccgcggtctattactgtgccaagcccttgcgcgggagctatcgctatttcgatctctggggcaggggcacggtcgtgaccgtgagctcg

SEQ ID NO: 58436 - RNA, 363 nt, synthetic construct
  misc_feature 1..363: note = derived and/or modified sequence opt11 from anti-influenza_Chain
  source 1..363: mol_type = other RNA
caagtgcaattgcaagagagcgggccagatctcgtgaaaccgggcgcgagcgtgatgataagctgtaaagcgagcgggtactcgttcacgtactattacatgcactgggtcaagcaatcgcacgggaaaacgctcgagtggataggcaggatctatccctataacggggacacgaactataacaggcgctttaaagataaagcgatcttgaccgtggacgagagctcgagcacggcctatatggagctcaggagcttgacctcggaagatagcgcggtctatttctgtgccagggacgcgaactatgaaggggactggtactttgacgtgtgggggcaagggaccacggtcacggtctcgagc

SEQ ID NO: 58437 - RNA, 363 nt, synthetic construct
  misc_feature 1..363: note = derived and/or modified sequence opt11 from anti-influenza_Chain
  source 1..363: mol_type = other RNA
caagtccaactcgtccaatccggcggcggcgtcgtccaacccggccgctcactccgcctatcatgcgccgcctccggcttcaccttctcctcctacgccatgcactgggtccgccaagcccccggcaaaggcctcgaatgggtcgccatcatctcctacgacggcaacgaccaatactacaccgactccgtcaaaggccgattcaccatctcccgcgactcctccaaagtctacctacaaatgcaccgactccgccccgaagacaccgccgtctactactgcgccaaagaattcgaaacctccggctacttccacggctccttcgactactggggccaaggcatcctcgtcaccgtctcctcc

SEQ ID NO: 58438 - RNA, 363 nt, synthetic construct
  misc_feature 1..363: note = derived and/or modified sequence opt11 from anti-influenza_Chain
  source 1..363: mol_type = other RNA
caagtccaagtcgtccaatccggcgccgaagtcaaaaaacccggctcctccgtccgcgtctcctgccaagcctccggcggcaccttcatgaactacgccatcatctgggtccgccgcgcccccggccaaggcctcgaatggatgggcggcatcatccccgtcttccccaccccaaactacgcccaaatgttccaaggccgcgtcaccatctccaccgacgaatcccgctccacctccttcctcgaactcacaaacctccgatacgaagacaccgccgtctactactgcgcccgccgcatctaccacggcggcaactccggcttcgacttctggggccaaggcaccctcgtaaccgtctcctcc

SEQ ID NO: 58439 - RNA, 363 nt, synthetic construct
  misc_feature 1..363: note = derived and/or modified sequence opt11 from anti-influenza_Chain
  source 1..363: mol_type = other RNA
caagtccaactccaagaatccggccccggcctcctcaaaccctccgacaccctcgccctcacctgcaccgtctccggcggctccatcacctccgactactggtcctggatccgccaaccccccggccgcggcctcgactggatcggcttcttctacaacggcggctccaccaaatacaacccctcactcaaatcccgcgtcaccatctccgccgacacctccaaaaaccaactctccctcaaactcacctccgtaaccgccgccgacaccggcgtctactactgcgcccgccacgacgccaaattctccggctcctactacgtcgcctcctggggccaaggcacccgcgtcaccgtctcctcc

SEQ ID NO: 58440 - RNA, 363 nt, synthetic construct
  misc_feature 1..363: note = derived and/or modified sequence opt11 from anti-influenza_Chain
  source 1..363: mol_type = other RNA
caagtccaactccaagaatccggccccggcctcctcaaaccctccgacaccctcgccctcacctgcaccgtctccggcggctccatcacctccgactactggtcatggatccgccaaccccccggccgcggcctcgactggatcggcttcttctacaacggcggctccaccaaatacaacccctccctcaaatcccgcgtcaccatctccgccgacacctccaaaaaccaactctcactaaaactcacctccgtcaccgccgccgacacaggcgtctactactgcgcccgccacgacgtcaaattctccggctcctactacgtcgcctcctggggccaaggcacccgcgtcaccgtctcctcc

SEQ ID NO: 58441 - RNA, 363 nt, synthetic construct
  misc_feature 1..363: note = derived and/or modified sequence opt11 from anti-influenza_Chain
  source 1..363: mol_type = other RNA
caagtccaactccaagaatccggccccggcctcgtcaaaccctccgaaaccctctccgtcacctgcaaagtctccggcgactccatctcctcctactcctggtcctggatccgccaaccccccggcaaaggcctcgaatgggtcggctacctctactactccggctccaccaaatacaacccctccctcaaatcccgcaccaccatctccgtcgacacctcaaccaaccaactctccctcaaactctccttcgtcaccgccgccgacaccgccgtctacttctgcgcccgcaccggctccgaatccaccaccggctacggcatggacgtctggggccaaggcaccaccgtcaccgtctcatcc

SEQ ID NO: 58442 - RNA, 363 nt, synthetic construct
  misc_feature 1..363: note = derived and/or modified sequence opt11 from anti-influenza_Chain
  source 1..363: mol_type = other RNA
gaagtgcaattggtcgagagcggggccgaggtcaagaaaccgggctcgagcgtgaaagtgagctgtaaagcgagcgggggcccgttcaggagctatgccataagctgggtaaggcaagcgcccgggcaagggcccgagtggatgggcgggatcatacccatattcgggaccacgaaatatgccccgaaatttcaagggcgcgtgaccataaccgcggacgatttcgcgggcacggtctatatggagctctcgagcttgcgatcggaagataccgcgatgtattactgtgcaaagcacatgggctatcaagtgcgcgagaccatggacgtgtgggggaaagggaccacggtcacggtctcgagc

SEQ ID NO: 58443 - RNA, 363 nt, synthetic construct
  misc_feature 1..363: note = derived and/or modified sequence opt11 from anti-influenza_Chain
  source 1..363: mol_type = other RNA
caagtgcaactggtccagagcggggcagaggtcaagaaaccgggctcgagcgtgaaagtgagctgtaaagcgagcgggggcccgttcaggagctatgccataagctgggtcaggcaagcgcccgggcaagggcccgagtggatgggcgggatcatacccatattcgggaccacgaaatatgccccgaaatttcaagggcgcgtgaccataaccgcggacgatttcgcgggcacggtctatatggagctctcgagcttgcgctcagaagataccgcgatgtattactgtgccaagcacatgggctatcaagtgcgcgagaccatggacgtgtgggggaaagggaccacggtcacggtctcgagc

SEQ ID NO: 58444 - RNA, 363 nt, synthetic construct
  misc_feature 1..363: note = derived and/or modified sequence opt11 from anti-influenza_Chain
  source 1..363: mol_type = other RNA
gaagtgcaattggtcgagaccggggccgaggtcaagaaaccgggcgcgagcgtgaaagtgagctgtaaagcgagcgggtacacgttcacgagctattacatgcactgggtcaggcaagcgcccgggcaagggctcgagtggatgggctggataaatcccaatagcgggggcacgaactatgcacagaaatttcaagggcgcgtgaccatgaccagggacacgagcataagcacggcctatatggagctctcgagattgcgctcggacgataccgcggtctattactgtgccagggaagggaaatggggaccgcaagcggcctttgacatatgggggcaagggaccatggtcacggtctcgagc

SEQ ID NO: 58445 - RNA, 363 nt, synthetic construct
  misc_feature 1..363: note = derived and/or modified sequence opt11 from anti-influenza_Chain
  source 1..363: mol_type = other RNA
gaggtgcagttggtggagagtggggcggaggtgaagaagccggggagtagtgtgaaggtgagttgtaaggcgagtggggggacgtttagtttttatagtatgagttgggtgaggcaggcgccggggcaggggttggagtggatgggggggataataccgatgtttgggacgacgaattatgcgcagaagtttcaggggagggtgacgataacggcggtggagagcacgagtacggcgtatatggaggtgagtagtctgaggagtgaggatacggcggtgtattattgtgcgaggggggataaggggatatattattattatatggatgtgtgggggaaggggacgacggtgacggtgagtagt

SEQ ID NO: 58446 - RNA, 363 nt, synthetic construct
  misc_feature 1..363: note = derived and/or modified sequence opt11 from anti-influenza_Chain
  source 1..363: mol_type = other RNA
gaggtccagctcgtggaaacgggcgcggaagtgaaaaagcccgggagctcggtcaaggtctcgtgcaaggcctcgggcgggacctttcgcacgcacgcgatatcgtgggtgcgccaggccccgggccagggcttggaatggatgggcgggataatcgcgatctttggcacggccaattacgcgcaaaagttccagggcaggatcacgatcacggccgatgaatcgacctcgaccgcgtacatggaattgagctcgctcaggagcgaggacacggccgtgtacttttgcgcgcgcgggagcgggtaccatatctcgaccccgttcgataactggggccagggcacgctcgtgaccgtaagctcg

SEQ ID NO: 58447 - RNA, 363 nt, synthetic construct
  misc_feature 1..363: note = derived and/or modified sequence opt11 from anti-influenza_Chain
  source 1..363: mol_type = other RNA
gaggtccagctcgtgcaatcgggcgcggaagtgaaaaagcccgggagctcggtcaaggtctcgtgcaaggcctcgggcgggatctttcgctcgaactcgatctcgtgggtgcgccaggccccgggccagggcttggaatggatgggcgggatattcgcgctctttggaacgaccgattacgcgcaaaagttccagggcagggtcacgatcacggccgatgaatcgagcacgaccgtgtacttggaattgagctcgctcacgagcgaggacacggccgtgtactattgcgcgcgcgggagcgggtacacgaccaggaactatttcgattactggggccagggcacgctcgtgaccgtgagctcg

SEQ ID NO: 58448 - RNA, 363 nt, synthetic construct
  misc_feature 1..363: note = derived and/or modified sequence opt11 from anti-influenza_Chain
  source 1..363: mol_type = other RNA
gaggtccagctcgtggaatcgggcgcggaagtgaaaaagcccgggagctcggtcaaggtctcgtgcaaggcctcgggcgggatctttaactcgtacgcgatctcgtgggtgcgccaggccccgggccagggcttggaatggatgggcgggataatcgcgatctttcacacgcccaagtacgcgcaaaagttccagggcagggtcacgatcacggccgatgaatcgaccaataccgcgtacatggaattgcgctcgctcaagagcgaggacacggccttgtactattgcgcgcgcgggagcacgtacgatttctcgagcgggctcgattactggggccagggcacgctcgtgaccgtgagctca

SEQ ID NO: 58449 - RNA, 363 nt, synthetic construct
  misc_feature 1..363: note = derived and/or modified sequence opt11 from anti-influenza_Chain
  source 1..363: mol_type = other RNA
caggtccagctagtgcaatcgggcgcggaagtgaaaaagcccgggagctcggtcaaggtctcgtgcaagagctcgggcgggaactttaacaattacgcggtctcgtgggtgcgccaggccccgggacagggattggaatggatgggcgggataagcccgatctttggctcgaccaatcacgcgcaaaagttccagggcagggtcacgatctcggccgatatctttaccaataccgcgtacatggaattgagctcgctcaggagcgatgacacggccatatactattgcgcgcgcgggcgagggtactatttctatcacgcgatggatgtctggggccagggctcgaccgtgaccgtgagctcg

SEQ ID NO: 58450 - RNA, 363 nt, synthetic construct
  misc_feature 1..363: note = derived and/or modified sequence opt11 from anti-influenza_Chain
  source 1..363: mol_type = other RNA
caggtccagctagtacaatcgggcgcggaagtcaaaaagcccgggagctcagtaaaggtctcgtgcaaggcctcgggcgggacctttaacaattacgcgatcaattgggtgcgccaggccccgggccagggcttggaatggatgggcgggataagcccgatctttggctcggtcaattacgcgcaaaagctccagggcagggtcacgatcacggccgatgtctttacctcgaccgcgtacatggaattgagctcactcagaagcgaggacacggccgtgtactattgcgcgaaagggagcgggtactactactattacgggctcgatgtctggggcctgggcacgaccgtgaccgtgagctcg

SEQ ID NO: 58451 - RNA, 363 nt, synthetic construct
  misc_feature 1..363: note = derived and/or modified sequence opt11 from anti-influenza_Chain
  source 1..363: mol_type = other RNA
caggtccagctcgtggaatcgggcggaggcgtggtccagcccgggcgctcgctcaggctctcgtgcgcggcctcgggctttacctttaccaattacgcgatgcattgggtgcgccaggccccgggcaagggcttggaatgggtcgcggtcatcagctttgacgaggacaataaatcgtacgcggactatgtcaagggcaggttcacgatatcgcgagataactcgaacaatcgcttgtacttgcaaatgaactcgctaagggccgaggacacggccgtgtactattgcgcgcgcgggcccgagggcgtgtgggggcgctcgatcgatagctggggccagggcacgctcgtgaccgtgagctcg

SEQ ID NO: 58452 - RNA, 363 nt, synthetic construct
  misc_feature 1..363: note = derived and/or modified sequence opt11 from anti-influenza_Chain
  source 1..363: mol_type = other RNA
caggtccagctcgtgcaatcgggcggggacttggtccagcccgggggctcgctcaggctctcgtgcgcggcctcgggctttacctttagcaggtactcgatgaattgggtgcgccaggccccgggcatgggcttggaatgggtagcgtacataagcgatacctcgcgcacgatctattacgcggactcggtcaagggcaggttcacgatctcgcgcgataacgcgaaaaatagcttgtacttgcaaatgaaatcgctcagagacgaggacacggccgtgtactattgcgcgcgcgatcccgacaccccgttcgtgcgcgcgttcgatagctggggccagggcacgctcgtgaccgtgagctcg

SEQ ID NO: 58453 - RNA, 363 nt, synthetic construct
  misc_feature 1..363: note = derived and/or modified sequence opt11 from anti-influenza_Chain
  source 1..363: mol_type = other RNA
caagtgcaactggtcgagagcgggggcgggctcgtgcaaccgggcgggagcttgcgcttgagctgtgtcgcgagcgggttcacgttctcgcgctttagcatgaactgggtcaggcaagcgcccgggatggggctcgagtgggtgagctatatctcggacacgggcaggaccatatactatgccgatagcgtgaaagggcgctttaccataagcagggacaatgacaagaacacgctctatctccagatgaagtcgttgcgcgatgaagatagcgcgttctattactgtgccagggacccggacacgccctttgtcagggcatttgacagctgggggcaaggggtcttggtcacggtctcgagc

SEQ ID NO: 58454 - RNA, 363 nt, synthetic construct
  misc_feature 1..363: note = derived and/or modified sequence opt11 from anti-influenza_Chain
  source 1..363: mol_type = other RNA
caagtgcaactgcaagagagcgggcccgatctcgtgaaaccgggcgcgagcgtgaaaatgagctgtaaagcgagcgggtactcgttcacgtactatcacatgcactgggtcaagcaaacgcacgggaaatcgctcgagtggataggcaggatctatccctataacgggggcacgaactatagccagcgctttaaagggaaagcggtctttacagtggacatgagctcgagcacggcctatatggagctcaggagcttgacctcggaagatagcgcggtctattactgtgccagggacgcgaactatgaaggggactggtactttgacgtgtgggggcaagggaccacggtcacggtctcgagc

SEQ ID NO: 58455 - RNA, 366 nt, synthetic construct
  misc_feature 1..366: note = derived and/or modified sequence opt11 from anti-influenza_Chain
  source 1..366: mol_type = other RNA
cagggccagctcgtgcaatcgggcgcggaagtgaaaaagagcgggagctcggtcaaggtctcgtgcaagacctcaggcgggacctttaactcgcacgcgatctcatgggtgcgccaggccccgggccagggcttggaatggatcgggggcataatcccgatgtttggcacgaccaattacgcgcaaaagctcaagggcaggatcgcgatcacggccgatcaattgcccacgaccgcgtacctggaattgagctcgctaaggagcgaggacacggccgtgtactattgcgcgcgcgggcaaagatactattacgatcgcgatggcatggacgtgtgggggcaagggaccatggtcacggtctcgagc

SEQ ID NO: 58456 - RNA, 366 nt, synthetic construct
  misc_feature 1..366: note = derived and/or modified sequence opt11 from anti-influenza_Chain
  source 1..366: mol_type = other RNA
caagtccacctagtccaatccggcgccgaagtcaaaaaacccggctcatccgtccgcctctcctgctccgcctccggcggccccttctccggcttcgccatctcctggctccgacaagcccccggccaaggcctcgaatggctcggcggcatctccgccgtcttcggcaccgccacctacgcccaaaaattccaaggccgcgtcacaatcaccgccgaccaattcacctcaacctcccacatggacctctcccgcctcacctacgacgacaccgcagtctactactgcgcccgctccggcggctacctcccccaaaacaactggatcgacccctggggccaaggcaccctcgtcatcgtctcctcc

SEQ ID NO: 58457 - RNA, 366 nt, synthetic construct
  misc_feature 1..366: note = derived and/or modified sequence opt11 from anti-influenza_Chain
  source 1..366: mol_type = other RNA
caggtccagctcgtgcaatcgggagcggaagtgaaaaaggccgggagctcggtaaaggtctcgtgccagagctcgggcgtgacctttagcatgtacgcggtctcgtgggtgcgccaggccccgggccagggcttggaatggatgggagggataatcccgctctttggcacgacaacgtacgcgcaaaagttcgagggcaggctcacgatcacggcagatacctcgaccaatatggcgtacttggaattgcgctcgctcaggagcgaggacacggccgtgtacttttgcgcgcgcgcgggcacgaccgtgaccaggttcaattggtttgacccgtgggggcaagggaccttggtcacggtctcgagc

SEQ ID NO: 58458 - RNA, 366 nt, synthetic construct
  misc_feature 1..366: note = derived and/or modified sequence opt11 from anti-influenza_Chain
  source 1..366: mol_type = other RNA
caggtccagctcgtgcaatcgggcgcggaagtgaaaaagcccgggagctcgctaaaggtctcgtgcaaggcctcgggcgtgacctttagcatgtacacgatctcgtgggtgcgccaggccccgggccagggcttggaatggatgggcgggataatcccgctctttggcacggccaattacgagcaaaagttccagggcagggtcacgatcacggccgatacctcgaccaataccgcgtacatggaattgagctcgctcaggagcgaggacacggccgtgtactattgcgcgcgcgcgggcacgaccttgaccaggttcaattggtttgacccgtgggggcaagggaccctggtcacggtctcgagc

SEQ ID NO: 58459 - RNA, 366 nt, synthetic construct
  misc_feature 1..366: note = derived and/or modified sequence opt11 from anti-influenza_Chain
  source 1..366: mol_type = other RNA
atggccgacaacatgaccaccacccaaatcgaatggcgaatgaaaaaaatggccatcggctcctccacccactcctcatccgtcctcatgaaagacatccaatcccaattcgaacaactcaaactccgctgggaatcctaccccaacctcgtcaaatccaccgactaccaccaaaaacgcgaaaccatccgcctcgccaccgaagaactctacctcctatccaaacgcatcgacgactccatcctcttccacaaaaccgtcatcgccaactcctccatcatcgccgacatgatagtctccctctccctactcgaaaccctctacgaaatgaaagacgtcgtcgaagtctactcccgccaatgcctc

SEQ ID NO: 58460 - RNA, 366 nt, synthetic construct
  misc_feature 1..366: note = derived and/or modified sequence opt11 from anti-influenza_Chain
  source 1..366: mol_type = other RNA
gaggtccagctcgtgcaatcgggcgggggcttggtccagcccgggggctcgctcaggctcgcgtgcgtggtctcgggatttaccgtgacctcgaactatatcacgtgggtgcgccaggccccgggcaagggcttggaatgggtctcggtcatatactcgcacgggcgcgcgtactatagcgcgagcgtgaacgggcgatttaccataagcaggcacacgagcaagaacacggtctatctcgagatgaatagcttgcgcccggaagataccgcggtctattactgtgccgggggcgggctagtgggcgggtacgatgaatatttctttgactattgggggcaagggaccttggcaacggtctcgagc

SEQ ID NO: 58461 - RNA, 366 nt, synthetic construct
  misc_feature 1..366: note = derived and/or modified sequence opt11 from anti-influenza_Chain
  source 1..366: mol_type = other RNA
caagtgcaattggtccagagcggggccgaggtcaagaaaccgggcgcgagcgtgaaagtgagctgtaaagcgagcgggtacacgttcacgggctattacatgcactgggtcaggcaagcgcccgggcaagggctcgagtggatgggctggatcaatcccaatagcggggacacgaactatgcccagaaatttcaagggcgcgtgaccatgaccagggacacgagcataaccacggcctatatggagctctcgagcttacgctcggacgataccgcggtctattactgtgccagggactcgccctatagctcgagctggagctttttcgattactggggccagggcccgctcgtgaccgtgagctcg

SEQ ID NO: 58462 - RNA, 366 nt, synthetic construct
  misc_feature 1..366: note = derived and/or modified sequence opt11 from anti-influenza_Chain
  source 1..366: mol_type = other RNA
gaggtgcagttggtggagagcgggggggggttggtgcagccgggggggagcctgaggttgagttgtgcggcgagcgggtttatatttaggaattattggatgagctgggtgaggcaggcgccggggaaggggttggagtgggtggcgaatataaagcaggatgggagggagaagtattatgtggatagtctgagggggagggtgaatataagtagggataatgcggagaatagtttgtatttgcatatgaatagtttgagggtggaggatacggcggtgtatttttgtgcgagggcgaggatggtggtggtgacgggggatgggtttgatgtgtgggggcatgggacgatggtgacggtgagtagt

SEQ ID NO: 58463 - RNA, 366 nt, synthetic construct
  misc_feature 1..366: note = derived and/or modified sequence opt11 from anti-influenza_Chain
  source 1..366: mol_type = other RNA
gaagtgcaattgctcgagagcgggggcgggctcgtgcaaccgggcgggagcttgcgcttgagctgtgccgcgagcgggttcgcgttctcgagctatggcatgagctgggtcaggcaagcgcccgggaaagggctcgagtgggtgagcgcgttctcgggctcgggcacgagcacgtactatgccgatagcgtgaaagggcgctttaccataagcagggacaagagcaagaacacgctatatctccagatgaatagcttgcgcgcggaagataccgcgatctattactgtgccaagcccccgggcccgtacatagtcgtggccgggctctttgaaaattgggggcgagggaccctggtcacggtctcg

SEQ ID NO: 58464 - RNA, 366 nt, synthetic construct
  misc_feature 1..366: note = derived and/or modified sequence opt11 from anti-influenza_Chain
  source 1..366: mol_type = other RNA
gaggtccagctcgtggaatcgggcgggggcgtggtacagcccgggcgctcgctcaggctctcgtgcgcggcctcgggctttagctttagcaattacgcgatgcattgggtgcgccaggccccgggcaagggcctggaatgggtcgcgctcatatcatttgacgggagcgataaatattacgcggactcggtcaagggcaggttcacgatgtcgcgcgataacagcaaaaataccttgtacttgcaaatgaactcactcagggccgaggacacggccgtgtactattgcgcgcgcgatgaaccgtactgtggcggggactgtttcgcgttcgatgtctggggccagggcacgatggtgacagtgagc

SEQ ID NO: 58465 - RNA, 366 nt, synthetic construct
  misc_feature 1..366: note = derived and/or modified sequence opt11 from anti-influenza_Chain
  source 1..366: mol_type = other RNA
caggtccagctccagcaatcgggcccgggcttggtcaagccctcgcaaacgctctcgctcacgtgcacagtctcgggcgggcccgtgagcgggggcgggtactcgtggaattggatacgccagcgcccgggccagggcttggaatgggtcgggttcatgttccatagcggaagcccgcgctataacccgaccttgaaatcgcgcataaccataagcgtggacacgagcaagaacttggtctcgctcaagctctcgagcgtgaccgcggccgataccgcggtctatttctgtgccagggtcgggcaaatggacaagtactatgccatggacgtgtgggggcaagggaccacggtcacggtctcgagc

SEQ ID NO: 58466 - RNA, 366 nt, synthetic construct
  misc_feature 1..366: note = derived and/or modified sequence opt11 from anti-influenza_Chain
  source 1..366: mol_type = other RNA
caggtccagctcgtgcaatcgggcgggggcttggtcaagcccgggggctcgctcaggctctcgtgcgcggcctcgggctttacctttagctcgtactcgatgaattgggtgcgccaggccccaggcaagggcctggaatgggtctcgagcataagctcgagctcgagctatatctattacgtggactcggtcaagggcaggttcacgatctcgcgcgataacgcgaaaaatagcttgtacttgcaaatgaactcgctcagggccgaggacacggccgtgtactattgcgcgcgcgggggcgggagctatggcgcgtacgagggctttgactattgggggcaagggaccttggtcacggtctcgagc

SEQ ID NO: 58467 - RNA, 366 nt, synthetic construct
  misc_feature 1..366: note = derived and/or modified sequence opt11 from anti-influenza_Chain
  source 1..366: mol_type = other RNA
caggtccagctcgtgcaatcaggcgggggcgtggtccagcccgggcgctcgctcaggctctcgtgcgcggcctcgggctttaactttagctcgtacgggatgcattgggtacgccaggccccgggcaagggcttggaatggctctcggtcatatggtcgggcgggagcaataaatattacgcggactcggtcaagggcaggttcacgatctcgcgcgatgactcgaaaaataccgtgtacttgcaaatgaactcgctcagggacgaggacacggccgtgtactattgcgcgcgcgcgcacacggccttgaccagattcaggtggttggacccgtgggggcaagggatcctggtcacggtctcgagc

SEQ ID NO: 58468 - RNA, 366 nt, synthetic construct
  misc_feature 1..366: note = derived and/or modified sequence opt11 from anti-influenza_Chain
  source 1..366: mol_type = other RNA
caagtccaactcgtccaatccggcggcggcgtcgtacaacgcggccgatccctccgcctctcctgcgccgcctccggcttcaccttccgcacctacggcatgcactgggtccgccaagcccccggcaaaggcctcgaatgcgtcgccctcatctcctacgacggcaccaacaaatactacgccgactccgtcaaaggccgcttcaccatctcccgcgacaactccaaagacaccctctacctccaaatgaactccctccgcgccgaagacaccggcgtctactactgcgcctccctcgactacgacttctcctactactaccaccgcgacgtctggggccccggcaccaccgtcaccgtctcctcc

SEQ ID NO: 58469 - RNA, 366 nt, synthetic construct
  misc_feature 1..366: note = derived and/or modified sequence opt11 from anti-influenza_Chain
  source 1..366: mol_type = other RNA
caagtgcaattggtcgagagcgggggcgggctcgtgcaaccgggcgggagcttgcgcctgagctgtgccgcgagcgggttcacgttctcggactattggatggtctgggtcaggcaagcgcccgggaaagggctcgtgtgggtgagcaggatctcgagcgatggctcgacaacgagctatgccgatagcgtgaaagggccctttaccataagcagagacaatgccaagaacacgctctatctccagatgaatagcttgcgcgcggaagataccgcggtctattactgtgccagggtcgcgaccccgtactattacgagagcgggttcgattactggggccagggcgcgctcgtgaccgtgagctcg

SEQ ID NO: 58470 - RNA, 369 nt, synthetic construct
  misc_feature 1..369: note = derived and/or modified sequence opt11 from anti-influenza_Chain
  source 1..369: mol_type = other RNA
caattccaactcgtccaatccggccccgaagtcaaaaaacccggcacctccgtcaaagtctcctgcaaagcctccggctacacctccaccacctacggcatctcctgggtccgccaagtccccggccaaggactcgaatggatgggctggatcaacccctacaacggcaacccccactacggccaaaaattccaaggccgcgtcaccctaacccgcgacacctccaccaacaccgcctacctcgaaatcctctccctccgctccgacgacaccgccgtctactactgcgcccgcgacggctggggccaacaactcgtcccctactacttcgactactggggccaaggcaccctcgtcaccgtctcctcc

SEQ ID NO: 58471 - RNA, 369 nt, synthetic construct
  misc_feature 1..369: note = derived and/or modified sequence opt11 from anti-influenza_Chain
  source 1..369: mol_type = other RNA
caagtccaactcgcccaatccggcgccgaagtcaaacgccccggctcctccgtcaaagtctcctgcaccgcctccggcggcatcttccgcaaaaacgccatctcctgggtccgccaagcccccggccaaggcctcgaatggatgggcggcatcatcgccgtcttcaacaccgccaactacgcccaaaaattccaaggccgcgtcaaaatcaccgccgacgaatccggcaacaccgcctacatggaactctcctccctccgctccgacgacaccgccgtctactactgcgcctcccaccccaaatacttctacggctccggatcctaccccgacttctggggccaaggcaccctcgtcaccgtctcatca

SEQ ID NO: 58472 - RNA, 369 nt, synthetic construct
  misc_feature 1..369: note = derived and/or modified sequence opt11 from anti-influenza_Chain
  source 1..369: mol_type = other RNA
caagtccaactccaagaatccggccccggcctcgtcaaaccctccgaaaccctctccctcacctgcaccgtctcccgaggctccatcggccactacttctggtcctggatccgccaaccccccggcaaaggcctcgaatggatcggatacatctcctactccggctccaccaaatacaacccctccctccgctcccgcgtcaccatctccgtcgacacctccaaaaaccaattctccctcaacctcaactccgtcaccgccaccgacaccgccctctactactgcgcccgcgaagactacgacatcctcaccggcgccggccccggcatggaagtctggggccaaggcaccaccgtcaccgtctcctcc

SEQ ID NO: 58473 - RNA, 369 nt, synthetic construct
  misc_feature 1..369: note = derived and/or modified sequence opt11 from anti-influenza_Chain
  source 1..369: mol_type = other RNA
caagtccaactccaagaatccggccccggcctcgtcaaaccctccgaaaccctctccctcacctgcaccgtctccggcgcctccatcaactcccactactggtcctggatccgccaaccccccggcaaaggcctcgaatggatcggctacgtctactactccggctccaccacctacaacccctccctcaaatcacgcgtcaccctatccgtcgacacctccaaaaaccaattctccctaaacctctcctcagtcaccgccgccgacaccgccttctactactgcgcccgacacccctacgacgtcctcaccggctcaggcgactggttcgacccctggggccaaggcaccctcgtcaccgtctcctcc

SEQ ID NO: 58474 - RNA, 369 nt, synthetic construct
  misc_feature 1..369: note = derived and/or modified sequence opt11 from anti-influenza_Chain
  source 1..369: mol_type = other RNA
caggtccagctcgtgcaatcgggcgcggaagtgaaaaggcccgggagctcggtcaaggtatcgtgcacggcctcaggcgggatctttcgcaagaacgcgatctcgtgggtgcgccaggccccgggccagggcttggaatggatgggcgggataatcgcggtctttaacacggccaattacgcgcaaaagttccagaacagggtcaagatcacggccgatgaatcgggcaataccgcgtacatggaattgagctcgctcacgagcgatgacacggccgtgtactattgcgcgagccatcccaagtacttttacgggagcgggagctatcccgatttctggggccagggcacgctcgtgaccgtgagctcg

SEQ ID NO: 58475 - RNA, 369 nt, synthetic construct
  misc_feature 1..369: note = derived and/or modified sequence opt11 from anti-influenza_Chain
  source 1..369: mol_type = other RNA
gaagtgcaattggtcgagagcggggccgaggtcaagaaaccgggctcgagcgtgaaagtgagctgtaaagcgagcgggggcacgttcaggagctatgccgtgagctgggtcagacaagcgcccgggcaagggctcgagtggatgggcgggatcatagccatattcgggaccacgaactatgcccagaaatttcaagatcgcgtgaccataaccgcggacgatctaccgagcacggcctatatggagctcacgagcttgcgctcggaagataccgcggtctatttctgtgtaaggggcaggggctattacttgggcggggactatggctcgctcgatagctggggccagggcacgctagtgaccgtgagc

SEQ ID NO: 58476 - RNA, 369 nt, synthetic construct
  misc_feature 1..369: note = derived and/or modified sequence opt11 from anti-influenza_Chain
  source 1..369: mol_type = other RNA
gaagtgcaattggtcgagagcgggggcgggctcgtgcaaccgggcaggagcttgcgcctgagctgtgtcgggagcgggttcaatttcgatggctatgccatgcaatgggtcaggcaagtgcccgggaaagggctagagtgggtgagcgggatctcgtggcatagcgatagcacgggctatgccgatagcgtgcgcgggcgctttaccataagcagggacaatgccaagaactcgctctatctccagatggatagcttgcgcccggaagataccgcgttctattactgtggcaagagcataggccatgtcgggggctcgtacagacacccgatcgattactggggccagggcacgctcgtgaccgtgagc

SEQ ID NO: 58477 - RNA, 369 nt, synthetic construct
  misc_feature 1..369: note = derived and/or modified sequence opt11 from anti-influenza_Chain
  source 1..369: mol_type = other RNA
caagtccaactccaagcctccggccccggcctcgtcaaaccctccgaaacactctccctcacatgcaccgtctccggcgactccatcacctccggcgcctactactggacctggatccgccaacaccccggcaaaggactcgaatggatcggctacatctactactccggcaacacctactacaacccctccctcaaatcccgcgtcaccatctccctcgacacctccaaaaaccaattctccctcaaagtcaactccgtcaccgccgccgacaccgccgtctactactgcgcccgagccgcctccacctccgtcctcggctacggcatggacgtctggggccaaggcaccaccgtcaccgtctcctcc

SEQ ID NO: 58478 - RNA, 369 nt, synthetic construct
  misc_feature 1..369: note = derived and/or modified sequence opt11 from anti-influenza_Chain
  source 1..369: mol_type = other RNA
caggtccagctcgtgcaatcgggcgcggaagtgaaaaagcccgggagctcggtcagggtctcgtgcaaggcctcgggctcgatctttcgcaattacgcgatgtcgtgggtgcgccaggccccgggccagggcttggaatggatgggcgggataatcgcgatctttggcacgcccaagtacgcgcaaaagttccagggcagggtcacgatcacggccgatgaatcgacctcgaccgtgtacatggaattgagcgggctcaggagcgaggacacggccatgtactattgcgcgcgcataccccattacaatttcgggagcgggagctatttcgattactggggccagggcacgctcgtgaccgtgagctca

SEQ ID NO: 58479 - RNA, 369 nt, synthetic construct
  misc_feature 1..369: note = derived and/or modified sequence opt11 from anti-influenza_Chain
  source 1..369: mol_type = other RNA
caactccaactccaagaatccggcccccgactcgtcaaaccctccgaaaccctctccctcacctgctctgtctccggcgtctccatctcctcctccaactactactggggctggatccgccaaccccccggcaaaggcctcgaatggatcggcaccatctaccactccggctccacctactacaacccctccctcaaatcccgcctcatcatctccgtcgacacatccaaaaaccaattctacctccaactcacctccctcaccgccgccgactccgccgtctactactgcgccaccggcggcggcttcggctggtcccaaacctacttcggctactggggccaaggcaccctcgtcaccgcctcctcc

SEQ ID NO: 58480 - RNA, 369 nt, synthetic construct
  misc_feature 1..369: note = derived and/or modified sequence opt11 from anti-influenza_Chain
  source 1..369: mol_type = other RNA
gaagtccaactccaacaatccggccccgaactcgtcaaacccggcgcctccgtcaaaatgtcctgcaaagcatccggctacaccttcacctccttcatcatgtactgggtcaaacaaaaacccggccaaggcctcgaatggctcggctacatcgacccctacaacgacggcaccaaatacaacgaaaaattcgaaggcaaagccaccctcacctccgacaaatcatcctccaccgcctacatggaactctcctccctcacctccgaagactccgccgtctactactgcgccaaacgcggcaactacggcaacggcttcgcctactggggccaaggcaccctagtcaccgtctcagccgccaaaacctcc

SEQ ID NO: 58481 - RNA, 369 nt, synthetic construct
  misc_feature 1..369: note = derived and/or modified sequence opt11 from anti-influenza_Chain
  source 1..369: mol_type = other RNA
caggtccagctcttggaatcgggcggggacgtggtccagcccgggacctcgctcaggctatcgtgcgcggcctcgggctttagcttgtggacgagcgggatgcattgggtgcgccaggccccgggcaagggcttggaatgggtcgcggtcatgagctatgacgagacaaagaaatattacgcggactcggtcaggggcaggttctcgatctcgcgcgataactcgcgcaatacattgtacttgcaaatgaactcgctaagggtcgaggacacggccgtgtacttttgcgcgaaaccgcgcttggactatctagattactttcacgcggccgatagctggggccagggcacgctcgtgagcgtgagctcg

SEQ ID NO: 58482 - RNA, 369 nt, synthetic construct
  misc_feature 1..369: note = derived and/or modified sequence opt11 from anti-influenza_Chain
  source 1..369: mol_type = other RNA
caagtccaactcgtcgaatccggcgccgaagtccgcaaacccggcgaatccctccgcatctcctgcaaagcccacggagactccttcacctcctactggatcggctgggtccgccaactccccggcaaaggcctcgaatggatggccgtcatctacccccgagactccgaaaccaaattctcccccgccttccacggccaagtctccatctccgtcgacaaatccacctcaaccgtccacctccaatggaactccctcaaagcctctgacaccgccgtctactactgcgcccgctcccccggctactccggctacctctacggctggttcgacccctggggccaaggcacccccgtcaccgtctcctcc

SEQ ID NO: 58483 - RNA, 369 nt, synthetic construct
  misc_feature 1..369: note = derived and/or modified sequence opt11 from anti-influenza_Chain
  source 1..369: mol_type = other RNA
caagtccaactagtcgaatccggccccggcctcgtcaaaccctccgaaaccctctccctcacctgcaccgtctccggcgactccgtcatcaactccgcctactactgggactggatccgccaaccccccggcaaaggcctcgaatgggtcggctccgtctactactccggcatcacctactacaacccctccctcaaatcccgcgtcaccatctccgtcgacacctccaaaaaccaattctccctccgcctctcctacgtcaccgccgccgacaccgccctctactactgcgcccgccgaggcggcggctggcaatactactacggcatggacgtctggggccaaggcaccaccgtcaccgtctcctcc

SEQ ID NO: 58484 - RNA, 369 nt, synthetic construct
  misc_feature 1..369: note = derived and/or modified sequence opt11 from anti-influenza_Chain
  source 1..369: mol_type = other RNA
caagtccaactcgtccaatccggcgccgaagtcaaaaaacccggcgcctcagtcaaagtctcctgcaaagcctccggctacatcttcaccggctactacatccactgggtccgccaagcccccggccaaggcctcgaatggatgggccgcatcgaccccaacggctccggcaccacctacgcccaaaaattccaaggccgagtcaccctcaccatggacacctcaatcaccaccgcctacatggaactctcccgcctccgcttcgacgacaccgccatctactactgcgcccgctgggactggaacttcgacctctacctcggctggttcgacccctggggccaaggcaccccagtcaccgtcgcctcc

SEQ ID NO: 58485 - RNA, 369 nt, synthetic construct
  misc_feature 1..369: note = derived and/or modified sequence opt11 from anti-influenza_Chain
  source 1..369: mol_type = other RNA
gaagtgcaattggtccagagcggggccgaggtcaagaaaccgggcgcgagcgtgaaagtgagctgtaaagcgagcgggtacatattcacgggctattacatacactgggtcaggcaagcgcccgggcaagggctcgagtggatgggcaggatcgatcccaatggcgcgggcacgacctatgcccagaaatttcaagggcgcgtgaccttgaccatggacacgagcataaccacggcctatatggagctctcgcgcctgcgctttgacgataccgcgatctattactgtgccaggtgggattggaatttcgatctctatctcgggtggtttgacccgtgggggcaagggaccccggtcacggtcgcgagc

SEQ ID NO: 58486 - RNA, 369 nt, synthetic construct
  misc_feature 1..369: note = derived and/or modified sequence opt11 from anti-influenza_Chain
  source 1..369: mol_type = other RNA
caagtgcaattggtacagagcggggccgaggtcaagaaaccgggcgcgagcgtgaaagtgagctgtaaagcgagcgggtacacgttcaatgcccatcacatgcactgggtcaggcaagcgcccgggcaagggctcgggtggatgggctggatcgatcccaataacgatggcacgatctatgcccagaaatttcaagggcgcgtgaccttgaccatggacacgagcatacacacggcctatatggagctctcgggcttgcgctatgacgataccgcgatctattactgtgtcaggtgggcgtggaatttcgatttctttctcgggtggtttgacccgtgggggcaagggaccttggtcacggtcgcgagc

SEQ ID NO: 58487 - RNA, 369 nt, synthetic construct
  misc_feature 1..369: note = derived and/or modified sequence opt11 from anti-influenza_Chain
  source 1..369: mol_type = other RNA
gaggtccagctcgtgcaatcgggcgcggaagtgaaaaagcccggcgaatcgctcaagatctcgtgcaaggtctcgggctatagctttacctcgcaatggatcgggtgggtgcgccaaatgccgggcaagggcttggaatggatcgggatgatgtacccgggcgatagcgataccatatactcgccctcgttccagggccaggtcacgatctcggccgataactcgatctcgaccgcgtacctgcaatggagctcgctcaaggcctcggacacggccatatactattgcgcgagcgggcccgggtactcgggctatcactatggctggttcgatacctggggccagggcacgctcgtgaccgtaagctca

SEQ ID NO: 58488 - RNA, 369 nt, synthetic construct
  misc_feature 1..369: note = derived and/or modified sequence opt11 from anti-influenza_Chain
  source 1..369: mol_type = other RNA
gaggtccagctcgtgcaatcgggcgcggaagtgaaaaagcccggggaatcgctcaagatctcgtgcaaggtctcgggctatagctttacctcgcaatggatcgggtgggtgcgccagatgccgggcaagggcttggaatggatcgggatgatgtacccgggcgatgcagatgccatatactcgccctcgttccagggccaggtcacaatctcggccgataactcgatctcgaccgcgtacttgcaatggagctcgctcaaggcctcggacacggccatatactattgcgcgagcgggcccgggtactcgggctatcactatggctggttcgatacctggggccagggcacgctcgtgaccgtgagctcg

SEQ ID NO: 58489 - RNA, 369 nt, synthetic construct
  misc_feature 1..369: note = derived and/or modified sequence opt11 from anti-influenza_Chain
  source 1..369: mol_type = other RNA
gaggtccagctcgtgcaatcaggcgcggaagtgaaaaagcccggggaatcgctcaagatctcgtgcaaggtctcaggctatagctttacctcgcaatggatcgggtgggtgcgccagatgccgggcaagggcttggaatggatcgggatgatgtacccgggcgagagcgagaccatatactcgccctcgttccagggccaggtcacgatctcggccgataactcgatctcgaccgcgtacttgcaatggagctcgctcaaggcctcggacacggccatatactattgcgcgagcgggcccgggtactcgggctatcactatggctggttcgatacctggggacagggcacgctcgtgaccgtgagctcg

SEQ ID NO: 58490 - RNA, 369 nt, synthetic construct
  misc_feature 1..369: note = derived and/or modified sequence opt11 from anti-influenza_Chain
  source 1..369: mol_type = other RNA
gaagtgcaattggtccagagcggggccgaggtcaagaaaccgggcgagagcctgaaaataagctgtaaagtgagcgggtactcgttcacgagccagtggataggctgggtcaggcaaatgcccgggaaagggctcgagtggataggcatgatgtatcccggggacgcggacacgatctatagcccgagctttcaagggcaagtgaccataagcgcggacaatagcataagcacggcctatctccagtggtcgagcttgaaagcgagcgataccgcgatctattactgtgcctcgggcccgggctatagcgggtaccattacgggtggtttgacacgtgggggcaagggaccttggtcacggtctcgagc

SEQ ID NO: 58491 - RNA, 369 nt, synthetic construct
  misc_feature 1..369: note = derived and/or modified sequence opt11 from anti-influenza_Chain
  source 1..369: mol_type = other RNA
gaagtccaactcgtccaatccggcgccgaagtcaaaaaacccggcgaatccctcaaaatctcctgcaaagtctccggctactccttcacctcacaatggatcggctgggtccgacaaatgcccggcaaaggcctcgaatggatcggcatgatgtaccccggctcctccgacaccatctactccccctccttccaaggccaagtcaccatctcagccgacaactccatctccaccgcctacctccaatggtcatccctcaaagcctccgacaccgccatctactactgcgcctccggccccggctactccggctaccactacggctggttcgacacctggggccaaggcaccctcgtcaccgtctcctcc

SEQ ID NO: 58492 - RNA, 369 nt, synthetic construct
  misc_feature 1..369: note = derived and/or modified sequence opt11 from anti-influenza_Chain
  source 1..369: mol_type = other RNA
gaagtgcaattggtccagagcggggccgaggtcaagaaaccgggcgagagcttgaaaataagctgtaaagtgagcgggtactcgttcacgagccagtggataggctgggtcagacaaatgcccgggaaagggctcgagtggataggcatgatgtatcccggggactcggacgcgatctatagcccgagctttcaagggcaagtgaccataagcgcggacaatagcataagcacggcctatctccagtggtcgagcctgaaagcaagcgataccgcgatctattactgtgcctcgggcccgggctatagcggataccattacgggtggtttgacacgtgggggcaagggaccttggtcacggtctcgagc

SEQ ID NO: 58493 - RNA, 369 nt, synthetic construct
  misc_feature 1..369: note = derived and/or modified sequence opt11 from anti-influenza_Chain
  source 1..369: mol_type = other RNA
gaggtccagctcgtgcaatcgggcgcggaagtgaaaaagcccggggaatcgctcaagatctcgtgcaaggtctcgggctatagctttacctcgcaatggatcgggtgggtgcgccagatgccgggcaagggcttggaatggatcgggatgatgtacccgggcgataccgataccatatactcgccctcgttccagggccaggtcacgatctcggccgataactcgatctcgaccgcgtacttgcaatggagctcgctcaaggcctcggacacggccatatactattgcgcgagcgggcccgggtactcgggctatcactatggctggttcgatacctggggccagggcacgctcgtgaccgtgagctcg

SEQ ID NO: 58494 - RNA, 369 nt, synthetic construct
  misc_feature 1..369: note = derived and/or modified sequence opt11 from anti-influenza_Chain
  source 1..369: mol_type = other RNA
gaggtccagctcgtgcaatcaggcgcggaagtgaaaaagcccggggaatcgctcaagatctcgtgcaaggtctcgggctatagctttacctcgcaatggatcgggtgggtgcgccagatgccgggcaagggcttggaatggatcgggatgatgtacccgggcgagagcgataccatatactcgccctcgttccagggccaggtcacgatctcggccgataactcgatctcgaccgcgtacctgcaatggagctcgctcaaggcctcggacacggccatatactattgcgcgagcgggcccgggtactctggctatcactacggctggttcgatacctggggccagggcacgctcgtgaccgtgagctcg

SEQ ID NO: 58495 - RNA, 372 nt, synthetic construct
  misc_feature 1..372: note = derived and/or modified sequence opt11 from anti-influenza_Chain
  source 1..372: mol_type = other RNA
caggtccagctagtgcaatcgggcgcggaagtgaaaaagcccgggagctcggtcaaggtctcgtgcaaggcctcgggcgggatctttatctcgcaagcgatctcgtgggtgcgccaggccccgggccagggcttggaatggatgggcgggataatcccgatgtttggcgcgaccaattacgcgcaaaagttccagggcagggtcacgatcacggccgataaatcaaccaataccgtgtacatggaattgagctcgctaacgagcgaggacacggccgtgtactattgcgcgcgcttgggctcgggctcgtaccataacggacccaattggtttgacccgtgggggcaagggaccttggtcacggtctcgagc

SEQ ID NO: 58496 - RNA, 372 nt, synthetic construct
  misc_feature 1..372: note = derived and/or modified sequence opt11 from anti-influenza_Chain
  source 1..372: mol_type = other RNA
caagtccaactacaagaatccggccccggcctcgtcaaaccctccgaaaccctctccctcaactgcgccgtctccggcggctccatctccaactactactggtcctggatccgacaaccacccggcaaaggcctcgaatggatcggctacatctcctacaacggccgccccaaatacaacccctccctcacctcacgcgtcaccatctccgtcgacacctccaaagaccaattctccctcgaactccgctccgtcaccgccgccgacaccgccctctactactgcgcccgcgaaacccgcttcggcgaactcctctccccctacgacgccttcgaaatctggggccaaggcaccatggtcaccgtctcctcc

SEQ ID NO: 58497 - RNA, 372 nt, synthetic construct
  misc_feature 1..372: note = derived and/or modified sequence opt11 from anti-influenza_Chain
  source 1..372: mol_type = other RNA
caagtccaactccaagaatccggccccggcctagtcaaaccctccgaaaccctctccctcacctgcaccgtctccggcggctccgtctcctccgaaacctactactggtcctggatccgccaaccccccggcaaaggcctcgaatggatcggctacatctactacatcggcaacaccgactaccgcccctccctcaaatcccgcgtcaccatctccctcgacacctccaaaaaccaattctccctcaaactctcctccgtcaccgccgccgacaccgccgtctactactgcgcccgcggcgcctactacgactcctccggctaccccgccttctacatctggggccaaggcaccatggtcaccgtctcctcc

SEQ ID NO: 58498 - RNA, 372 nt, synthetic construct
  misc_feature 1..372: note = derived and/or modified sequence opt11 from anti-influenza_Chain
  source 1..372: mol_type = other RNA
caagtccaactccaagaatccggccccggcctcgtcaaaccctctgaaaccctctccctcacctgcgccgtctccggcgtctccatctccaacatcgacttctactggggctggatccgccaaccccccggcaaaggcctcgaatggatcggcaacatctactacaccggcatcaccttctacaacccctccctctcctcccgcgtcgccatctccatcgacacctccaaaaaccaattctctctcaccctcacctccgtcacagccgccgacaccgccatgtactactgcgcccgccactacggcgactccgaagccatcaacgacgccttcgacatctggggccaaggcaccatgctcaccgtctcctcc

SEQ ID NO: 58499 - RNA, 372 nt, synthetic construct
  misc_feature 1..372: note = derived and/or modified sequence opt11 from anti-influenza_Chain
  source 1..372: mol_type = other RNA
caagtgcaattggtcgagagcggggccgaggtcaagaaatttggcgcgagcgtgaaagtgagctgtaaagcgagcgggtacacgctcatagactattacatgcactgggtcagggtcgcgcccgggcaagggctcgagtggatgggctggatcaatcccataaacgggggcacgaactatgcccagaaatttcaagggcgcgtgaccatgaccagggacacgagcataaacacggcatatatggatctctcgagcttgcgctcggacgataccgcgatgtattactgtaccaggggcaggcccataggcaggaactgggaaccgcgcgataaagattactggggccagggcacgcccgtgaccgtgagttcg

SEQ ID NO: 58500 - RNA, 372 nt, synthetic construct
  misc_feature 1..372: note = derived and/or modified sequence opt11 from anti-influenza_Chain
  source 1..372: mol_type = other RNA
caagtccaactcgtccaatccggcgccgaagtcaaaaaacccggctcctccgtcaccgtctcctgcaaaacctccggccacaccttcatctcatacgccatctcctggctccgccaagcccccggccaaggcctcgaatggatgggcggcatcgtccccatcttcggcaccgtcaactacacacaaaaattccaaggccgcctcaccatcaccgccgacgaatccacctccaccgcctacatggacctctcccgcctcaccttcgaagacaccgccatctacttctgcgcccgcgaagccggctaccactcctccttctccggcgtctacttcgactactggggccaaggcaccctccttaccgtctcctcc

SEQ ID NO: 58501 - RNA, 372 nt, synthetic construct
  misc_feature 1..372: note = derived and/or modified sequence opt11 from anti-influenza_Chain
  source 1..372: mol_type = other RNA
gaagtccaactccaacaatccggccccgaactcgtcaaacccggcgcctccgtcaaaatctcctgcaaagcctccggctacaccttcaccgactacaacatgcactgggtcaaacaatccctcggcaaatccctcgaatggatcggctacatctaccccaacaacggcggcaccggctacaaccaaaaattcgaatccaaagccaccctcaccgtcgacaactcctcctccaccgcctacatggaactccgcaccctcacctccgaagactccgccgtctactactgcgtccgctccggcgcctactacttcaactacctcgtcccctacttcgactactggggccaaggcaccaccctcaccgtctcctcc

SEQ ID NO: 58502 - RNA, 372 nt, synthetic construct
  misc_feature 1..372: note = derived and/or modified sequence opt11 from anti-influenza_Chain
  source 1..372: mol_type = other RNA
gaagtccaactccaacaatccggccccgaactcgtaaaacccggcgcctccgtcaaaatctcctgcaaagcctccggctacaccttcaccggctacaacatgcactgggtcaaacaatcacacggcaaatcactcgaatggatcggcaaaatctaccccaacaacggcgtcaccggctacaaccaagaattccgctcaaaagccaccctcaccgtcgacaactcctcctccaccgcctacatggaactccgatccctcacctccgaagactccgccatctacttctgcgtccgctccggcgcctactacgtcaactacctcgtcccctacttcgactactggggccaaggcaccaccctcaccgtctcctcc

SEQ ID NO: 58503 - RNA, 375 nt, synthetic construct
  misc_feature 1..375: note = derived and/or modified sequence opt11 from anti-influenza_Chain
  source 1..375: mol_type = other RNA
caagtgcagctagtacaaagcggggcagaggtaaagaaaccgggaagcagcgtgaaagtgagctgcaaagcaagcggggtaacgagcagcaactacccaataacatgggtaaggcaggcgccagggcaagggctagagtggatgggaggggtactgccactgttcggggtaacgaactacgcacagaaattccaagggagagtgacaataagcgcagacaaaagcacaaacacggcatacatggagctaagcagcctgagaagcgaagacacagcggtatactactgcgcaagaggaaagagaccgggatactgcagcggaggggtatgcagcagcgactactgggggcaagggacactggtaacagtaagcagc

SEQ ID NO: 58504 - RNA, 375 nt, synthetic construct
  misc_feature 1..375: note = derived and/or modified sequence opt11 from anti-influenza_Chain
  source 1..375: mol_type = other RNA
caagtccaactccaagaatccggccccggcctcgtcaaaccctcccaaaccctctccctcacctgcaccgtctccggcggctccatctcctccggcacctactactggtcctggatccgccaccaccccggcaaaggcctcgaatggatcggctacatctaccactcaggctccgcctactacaacccctccctcgaatcccgcgtaaccatgtccgtcgacacctcaaaaaaccaattctccctcaaactctcctccgtcaccgccgccgacaccgccatctactactgcgcccgcgccgaaaacctcctctccccctacctcgccgaaggattcgacccctggggccaaggcaccctcgtcaccgtctcctcc

SEQ ID NO: 58505 - RNA, 375 nt, synthetic construct
  misc_feature 1..375: note = derived and/or modified sequence opt11 from anti-influenza_Chain
  source 1..375: mol_type = other RNA
gaggtccagctcgtgcaatcgggcgcggaagtgaaaaagcccggggaatcgctcaagatctcgtgccaggcctcgggctatagctttacctcgcgatggatcgggtgggtgcgccagatgccgggcaagggcttggaatgggtcgggttcatatacccgagcgatagtgatgtcaggtactcgccctcgttcaggggccaggtcacgatctcggccgataaatcgatctcgaccgcgtacttgcaatggagctcgctcaaggcctcggacacggccatgtacttttgcgcgcgcttgggcgggaacaaggactatggcgattacttgtggtatttcgatctctggggcaggggcgcgctcgtgaccgtgagctca

SEQ ID NO: 58506 - RNA, 375 nt, synthetic construct
  misc_feature 1..375: note = derived and/or modified sequence opt11 from anti-influenza_Chain
  source 1..375: mol_type = other RNA
caagtgcaattggtcgagagcgggggcggggtcgtgcaaccgggcaggagtttgcgcttgagctgtgccgcgagcgggttcacgttctcgagctatggcatgcactgggtcaggcaagcgcccgggaaagggctcgagtgggtggccgtgatctggtacgatggcgataacaagtactatggcgatagcgtgaaagggcgctttaccataagcagggacaatagcaagaacacgctctttctccagatgaatagcttgcgcgcggaagataccgcggtctattactgtgccaaggacacggccgatcacggggactatgtcgatctcgggttctttgacgcgtgggggcaagggacattggtaacggtctcgagc

SEQ ID NO: 58507 - RNA, 375 nt, synthetic construct
  misc_feature 1..375: note = derived and/or modified sequence opt11 from anti-influenza_Chain
  source 1..375: mol_type = other RNA
gaagtgcaattggtccagagcggggccgagctcaagatgccgggcgagagcttgaaaataagctgtaaagcgagcgggtacacgttcacgaactattggataggctgggtcaggcaaacgcccgggaaagggctcgagtggatgggcataatctttcccccggactcgcaaacgagctatagcccgagctttcaagggcaagtgacctttagcgtggacaatagcataagcgtggcctatatccagtggtcgagcctgaaagcgagcgataccgcgatctattactgtgccaggagcgggatctttgactggagcgcgcccttggtcgaggcctttgacatatgggggcaagggaccgtggtcacggtctcgagc

SEQ ID NO: 58508 - RNA, 375 nt, synthetic construct
  misc_feature 1..375: note = derived and/or modified sequence opt11 from anti-influenza_Chain
  source 1..375: mol_type = other RNA
gaagtccaactcgtccaatcaggcgccgaagtcaaaaaacccggcgaatccctcaaaatctcctgcaaaggctccggctactccttctccgactactggatcggctgggtcagacaaatgcccggcgaaggcctcgaatggatgggcatcatctaccccgcctcctccgaaatccgctactccccctccttccaaggcctcgtcaccatctccgccgacaaatccatcaacaccgcctccctccaatggtcctccctcaaagcctccgacaccgccatctactactgcgcccgccacgcctcctgctccgcccgctcatgctactggggccccgtcgactactggggccaaggcaccctcgtcaccgtctcttcc

SEQ ID NO: 58509 - RNA, 375 nt, synthetic construct
  misc_feature 1..375: note = derived and/or modified sequence opt11 from anti-influenza_Chain
  source 1..375: mol_type = other RNA
caggtccagctagtggaatcaggcgggggcgtggtccagcccgggcgctcactcaggctctcgtgcgcggcctcggaaataaccttcatcacgtacgcgatgcactgggtgcgccaggccccgggcaagggcctggaatgggtcgcgctcataagcgatgacgggagcaataaattttacgcggactcggtcaagggcaggttcacgatctcgcgcgataactcgaaaaataccttgtacttgcaaatgaactcgctcagggccgaggacacggccgcgtactattgcgcgcgcgagggcgtgtactttgactcgggcacgtacaggggatatttcgattactggggccaggaaacactcgtgaccgtgagctcg

SEQ ID NO: 58510 - RNA, 375 nt, synthetic construct
  misc_feature 1..375: note = derived and/or modified sequence opt11 from anti-influenza_Chain
  source 1..375: mol_type = other RNA
caagtccaactccaagaatccggccccggcctcgtcaaaccctcccaaactctctccctaacctgcaccgtctccggcggctccatctcctccggcaactactactggaactgggtccgccaacaccccggcaaaggcctcgaatggatcggctacatctactaccgcggctccaccttctacaacccctccctcaaatcccgcgtcaccatctccatcgacacctccaaaaaccaattctccctccgcctctcctccgtcaccgccgccgacaccgccgtctactactgcgccaaagacacacgctcctccctcgacaactaccaatacggcatggacgtctggggccaaggcaccaccgtcaccgtctcctcc

SEQ ID NO: 58511 - RNA, 375 nt, synthetic construct
  misc_feature 1..375: note = derived and/or modified sequence opt11 from anti-influenza_Chain
  source 1..375: mol_type = other RNA
gaggtccagctcttggaatcgggcgggggcttggtccagcccgggggctcgctcaggctctcgtgcgcggcctcaggatttagctttagcacgtacgcgatgtcatgggtgcgccaggccccgggcaagggcttggaatgggtctcaggcataagcgggagcggggaatcgacctattacgcggactcggtcaagggcaggttcacggtctcgcgcgataactcgaaaaataccttgtacttgcaaatgaactcgctcagggccgaggacacggccgtgtactattgcgcgaaacagggcgatcacatagcctggctcttgcgcgggatcaatttcgattactggggccagggcgtgctagtgaccgtgagctcg

SEQ ID NO: 58512 - RNA, 375 nt, synthetic construct
  misc_feature 1..375: note = derived and/or modified sequence opt11 from anti-influenza_Chain
  source 1..375: mol_type = other RNA
caagtccaactcgtcgaatccggcggcggcgtcgtccaacccggccgctccctccgcctctcctgcgccgcctccggcttcgccttccacaaccgcgccatgcactgggtccgccaagcccccggcaaaggcctcgaatgggtcgccctcatctacttcgacggctccaaacaatactacgccgactccgtcaaaggccgcttcaccatctcccgcgacaactccaaaaacaccgtcttcctacaaatgaactcactccgccccgaagacaccgccgtctactactgcgccgtccccggccccatcttcggcatcttcccaccctggtcctacttcgaccactggggccaaggcatcctcgtcaccgtctcctcc

SEQ ID NO: 58513 - RNA, 375 nt, synthetic construct
  misc_feature 1..375: note = derived and/or modified sequence opt11 from anti-influenza_Chain
  source 1..375: mol_type = other RNA
gaagtccaactcgtagaatcaggcggaggcgtcgtccaacccggccgctccctacgcctctcctgcgccgcctccggcttcgccttccacaaccgcgccatgcactgggtccgccaagcccccggcaaaggcctagaatgggtcgccctcatctacttcgacggctccaaacaatactacgccgactccgtcaaaggccgcttcaccatctcacgcgacaactccaaaaacaccgtcttcctccaaatgaactccctccgccccgaagacaccgccgtctactactgcgccgtccccggccccatcttcggcatcttcccaccctggtcctacttcgaccactggggccaaggcatcctcgtcaccgtctcctcc

SEQ ID NO: 58514 - RNA, 375 nt, synthetic construct
  misc_feature 1..375: note = derived and/or modified sequence opt11 from anti-influenza_Chain
  source 1..375: mol_type = other RNA
gaagtccaactcgtccaatccggcggcggcgtcgtccaacccggcaaatccctccgcctctcctgcgccgcctccggcctcaccttctcctcctacgccgtccactgggtccgccaagcccccggcaaaggccttgaatgggtcaccctcatctcctacgacggcgccaaccaatactacgccgactccgtcaaaggccgcttcaccatctcccgcgacaactccaaaaacaccgtctacctccaaatgaactccctccgccccgaagacacagccgtctactactgcgccgtccccggccccgtcttcggcatcttccccccctggtcctacttcgacaactggggccaaggcatcctcgtcaccgtctcctca

SEQ ID NO: 58515 - RNA, 375 nt, synthetic construct
  misc_feature 1..375: note = derived and/or modified sequence opt11 from anti-influenza_Chain
  source 1..375: mol_type = other RNA
caagtccaactcgtcgaatccggcggcggcgtcgtccaacccggcaaatccctacgcctctcctgcgccgcctccggcctcaccttctcctcctacgccgtccactgggtccgccaagcccccggcaaaggcctcgaatgggtcaccctcatctcctacgacggcgccaaccaatactacgccgactccgtcaaaggccgcttcaccatctcccgcgacaactccaaaaacaccgtctacctccaaatgaactccctccgccccgaagacaccgccgtctactactgcgccgtccccggccccgtcttcggcatcttccccccctggtcctacttcgacaactggggccaaggcatcctcgtcaccgtctcctcc

SEQ ID NO: 58516 - RNA, 375 nt, synthetic construct
  misc_feature 1..375: note = derived and/or modified sequence opt11 from anti-influenza_Chain
  source 1..375: mol_type = other RNA
caagtccaactcgtcgaatccggcggcggcgtcgtccaacccggcaaatccccccgcctctcctgcgccgcctccggccccaccttctcctcctacgccgtccactgggtccgccaagcccccggcaaaggcctcgaatgggtcaccctcatctcctacgacggcgccaaccaatactacgccgactccgtcaaaggccgcttcaccatctcccgcgacaactccaaaaacaccgtctacctccaaatgaactccctccgccccgaagacaccgccgtctactactgcgccgtccccggccccgtcttcggaatcttccccccctggtcctacttcgacaactggggccaaggcatcctcgtcaccgtctcctcc

SEQ ID NO: 58517 - RNA, 375 nt, synthetic construct
  misc_feature 1..375: note = derived and/or modified sequence opt11 from anti-influenza_Chain
  source 1..375: mol_type = other RNA
gaagtccaactcgtcgaatccggcggcggcgtcgtccaacccggcaaatccctccgcctctcctgcgccgcctccggcctcaccttctcctcctacgccgtacactgggtccgccaagcccccggcaaaggcctcgaatgggtcaccctcatctcctacgacggcgccaaccaatactacgccgactccgtcaaaggccgcttcaccatctcccgcgacaactccaaaaacaccgtctacctccaaatgaactccctacgccccgaagacaccgccgtctactactgcgccgtccccggccccgtcttcggcatcttccccccctggtcctacttcgacaactggggccaaggcatcctcgtcaccgtctcctca

SEQ ID NO: 58518 - RNA, 375 nt, synthetic construct
  misc_feature 1..375: note = derived and/or modified sequence opt11 from anti-influenza_Chain
  source 1..375: mol_type = other RNA
caagtccaactcgtccaatccggcgccgaactcaaacgacccggcgcctcagtcaaagtctcctgcaaaacctccggctactccttcaacaactacggcatcaactgggtccgccaagcccccggacaaggcctcgaatggatgggctggatctccgcctacaccggcaacacccactacgccaaaaacttcgaaggccgcgtcaccctcaccaccgacacctccacctccaccgcctacatggaagtccgctccctccgctccgacgactccgccgtctacttctgcgcccgcgccatgatccaaggcgtcgtcaccctctacctccgccccggcgactactggggccaaggcaccctcgtcaccgtctcatcc

SEQ ID NO: 58519 - RNA, 375 nt, synthetic construct
  misc_feature 1..375: note = derived and/or modified sequence opt11 from anti-influenza_Chain
  source 1..375: mol_type = other RNA
caagtccaactcgtccaatccggcgccgaagtcaaacaacccggcgcctccgtcaaagtctcctgcaaagcctccggctacaccttcaacgcctactacatccactgggtccgccaagcccccggccaaggcctcgaatggatgggctggatcaaccccaacttcggcggaacccactacgcccgcaaattccaaggccgcgtcaccatgacccgcgacgcctccatcaacacagcatacatggaactagaccgcctcatctccgacgacaccgccgtctactactgcgtccgctggcgcgccgccgccgtcatcatggaccaattctacaaaatggacgtctggggccaaggcaccctcgtcaccgtctcctcc

SEQ ID NO: 58520 - RNA, 375 nt, synthetic construct
  misc_feature 1..375: note = derived and/or modified sequence opt11 from anti-influenza_Chain
  source 1..375: mol_type = other RNA
caagtccaactcgtccaatccggccccgaactcaaaaaacccggctcctccgtcaaactctcctgcatggccaccggcggcaccttcatcaactacgcattctcatgggtccgccaagcccccggccaaggcctagaatggctcggcggcatcatcccagtctacggcacctcaaaccacgtcgaaaaactccaaggccgcgtcaccatcaccgccgacgcctccaccaacaccgcctacatggaactctccggcctccgcttcgacgacaccgccgtctacttctgcgccgcctccaccgccacctccggcacctactacgccatgcgacccttcgacttctggggccaaggcaccctcgtctccgtctcctcc

SEQ ID NO: 58521 - RNA, 378 nt, synthetic construct
  misc_feature 1..378: note = derived and/or modified sequence opt11 from anti-influenza_Chain
  source 1..378: mol_type = other RNA
gaagtccaactcgtcgaatccggcggcggcgtcgtccaacccggcggctccctccgcctctcatgcatcgcctccgccttcaacctcggcatcttcggcatgcactgggtccgccaagcccccggcaaaggcctcgaatgggtcgcattcatccgctacgacggcggcaaaaccttctacgccgactccgtcaaaggccgcttcaccatctcccgcgacaactccaaaaacaccctctacctccaaatgaactcactccgcaccgaagacaccgccctctactactgcgcccgcgacgccaccgccgactactacggccccggctcctaccccaactggctcgacccctggggccaaggcaccctcgtcaccgtctcc

SEQ ID NO: 58522 - RNA, 378 nt, synthetic construct
  misc_feature 1..378: note = derived and/or modified sequence opt11 from anti-influenza_Chain
  source 1..378: mol_type = other RNA
gaagtccaactagtcgaatccggccccgccctcgtcaaacccacccaaaccctcaccctcacctgctccttctccggcttctccctctccacctccggcatgtccgtctcatggattcgccaaccccccggcaaagccctcgaatggctcgccctcatcgactgggacgacgacacctactacatcacctactcctcctccctcaaaacccgcctcaccatctccaaagacacctccaaatcccaagtcgtcctcaccatgaccaacatggaccccgtcgacaccgccacctactactgcgctcgcaccctccgcgtctccggcgactacgtccgcgacttcgacctctggggccgcggcaccctcgtcaccgtctcc

SEQ ID NO: 58523 - RNA, 378 nt, synthetic construct
  misc_feature 1..378: note = derived and/or modified sequence opt11 from anti-influenza_Chain
  source 1..378: mol_type = other RNA
caagtccaactacaagaatccggccccggcctcgtcaaaccctccgaaaccctctccctcacctgcaccgtctccggcggctccatcaactcctactactggaactggatccgccaaccccccggcaaaggcctcgaatggatcggctacatctaccactccggctcaaccaactacaacccctcactcaaatcccgagtcaccatctccgtcgacacctcaaaaaaccaattctccctccaactctcctccgtcaccgccgccgacaccgccgtctactactgcgcccgcctccgcaccgactacggcgaccccgactccgtctactactacggcatggacgtctggggccaaggcaccacagtcaccgtctcctcc

SEQ ID NO: 58524 - RNA, 378 nt, synthetic construct
  misc_feature 1..378: note = derived and/or modified sequence opt11 from anti-influenza_Chain
  source 1..378: mol_type = other RNA
caagtccacctcgtccaatccggcgccgaagtccgcaaacccggcgactccgtcaaagtatcctgcaaaacctccggctacaccttctccacctaccccgtcgcctgggtccgccaagtccccggccaaggcctcgaatggatgggctggatctccacctacaacggcaacaccaacttcgcccaaaacttccaaggccgcgtcaccctcaccaccgacaccaccaccaacaccgcctacatggaagtccgctccctcaaattcgacgacaccgcagtctactactgcgcccgcgtcgaaggctcctaccgcgacttctggaacaaccaaaaccgcttcgacccctggggccaaggcaccctcgtcaccgtctcctcc

SEQ ID NO: 58525 - RNA, 378 nt, synthetic construct
  misc_feature 1..378: note = derived and/or modified sequence opt11 from anti-influenza_Chain
  source 1..378: mol_type = other RNA
gaggtccagctcgtggaatcaggcgcggaagtgaaaaagcccggggcctcggtcaaggtctcatgcaaggcctcgggctatacctttacctcgttcgatatcaattgggtgcgccaggccccgggccagggcttggaatggatggggtggatgaccccgacctcgggcaagaccgggtacgcgcaaaagttccagggcagaatcacgatgacgcgcaatacctcgatcaataccgcgtacatggaattgagctcgctcaggagcgaggacacggccgtgtacttttgcgcgcgcgggcccgagcgcaggaccacgatctttgacgtgatcttggactggttcgacccctggggccagggcacgctcgtgaccgtgagc

SEQ ID NO: 58526 - RNA, 378 nt, synthetic construct
  misc_feature 1..378: note = derived and/or modified sequence opt11 from anti-influenza_Chain
  source 1..378: mol_type = other RNA
caagtccaactcgtccaatccggcgccgaagtcaaaaaacccggctcatccgtcaaagtctcctgcaaagcctccggcggcttcttctcctcctacgccatctcctgggtccgccaagcccccggccaaggcctcgaatggatgggcggcgtcatccccatcttccgcaccgccaactacgcccaaaacttccaaggccgcgtcaccatcaccgccgacgaattcacctcctacatggaactatcctccctccgctccgacgacaccgccgtctactactgcgcccgcctcaactaccacgactccggcacctactacaacgccccccgcggctggttcgacccctggggccaaggcaccctagtcacagtctcctcc

SEQ ID NO: 58527 - RNA, 378 nt, synthetic construct
  misc_feature 1..378: note = derived and/or modified sequence opt11 from anti-influenza_Chain
  source 1..378: mol_type = other RNA
caagtgcaactggtccagagcggggccgaggtcaagaaaccaggctcaagcgtgaaagtaagctgtaaagcgagcggaggcgcattctcgaactacgccataagctgggtcaggcaagcacccgggcaaggactcgagtggatgggcgggatcatacccatattcgggaccacgaactacgcccagaaattccaagggcgcgtgacaataaccgcggacaagttcacgaccatagcctatatggagctcagaagcctgcgctcagaagataccgcggtctattactgtgccagacacgggggcgtgtactattacgggagcgcgagctcgggctggttcgatccctggggccagggcacgctcgtgaccgtgagctcg

SEQ ID NO: 58528 - RNA, 378 nt, synthetic construct
  misc_feature 1..378: note = derived and/or modified sequence opt11 from anti-influenza_Chain
  source 1..378: mol_type = other RNA
caggtccagctcctggaatcgggcgggggcgtggtcaggcccgggcgctcgctcaggctcgcgtgcgcgggctcgggctttacctttagcgcgtacgcgatgcattgggtgcgacaggccccgggcaagggcttggaatgggtcgcgcacacgagctatgacgggcgcgatagctattacgtggactcggtcaagggcaggttcacgatctcgcgcgatgactcgaaaaataccttgtacttgcaaatgaactcgctcaggcccgaggacacggccgtgtactattgcgcgaaagtgggcccgtacacgggctatgacgattacaattactatggcatggacgtgtgggggcacgggaccacggtcacggtctcgagc

SEQ ID NO: 58529 - RNA, 378 nt, synthetic construct
  misc_feature 1..378: note = derived and/or modified sequence opt11 from anti-influenza_Chain
  source 1..378: mol_type = other RNA
caagtgcaattggtcgagagcgggggcggggtcgtgcaaccgggagggagcttgcgcttgagctgtgccgcgagcgggttcaatttcgatgaatatgtcatgtactgggtcaggcaatcgcccgggaaagggctcgagtgggtgagcttgatcggggccgatggaagaggaacgtacaatagcgatagcgtgaaagggcgatttaccataagcagggacaatcgcaagaactcgctatatctccagatgaatagcttgcgctcggacgataccgcgctctattactgtgccaaggtcgagcgctcattctatgacgggagcgggtacggggacgcgctcgagatctggggccagggcacgatggtgaccgtgagctcg

SEQ ID NO: 58530 - RNA, 381 nt, synthetic construct
  misc_feature 1..381: note = derived and/or modified sequence opt11 from anti-influenza_Chain
  source 1..381: mol_type = other RNA
gaggtccagctcttggaatcgggcgggggcttggtccatcccgggggctcgctcaggctctcgtgcgcggcctcgggctttacctttagcaattacgcgatgtcgtgggtgcgccaggccccgggcaagggcttggaatgggtctcgagcataaactcgggcgggggcgcgacctattacgcggactcggtcaagggcaggttcacgatctcgcgcgataactcgaaaaataccttgagcttgcaaatgaactcgctaagggccgaggacacggccgtgtactattgcgcgaaagagggcgggaacacgatctttggcttggtcacaatggcgtactatttcgatagctggggccagggcacgctcgtgaccgtgagctcg

SEQ ID NO: 58531 - RNA, 381 nt, synthetic construct
  misc_feature 1..381: note = derived and/or modified sequence opt11 from anti-influenza_Chain
  source 1..381: mol_type = other RNA
caaccccaactccaagaatccggccccggcctcgtccgcccctccgaaaccctctctctcacctgcaccgtctccggcgactccgtcacccgcggcggcttctactggggctggatccgccaaccccccggcaaaggcctcgaatggatcggctccatctactacaactacaacatctaccactccccctccctcaaatcacgcgtctccctatccgtcgacacctccaaaaaccaagtctccctcaaactcgcctcagtcaccgccgccgacaccgccgtctactactgcgcccgccactacccctactacgacctccccaccggcttctactcccaattcgacttctggggccaaggcacccccgtcaccgtctcctcc

SEQ ID NO: 58532 - RNA, 381 nt, synthetic construct
  misc_feature 1..381: note = derived and/or modified sequence opt11 from anti-influenza_Chain
  source 1..381: mol_type = other RNA
tggtggcagctagtgcaatcgggcgcggaagtgaaaaagccagggagctcggtcaaggtctcgtgcaaggcctcgggcgggacctttagctcgtacgatatctcgtgggtgcgccaggccccgggccagggcttggaatggatgggcgggataatcccgatctatggcacggccaattacgcgcaaaagttccagggaagggtcacgatcacggccgatgaatcgacctcgaccgcgtacatggaattgagctcgctcaggagcgaggacacggccgtgtactattgcgcgcgcgcgggcggggactcgagcgggtactatggcgcgctcgggcgatttttccagcactggggccagggaacgctcgtgaccgtgagctcg

SEQ ID NO: 58533 - RNA, 381 nt, synthetic construct
  misc_feature 1..381: note = derived and/or modified sequence opt11 from anti-influenza_Chain
  source 1..381: mol_type = other RNA
gaagtccaactcgtccaatccggcggcgccgtcgtccaacccggccgatccctccgcctctcctgcgccgcctccggcttcaccttctccatctacgccatgcactgggtacgccaaacccccggcaaaggcctcgaatgggtcgccctcatctcatacgacggcaacaacaaatactacgccgactccgtcaaaggccgcttcaccatctcccgcgacaactacaaaaacaccctctacctccaaatgaaaggcctccgcgccgaagacaccgccctctactactgcgcccgccgcatcaccgaaaaaggatactacaacgactccggccgccccaactggttcgacccctggggccaaggcaccctcgtcaccgtatcc

SEQ ID NO: 58534 - RNA, 381 nt, synthetic construct
  misc_feature 1..381: note = derived and/or modified sequence opt11 from anti-influenza_Chain
  source 1..381: mol_type = other RNA
caggtccagctccagcaatcgggcccgcgcttggtcaagccctcacaaacgctctcgctcacgtgcgcgatctcgggcgatagcgtgagcggggactcgggcacgtggaattggatacgccagagcccgagcaggggcttggaatggctcgggcgcacgtactatcgctcgaaatggtacaatgactatgccgagagcgtgaaatcgcgaatagtcataaaagcggacacgagcaagaacgagttctcgctccagctcaatagcgtgaccccggaagataccgcgatctattactgtgccagggccggggtcaagatctttggcttgatcgtgggcgcgctcgataactggggcaggggcacgctcgtgaccgtgagctca

SEQ ID NO: 58535 - RNA, 381 nt, synthetic construct
  misc_feature 1..381: note = derived and/or modified sequence opt11 from anti-influenza_Chain
  source 1..381: mol_type = other RNA
caagtccaactccaacaatggggcgccggcctcctcaaaccctccgaaaccctctcactcacctgcaccgtctccggcggctccctcaccgactactcctggaactggatccgacaaccccccggcaaaggcctcgaatggatcggcgacaccctccacaacggctacaccaactacaacccctccctccgcggccgcgtctccatctccatcgacacctccaaaaaccaagtctccctacgcctcacctccgtcaccgccgccgacaccgccctctactactgcgcccgcggctccggcggctacggaggcttcgactacttcggcaaactccgcacctgggacttctggggccaaggcaccctcgtcacagtctcctcc

SEQ ID NO: 58536 - RNA, 381 nt, synthetic construct
  misc_feature 1..381: note = derived and/or modified sequence opt11 from anti-influenza_Chain
  source 1..381: mol_type = other RNA
caagtgcaattggtccagagcggggccgaggtcaggaaaccgggcgagagcttgcgcataagctgtcgcgggagcgggtacaatttcccgaaatattggataggctgggtcaggcaaatgcccgggaaagggctcgagtggatgggcatgatctatcccggggactcggacgtgcgctataacccgagctttcaagggcaagtgaccataagcgcagacgagagcataaacacggcctatctacagtggtcgagcttgcgcacgagcgataccgcgcgctattactgtgccaggcacttgggccagcaattggtctcgaacacgtactattactatggcatggacgtgtgggggcaagggaccacggtcacggtctcaagc

SEQ ID NO: 58537 - RNA, 384 nt, synthetic construct
  misc_feature 1..384: note = derived and/or modified sequence opt11 from anti-influenza_Chain
  source 1..384: mol_type = other RNA
caaatccaactccaagaatccggccccggcctcgtcaaaccctcccaaaccctctccctaacctgcgccatctccggcgactccgtatcctccaacaacgccgtctggaactggatccgacaatccccctcccgcggactcgaatggctcggccgcacctactaccgctccaaatggtacaacgactacgccgaatccgtcaaatcccgcatcaccgtcaaccccgacacctccaaaaaccaattctccctccacctcaaatccgtcacccccgaagacaccgccgtcttctactgcgtccgctccggccacatcaccgtcttcggcgtcaacgtcgacgccttcgacatgtggggccaaggcaccatggtcaccgtctcatcc

SEQ ID NO: 58538 - RNA, 384 nt, synthetic construct
  misc_feature 1..384: note = derived and/or modified sequence opt11 from anti-influenza_Chain
  source 1..384: mol_type = other RNA
caagtccaactccaagaatcaggccccggcctcgtcaaaccctcccaaaccctctccctcacatgcgccatctccggcgactccgtctcctccaacaacgccgtctggaactggatccgccaatccccctcccgcggcctcgaatggctcggccgcacctactaccgctccaaatggtacaacgactacgccgaatccgtcaaatcccgcatcaccgtcaaccccgacacctccaaaaaccaattctccctccacctcaaatccgtcacccccgaagacaccgccgtcttctactgcgtccgctccggccacatcaccgtcttcggcgtcaacgtcgacgccttcgacatgtggggccaaggcaccatggtcaccgtctcctcc

SEQ ID NO: 58539 - RNA, 384 nt, synthetic construct
  misc_feature 1..384: note = derived and/or modified sequence opt11 from anti-influenza_Chain
  source 1..384: mol_type = other RNA
caagtccaactccaacaatccggccccggcctcgtcaaaccctcccaaaccctctccctcacctgcgccatctccggcgaccgcgtctcctccaactccgccgtctggaactggatccgccaatccccctcccgcggcctcgaatggctcggccgcacctactaccgatccaaatggtactacgactacgccgaatccgtcaaatcccgcatcgtcatcgaccccgacacctccaaaaaccaagtctccctccaactcaactccgtcacccccgaagactccgccatctactactgcgcccgcggcggccacatcaccgtcttcggcctcaacatcgacgcctacgacatctggggacaaggcgccaaagtcaccgtatcctcc

SEQ ID NO: 58540 - RNA, 384 nt, synthetic construct
  misc_feature 1..384: note = derived and/or modified sequence opt11 from anti-influenza_Chain
  source 1..384: mol_type = other RNA
caagtccaactccaacaatctggacccggcctcgtaaaaccctcccaaaccctctccctaacctgcgccatatccggcgaccgcgtctcatccaactccgccgtctggaactggatccgccaatccccctcccgcggcctcgaatggctcggccgcacctactaccgctccaaatggtactacgactacgccgaatcagtcaaatcccgaatcgtcatcgaccccgacacctccaaaaaccaagtctccctccaactcaactccgtcacccccgaagactccgccatctactactgcgcccgcggcggccacatcaccgtcttcggcctcaacatcgacgcctacgacatctggggccaaggcgccatggtcacagtctcctcc

SEQ ID NO: 58541 - RNA, 384 nt, synthetic construct
  misc_feature 1..384: note = derived and/or modified sequence opt11 from anti-influenza_Chain
  source 1..384: mol_type = other RNA
caagtccaactccaacaatccggccccggcctcgtcaaaccctcccaaaccctctccctcacatgcgccatctccggcgaccgcgtctcctccaactccgccgtctggaactggatccgccaatccccctcccgcggcctagaatggctcggccgcacctactaccgctccaaatggtactacgattacgccgaatccgtcaaatcccgcatcgtcatcgaccccgacacctcaaaaaaccaagtctccctccaactcaactccgtcacccccgaagactccgccatctactactgcgcccgcggcggccacatcaccgaattcggcctcaacatcgacgcctacgacatctggggccaaggcgccatggtcaccgtctcctcc

SEQ ID NO: 58542 - RNA, 384 nt, synthetic construct
  misc_feature 1..384: note = derived and/or modified sequence opt11 from anti-influenza_Chain
  source 1..384: mol_type = other RNA
caagtccaactccaacaatccggccccggcctcgtaaaaccatcccaaaccctctcactaacctgcgtcatctccggcgacaccgtctcctccaaccgcgccacctggaactggatgcgccaatcacccctccgcggcctcgaatggctcggccgcacctactaccgctccaaatggtacaacgactacgccgtctccgtcaaatccagagtcgtcatcaaccccgacacctccaaaaaccaagtctccctccaactcaacaccgtcacccccgacgactccggcgtctacttctgcgcccgcggcggccacatcaccgtcttcggcgtcaacatcgacgccttcgacatctggggcctcggcaccaaagtcaccgtctcctcc

SEQ ID NO: 58543 - RNA, 384 nt, synthetic construct
  misc_feature 1..384: note = derived and/or modified sequence opt11 from anti-influenza_Chain
  source 1..384: mol_type = other RNA
caagtcgaactccaacaatccggccccggcctcgtcaaaccctcccaaaccctctccctcacctgcgccatctccggcgactcagtctcatccaactccgccacctggaactggatccgccaatccccctcccgcggcctcgaatggctcggccgcacctactaccgctccaaatggtacaacgactacgccgacttcctcaaacgccgaatcaccatcaaccccgacacctccaacaacgaagtctccctccgcctcacctccgtcacccccgacgacaccgccctctactactgcgcccgcggcggccacatcaccgtcttcggcgtcaacatcgacgcattcgacgtctggggccaaggcaccatggccaccgtctcctcc

SEQ ID NO: 58544 - RNA, 384 nt, synthetic construct
  misc_feature 1..384: note = derived and/or modified sequence opt11 from anti-influenza_Chain
  source 1..384: mol_type = other RNA
caagtccaactccaacaatccggccccggcctagtcaaaccctcccaaaccctatccctcacatgcgccatctccggcgactccgtctcctccaactccgccacctggaactggatccgccaatccccctcccgcggcctcgaatggctcggccgcacctactaccgatccaaatggtacaacgactacgccgacttcctcaaacgccgcatcaccatcaaccccgacacctccaacaacgaagtctccctccgcctcacctccgtcacccccgacgacaccgccctctactactgcgcccgaggcggccacatcaccgtcttcggcgtcaacatcgacgccttcgacgtctggggccaaggcaccatggtcaccgtctcctcc

SEQ ID NO: 58545 - RNA, 384 nt, synthetic construct
  misc_feature 1..384: note = derived and/or modified sequence opt11 from anti-influenza_Chain
  source 1..384: mol_type = other RNA
caagtccaactccaacaatccggccccggcctcgtcaaaccctcccaaaccctctcactcacctgcgccatctccggcgactccgtctcctcctacaacgccgtctggaactggatccgccaatccccctcccgcggcctcgaatggctcggccgcacctactaccgctccggctggtacaacgactacgccgaatccgtcaaatcccgcatcaccatcaaccccgacacctcaaaaaaccaattctccctccaactcaactcagtcacccccgaagacaccgccgtctactactgcgcccgctccggccacatcaccgtcttcggcgtcaacgtcgacgccttcgacatgtggggccaaggcaccatggtcaccgtctcctcc

SEQ ID NO: 58546 - RNA, 384 nt, synthetic construct
  misc_feature 1..384: note = derived and/or modified sequence opt11 from anti-influenza_Chain
  source 1..384: mol_type = other RNA
caagtccaactccaacaatccggccccggcctcgtcaaaccctcccaaaccctctccctaacctgcgccatctccggcgactccgtctcctccaacaacgccgtctggaactggatccgccaatccccctcccgaggcctcgaatggctcggccgcacctactaccgctccaaatggtacaacgactacgccgaatccgtcaaatcccgaatcacaatcaaccccgacacctccaaaaaccaattctccctccaactcaactccgtcacccccgaagacaccgccgtctactactgcgcccgctccggccacatcaccgtcttcggcgtcaacgtcgacgccttcgacatgtggggccaaggcaccaccgtcaccgtctcctcc

SEQ ID NO: 58547 - RNA, 384 nt, synthetic construct
  misc_feature 1..384: note = derived and/or modified sequence opt11 from anti-influenza_Chain
  source 1..384: mol_type = other RNA
aggggccagctcgtgcaatcgggcgggggcgtggtccagcccgggcgctcgctcaggctctcgtgcgcggcctcgggctttgtctttaacgtgttcgggatccattgggtgcgccaggccccgggcaagggcttggaatggctcgcgaccataagctatgacgggctcaataaatattacgcggactcggtcaagggcaggatcacgatctcgcgcgataactcgaaaaataccctgtacctgcaaatgaactcgctcagggccgaggacacggccgtgtactattgcgtgcgcgatagcgaggaatcgacctattacggggactatatgtgggtctataactggttcgatctatggggccagggcacgctcgtgaccgtgagc

SEQ ID NO: 58548 - RNA, 384 nt, synthetic construct
  misc_feature 1..384: note = derived and/or modified sequence opt11 from anti-influenza_Chain
  source 1..384: mol_type = other RNA
caagtccaactccaacaatggggctccggcctcctcaaaccctccgaaaccctatccctcacctgcgccgtctacggcggctccttccgcgacgactactggacctggatccgccaaccccccggcaaaggcctcgaatggatcggcgaaatcaaccactccggccgcaccaactacaacccctccctcaaatcccgcgtcaccatctccgtcgacacctccctcaaacaattctccctcaaagtcatctccgtcaccgccgccgacaccgccgtctactactgcgcccgcggcacctcccacgtctcccgctacttcgactggctcccccccaccaactggttcgacccctggggccaaggcacccaagtcaccgtctcctcc

SEQ ID NO: 58549 - RNA, 384 nt, synthetic construct
  misc_feature 1..384: note = derived and/or modified sequence opt11 from anti-influenza_Chain
  source 1..384: mol_type = other RNA
caagtccaactccaacaatggggcgccggcctcctcaaaccctccgaaaccctctccctctcctgcgccgtcttcggcggctccttctccgactactactggacctggatccgccaaccccccggcaaaggcctcgaatggatcggcgaaatcaaacactcaggccgcaccaactacaacccctccctcgaatcccgagtcaccatctccgtcgacacctccaaaaaccaattctccctcaaactctcctccgtcaccgccgccgacaccgccatctactactgcgcccgcggcaccgaccccgacaccgagggctactgccgctccggatcctgctccgccttcgacttctggggccaaggcaccctcgtcaccgtctcctcc

SEQ ID NO: 58550 - RNA, 384 nt, synthetic construct
  misc_feature 1..384: note = derived and/or modified sequence opt11 from anti-influenza_Chain
  source 1..384: mol_type = other RNA
caagtgcaactgcaacagtggggcgccgggctcttgaaaccgagcgagaccttgagcttgacctgtggggtgtacgggggctcactctcggactattactggagctggatcaggcaaccgcccgggaaagggctagagtggataggcgagatcaatcactcgggcgggaccaattacaatccctcgctcaagcgcagggtcacgatctcggtcgatacctcgaaaaagcaatttagcctgaaaatgaactcggtcacggccgcggacacggccgtgtactattgcgcgcgcgggaccgatcccgataccgaggtctattgcagggccgggaactgtgccgcgttcgatttctggggccagggcacgctagtgaccgtgagctcg

SEQ ID NO: 58551 - RNA, 384 nt, synthetic construct
  misc_feature 1..384: note = derived and/or modified sequence opt11 from anti-influenza_Chain
  source 1..384: mol_type = other RNA
caggtacagctccaggaatcgggcccgggcctggtcaagccctcgcaaacgctctcgctcacgtgcacagtctcgggcgatagcataagctcggtcgatcactactggtcatggatacgccagcacccggtcaagggcttggaatggatcgggttcatgtactacagcgcgagcacgtactataacccgagcctgaaatcgcgcgtgaccataagcacggacacgagcaagaaccagttctcgctcaggctctcgagcgtgaccgcggccgacaccgcggtctactactgtgccaggggcacatgcgcgggcgattgctcgctccattactattactacggcctggacgtgtgggggcaagggcgcacggtcacggtctcgagc

SEQ ID NO: 58552 - RNA, 384 nt, synthetic construct
  misc_feature 1..384: note = derived and/or modified sequence opt11 from anti-influenza_Chain
  source 1..384: mol_type = other RNA
gaggtcgcgctcgtggaatcaggcgcggaagtgaaaaagccagggagctcggtcaaggtctcgtgcaaggcctcgggccatatctttagcgggtacgcgatctcgtgggtgcgccaggccccgggccagggcctggaatggatgggcgggataatcccgatctttggcacgaccaattacgcgcaaaagttccagggcagggtcacgatcacggccgatcaatcgacatcgaccgcgtacatggacttgagcaatctcaggagcgaggacacggccgtgtactattgcgcgcgcgtgaaagatggctattgcacactaacgagctgtcccgtgggatggtactttgacttgtgggggcgcgggacattggtcacggtctcgagc

SEQ ID NO: 58553 - RNA, 384 nt, synthetic construct
  misc_feature 1..384: note = derived and/or modified sequence opt11 from anti-influenza_Chain
  source 1..384: mol_type = other RNA
gaggtccagctcgtggaatcgggcgcagaagtgaaaaagcccgggagctcggtcaaggtctcgtgcaaggcctcgggccatatatttagcgggtacgcgatctcgtgggtgcgccaggcaccaggccagggcttggaatggatgggcgggataatcccgatctttggcacgaccaattacgcgcaaaagttccagggcagggtcacgatcacggccgatcaatcgacctcgaccgcgtacatggacttgagcaatctcaggagcgaggacacggccgtgtactattgcgcgcgagtgaaagatggctattgcacgctcacgagctgtcccgtgggctggtactttgacttgtgggggcgcgggaccttggtcacggtctcgagc

SEQ ID NO: 58554 - RNA, 384 nt, synthetic construct
  misc_feature 1..384: note = derived and/or modified sequence opt11 from anti-influenza_Chain
  source 1..384: mol_type = other RNA
caagtgcaattggtccagagcggggccgaggtcaggaaaccgggcgcgagcgtgaaagtgagctgtaaagcgagcgggtacacgttcacgcgccatggcataagctgggtcaggcaagcgcccgggcaagggctagagtggatgggctggatctcggcctataccggggacacggactatgcccagaaatttcaagggcgagtgaccatgaccacggacacgagcacgaacacggcctatatggagctcaggagcctgcgctcggacgatgccgcggtctattactgtgccaggctcaggctccagggcgaggtcgtggtcccgccctcgcaatcgaactggttcgatccctggggccagggcacgctagtgaccgtgagctcg

SEQ ID NO: 58555 - RNA, 384 nt, synthetic construct
  misc_feature 1..384: note = derived and/or modified sequence opt11 from anti-influenza_Chain
  source 1..384: mol_type = other RNA
caagtccaactcgtcgaatccggccccggcctcatgaaaccctccgaaaccctatccctcacctgcaccgtctccggcggctccgtctccaactactactggtcctggatccgccaaccccccggcaaaggcctcgaatggatcggctacgtcttctactccggctcatccaactacaacccctccctcaacaacccctccctcaaatcccgcgtcaccatctccatcgacacatccaacaaccaattctccctcaaactctcctccgtcaccgccgccgacaccgccgtctactactgcgcccgcggccgcgtcaactccggctacgactggggccccaacttcgactcctggggccaaggcgccctcgtcaccgtctcctcc

SEQ ID NO: 58556 - RNA, 384 nt, synthetic construct
  misc_feature 1..384: note = derived and/or modified sequence opt11 from anti-influenza_Chain
  source 1..384: mol_type = other RNA
caagtgcaattggtccagagcggggccgaggtcaagaaaccgggctcgagcgtgaaagtgagctgtaaagcgagcgggggcacgttctcgtactatgccataagctgggtcaggcaagcgcccgggcaagggctcgagtggatgggcgggatcatacccatagtcgggaccgcgcactatacccagaaattccaagggcgcgtgaccataacagcggacgagagcacgagcacggcctatatggagctctcgagcttgcgctcggaagataccgcggtctatttctgtgccagggccgcggacgagagcgtggaatcgctcacgatcaaggcctttcgcacgaactatcactggggccagggcacgctcgtgaccgtgagctcg

SEQ ID NO: 58557 - RNA, 387 nt, synthetic construct
  misc_feature 1..387: note = derived and/or modified sequence opt11 from anti-influenza_Chain
  source 1..387: mol_type = other RNA
gaagtccaactcgtcgaatccggcggcggcgccgtccaacccggcgaatccctcaaactcccctgcgccgcctccggcttcaccttctccaactacggcatgcactgggtccgccaagcccccggcaaaggcctagaatgggtcgccgtcatctcctacgacggctccaacaaatactacgccgactccgtcaaaggccgcttcaccatctcccgcgacaactccaaagacaccctctacctccaaatgaactccctccgcgccgaagacaccgccctcttctactgcgccaaagaacgccccctccgcctcctccgctacttcgactggctctccggcggcgccaacgactactggggccaaggcaccctcgtcaccgtctcctcc

SEQ ID NO: 58558 - RNA, 387 nt, synthetic construct
  misc_feature 1..387: note = derived and/or modified sequence opt11 from anti-influenza_Chain
  source 1..387: mol_type = other RNA
gaagtgcaattggtcgagagcgggggcggggccgtgcaaccgggcgagagcttgaaattgagctgtgccgcgagcgggttcacgttctcgaactatggcatgcactgggtcaggcaagcgcccgggaaagggctcgagtgggtggccgtgatctcgtacgatggctcgaacaagtactatgccgatagcgtgaaagggcgatttaccataagcagggacaatagcaaggacacgctctatctccagatgaatagcttgcgcgcggaagataccgcgctcttttactgtgccaaggaaaggcccttgcgactgctcaggtactttgactggctctcgggcggggccaatgactattgggggcaagggaccttggtcacggtctcgagc

SEQ ID NO: 58559 - RNA, 387 nt, synthetic construct
  misc_feature 1..387: note = derived and/or modified sequence opt11 from anti-influenza_Chain
  source 1..387: mol_type = other RNA
caagtccaactcgtcgaatccggcggcggcgtcgtccaacccggccgctccctccgcctctcctgcgccgtctccggcttcaccttctcctcctacgccatgcactgggtccgccaagcccccggcaaaggcctcgaatgggtcgccgtcatctcctacgacggctccaaccaatactacgccgactccgtcaaaggccgcttcaccatctcccgcgacaactccaaaaacaccctctacctccaaatgaactcactccgcgccgaagacaccgccctctactactgcgccaaagacccccgcctccgccacctcctctacttccccttcacctccatgatctacttcgactactggggccaaggcaccctcgtcaccgtctcctcc

SEQ ID NO: 58560 - RNA, 387 nt, synthetic construct
  misc_feature 1..387: note = derived and/or modified sequence opt11 from anti-influenza_Chain
  source 1..387: mol_type = other RNA
caagtccaactcgtccaatccggcggcggcgtcgtccaacccggccgctccctacgcctctcctgcgtagcctccggcttcaccttctccacctacgccatgcactgggtccgccaagcccccggccgcggcctcgaatgggtcgccgtcatctcctacgacgccaactacaaatactacgccgactccgtcaaaggccgcttctccatctcccgcgacaactcccaaaacaccctccacctcgaaatgaacaccctccgcaccgaagacacagccctctactactgcgccaaagactcccaactccgctccctcctctacttcgaatggctctcccaaggctacttcgaaccctggggccaaggcaccctcgtcaccgtcacctcc

SEQ ID NO: 58561 - RNA, 387 nt, synthetic construct
  misc_feature 1..387: note = derived and/or modified sequence opt11 from anti-influenza_Chain
  source 1..387: mol_type = other RNA
caagtccaactcgtccaatccggcggcggcgtcgtccaacccggccgctccctccgcctctcctgcgtcgcctccggcttcaccttctccacctacgccatgcactgggtccgccaagcccccggccgcggcctcgaatgggtcgccgtcatctcctacgacggcaactacaaatactacgccgactccgtcaaaggccgcttctccatctcccgcgacaactccaactccaccctccacctcgaaatgaacaccctccgcaccgaagacaccgccctctactactgcgccaaagactcccaactccgctccctcctctacttcgaatggctctcccaaggctacttcgacccctggggccaaggcaccctcgtcaccgtcacctcc

SEQ ID NO: 58562 - RNA, 387 nt, synthetic construct
  misc_feature 1..387: note = derived and/or modified sequence opt11 from anti-influenza_Chain
  source 1..387: mol_type = other RNA
caagtccaactcgtccaatccggcgccgaagtcaaaaaacccggctcctcagtcaccgtctcctgcaaagcctccggcggcaccttctcaaactacggcatctcctgggtccgccaagcccccggccaaggcctcgactggatgggcggcatcatccccctcttcggaaccgccaactacgcccaaaaattccaaggccgcgtcaccatcaccgccgacgaatcaacctcctcctccaacatggaactctcctccctccgctccgaagacaccgccgtctactactgcgcccgcgacgtccacaactacgacttcctcaccggctaccccctccacctctacggcatggacgtctggggccaaggaaccacagtcaccgtctcctcc

SEQ ID NO: 58563 - RNA, 387 nt, synthetic construct
  misc_feature 1..387: note = derived and/or modified sequence opt11 from anti-influenza_Chain
  source 1..387: mol_type = other RNA
caagtccaactccaagaatccggccccggcctcgtcaaaccctccgaaaccctctcactcatctgcgccgtctccggcgcctccatctcatcctcctactggtcctggatccgccaacccccaggcaaaggcctcgaatggatcggctacatctactactccggcgtcaccaaatacaacccctccctaaaatcccgcgtcaccctctccgtcgacacctccaaaaaccacttctccctcaaactctcctacgtcaccgccgccgacaccgccgtctactactgcgcccgcaacctccccgacatcgccgtcgtcaccgccgtccaagacgccacccccgtctggttcgacccctggggccccggcaccctcgtatccgtctcctcc

SEQ ID NO: 58564 - RNA, 387 nt, synthetic construct
  misc_feature 1..387: note = derived and/or modified sequence opt11 from anti-influenza_Chain
  source 1..387: mol_type = other RNA
gaggtccagctcgtggaatcgggcgggggcttggtccagcccgggcgctcgctcaggctctcgtgcgcggcctcgggctttacctttagcgatttctggatgtcgtgggtgcgccaggccccgggcaagggcttggaatgggtcgcgaacatagaccaggacgggaacgagcgcttttacgcggactcggtcaagggcaggttcacgatctcgcgcgataacgcgaaaaatagcttgtacttgcaaatgacctcgctcagagccgatgacacggccgtgtactattgcgcgcgcgatggcagggaagggtacttttacgggagcgggagcttttacaatctcaagggcttgaactggggacagggcacgctcttgaccgtgagctcg

SEQ ID NO: 58565 - RNA, 387 nt, synthetic construct
  misc_feature 1..387: note = derived and/or modified sequence opt11 from anti-influenza_Chain
  source 1..387: mol_type = other RNA
gaggtactgatggtggagagcgggggggggttggtgcagccgggggggagtgtgaggttgagttgtgtggcgagcgggtttagttttagcagccattggatgacgtgggtgaggcaggcgccggggaaggggttggagtgggtggcgaatatagaggatgatgggggggataagtattatgtggatagcgtgaaggggaggtttataataagtagggataatgcgaagaatagtgtgtatttgcagatgaatagtttgagagcggaggatacggcggtgtatttttgtgcgagggggagtgggagtagcgataggagtgattatgatccgcattattattattatttggacgtgtgggggaagggggcgacggtgacggtgagtagt

SEQ ID NO: 58566 - RNA, 387 nt, synthetic construct
  misc_feature 1..387: note = derived and/or modified sequence opt11 from anti-influenza_Chain
  source 1..387: mol_type = other RNA
gaagtgcaactggtcgagagcgggggcgatctagtgcaaccgggaaggagcttgaaattgagctgtaccgggagcgggttcacgttcggggactatggcgtgacctgggtcaggcaagcgcccgggaaagggctcgagtgggtgggctttatcaggaccaggccatggggcgggacagcggacacggcagcgagcgtgaaagggcgctttaccataagcagggacgatagcaagagcttggcctatctccagatgaatagcttgaaaacggaagataccgcggtctattactgttgcagggacgcgccaccgaacgtggaagtggcctcgatgacgaactggtactttgacttgtgggggcgagggacattggtcacggtctcgagc

SEQ ID NO: 58567 - RNA, 387 nt, synthetic construct
  misc_feature 1..387: note = derived and/or modified sequence opt11 from anti-influenza_Chain
  source 1..387: mol_type = other RNA
gaagtgcaattggtccagagcgggagcgaggtcaagaaaccgggcgagagcctgaaaataagctgtaaagggagcgggtactcgttctcgaactattggataggctgggtcaggcacatgccagggaaagggctcgagtggatgggcataatctatcccggggactcggacacgcgctatagcccgagctttcaagggcaagtgaccatgagcgcggacaagagctcgagcacggtctatctccagtggtcgagcttgaaagcgagcgataccgcgatatattactgtgccagacgcgggggccatagctttggctatggctcgggcggggacacacactcggaatttgactcgtgggggcaagggaccttggtcacggtctcgagc

SEQ ID NO: 58568 - RNA, 387 nt, synthetic construct
  misc_feature 1..387: note = derived and/or modified sequence opt11 from anti-influenza_Chain
  source 1..387: mol_type = other RNA
caagtccaactcctcgaaaccggcggcggcctcgtcaaacccggccaatccctcaaactctcctgcgccgcctccggcttcaccttcacctcctacgccatgcactgggtccgccaaccccccggcaaaggcctcgaatgggtcgccgtcgtctcatacgacggcaactacaaatactacgccgactccgtccaaggccgcttcaccatctcccgcgacaactccaaaaacaccctctacctacaaatgaactccctccgcgccgaagacaccgccgtctactactgcgccaaagactcccgcctccgctccctcctctacttcgaatggctctcacaaggctacttcaacccctggggccaaggcaccaccctcaccgtctcatcc

SEQ ID NO: 58569 - RNA, 387 nt, synthetic construct
  misc_feature 1..387: note = derived and/or modified sequence opt11 from anti-influenza_Chain
  source 1..387: mol_type = other RNA
caagtacaactagtcgaatccggcgccgaagtcaaaaaacccggcgcctcagtcaaactctcctgcaccgcctcaggatacaacttcgccgcctactacatccactgggtccgccaagcacccggacaaggcctcgaatggatgggctggtccaaccccaacaccggcggcgccaactacgcccaggacttccaaggccgcgtcaccatgaccgccgtcaccagcacaagcaccgcctacatggaactatcccgcctcacctccgacgacaccgccctctacttctgcgcccgcgtcccccgcgaccgcctcctcacactctactacgaaagctcaacctacggattcgactactggggacaaggaaccctcgtcaccgtctccagc

SEQ ID NO: 58570 - RNA, 387 nt, synthetic construct
  misc_feature 1..387: note = derived and/or modified sequence opt11 from anti-influenza_Chain
  source 1..387: mol_type = other RNA
caagtgcaattggtcgagagcgggggcgggctcgtgcaaccgggagggagcttgcgcttgagctgtaccgtgagcgggttcacgttcaatagctatgcaatgaactgggtcaggcaagcgcccggaaaagggctagagtgggtgagcgggatcaggggatcgggcgagaacacgtactatgccgagaccgtgaaagggcgctttaccataagcagggacaatagcaagaacacgctctatctcgagatgaatagcttgcgcgcggaagataccgcggtctattactgtgccaggaaatggggcagaatgacggtctttggcgtggccacggaccagctctattactttgactattgggggcaagggacattggtcacggtctcgagc

SEQ ID NO: 58571 - RNA, 387 nt, synthetic construct
  misc_feature 1..387: note = derived and/or modified sequence opt11 from anti-influenza_Chain
  source 1..387: mol_type = other RNA
caagtccaactcgtcgaatccggccccggcctcgtcaaaccctcccaaaccctctccctaacctgcaccgtctccggcggctccatctccaacggcggctaccactggtcctggatacgccaacaccccggcaaaggcctcgaatggatcggcaacatctactaccgcggctccaccttctacgacccctccctcaaatcccgcgtaaccatctccgtagacacctccaaatcccaattctccctcaaactcacctccgtcaccgccgccgacaccgccgtctactactgcgcccgcatgcccctcgccaactacgacctcctcaccggcctctacatcggcgccttcgacctctggggccaaggcaccatggtcaccgtctcctcc

SEQ ID NO: 58572 - RNA, 387 nt, synthetic construct
  misc_feature 1..387: note = derived and/or modified sequence opt11 from anti-influenza_Chain
  source 1..387: mol_type = other RNA
caagtgcaattggtcgagagcggggccgaggtcaagaaaccgggcgcgagcgtgcgcgtgagctgtaaagggagcgggtacacgttcacggcctatcacatgcactgggtcaggcaagcgcccgggcaagggttcgagtgggtgggctggatcaatcccaatagcggggccacgtactatacctcgacctttgaaggacgcgtgaccatgaccagggacacgagcataaccacggcctatatggagctctcgagcctgcgctcggacgataccgcggtctattactgtgccacggacatagtcgtggaaagagacgcgagcttgggcgggttcaatagctatggcatggacgtgtgggggcaagggaccacggtaacggtctcgagc

SEQ ID NO: 58573 - RNA, 390 nt, synthetic construct
  misc_feature 1..390: note = derived and/or modified sequence opt11 from anti-influenza_Chain
  source 1..390: mol_type = other RNA
caagtccaactccaacaatggggcgccggcctcctcaaaccctccgaaaccctctcactcacctgcgccgtctacggaggctccttctccgtctccggctactactggtcctggatccgccaaccccccggccgcggcctcgaatggatcggcgaaatctcccacggcggctccaccaactacaacccctccctcaaatcccgagtcacaatctccgtcgacaccaccaaaaaccaattctccctacgcctctcctccgtcaccgccgccgacaccgccgtctactactgcgcccgcggcaccgaccccgacaccgaagtctactgccgcgtcggcaactgcgccgccttcgactactggggccaaggctccctcgtcaccgtctcctcc

SEQ ID NO: 58574 - RNA, 390 nt, synthetic construct
  misc_feature 1..390: note = derived and/or modified sequence opt11 from anti-influenza_Chain
  source 1..390: mol_type = other RNA
caagtccaactcctcgaatccggccccggcctcgtcaaaccctcccaaaccctcctcctcacctgcaccgtctccggcgcctccatctccaccggcggcaactactggtcctggatccgccaacaccccggcaaagacctcgaatggatcggctacatcttctactcaggcaccaccaaatacaacccctccgtcgacaacccctccctcaaatcccgagtcaccatgtccgtcgacacctccgaaaaccaattctccctcaaactctcctccgtcaccgccgccgacaccgccgtctacttctgcgcccgcggctcccccaactccggctacgactggggcccccacttcgactactggggccaaggcaccctcgtcaccgtctcctcc

SEQ ID NO: 58575 - RNA, 390 nt, synthetic construct
  misc_feature 1..390: note = derived and/or modified sequence opt11 from anti-influenza_Chain
  source 1..390: mol_type = other RNA
gaagtgcaattggtcgagagcgggggccatctcgtgcaaccgggcaggagcctgcgcttgagctgtgccgcgagcgggttcacgttcgaggactatgcaatgaactgggtcaggcaagcgcccgggaaagggctagagtgggtgagcgtgatctcgtgggatagcgggcgcataggctatgccgatagcgtgaaagggcgctttaccataagcagggacaatgcaaagaactcgagctatctccagatgaatagcttgcgcccggaagataccgcgctctattactgtgtcagggacatgctcgcgtactatagcgataactcgggcaagaaatataacgtgtacgggatggatgtctggggacagggcacgaccgtgaccgtgagctcg

SEQ ID NO: 58576 - RNA, 390 nt, synthetic construct
  misc_feature 1..390: note = derived and/or modified sequence opt11 from anti-influenza_Chain
  source 1..390: mol_type = other RNA
gaagtgcaattggtcgagagcgggggcgggctcgtgcaaccgggcaggagcttgcgcttgagctgtgccgtgagcgggttcatattcgaggactatgccataaactgggtcaggcaagcgcccgggaaagggctcgagtgggtgagcataatctcgtgggatagcgggcgcataggctatgccgatagcgtgcgcgggcgatttaccataagcagggacaatgccaagaactcgagctttctccagatgaatagcttgcgcccggaagataccgcggtctattactgtgtcaaggacatgctcgcgtactattacgatggctcgggcatacgatataacttgtacgggatggatgtctggggccagggcacgaccgtgaccgtgagctcg

SEQ ID NO: 58577 - RNA, 390 nt, synthetic construct
  misc_feature 1..390: note = derived and/or modified sequence opt11 from anti-influenza_Chain
  source 1..390: mol_type = other RNA
gaagtgcaattggtcgagagcgggggcgggctcgtgcaaccgggcaggagcctgcgattgagctgtgccgtgagcgggttcatattcgaggactatgccataaactgggtcaggcaagcgcccgggaaatgtctcgagtgggtgagcataatctcgtgggatagcgggcgaataggctatgccgatagcgtgcgcgggcgctttaccataagcagggacaatgccaagaactcgagctttctccagatgaatagcttgcgcccggaagataccgcggtctattactgtgtcaaggacatgctcgcgtactattacgatggctcgggcatacgctataacttgtacgggatggatgtctggggccagggcacgaccgtgaccgtgagctcg

SEQ ID NO: 58578 - RNA, 396 nt, synthetic construct
  misc_feature 1..396: note = derived and/or modified sequence opt11 from anti-influenza_Chain
  source 1..396: mol_type = other RNA
caaatcaccctcaaagaatccggccccaccctcgtcaaacccacccaaaccctcacactcacctgcgtcttctccggcttctccctctccatcaccggcgtccgagtcggctggatccgccaaccccccggcaaagccctcgaatggctagccctcatctcctgggacgacgaaaaacactactccccctccctccaatcccgcctcaccatcaccaaagacacctcaaaaaaccaagtagtcctcaccatgaccaacctcgaccccgtcgacaccgccacctactactgcgcccgctcaaccgaccgcggccacgtcctccgctacttcggctggatgctccccggcgacgccttcgacgtctggggccaaggcaccatggtcaccgtctcctca

SEQ ID NO: 58579 - RNA, 396 nt, synthetic construct
  misc_feature 1..396: note = derived and/or modified sequence opt11 from anti-influenza_Chain
  source 1..396: mol_type = other RNA
caagtccaactccaagaatccggccccggcctcgtcaaaccctccgaaaccctctccctcacctgcaccgtctcctccggccccatgtccgactactactggtcctggatccgccaaccccccggcaaaggcctcgaatggatcggccacgtctccgtctcccacggcggccgcaccaaatccaacccctccgtcatgtcccgcgtcaccatctctgtcgaaacatccaaaaaccaattctccctcaaactcacctccgtcaccgccgcagacaccgccgtctactactgcgcccgcctcaactactacgaccgctccggctaccactcccccgacggcccctcaaacaactggttcgacccctggggccaaggcaccctcgtcacagtctcctca

SEQ ID NO: 58580 - RNA, 396 nt, synthetic construct
  misc_feature 1..396: note = derived and/or modified sequence opt11 from anti-influenza_Chain
  source 1..396: mol_type = other RNA
caagtccaactcgtccaatccggcgccgaagtcaaaaaacccggcgcctccgtcaaagtctcctgcaaaacctccggctacaccttcaccgcatacaccatccactgggtccgccaagcccccggccaacgcctcgaatggatgggctggatcaacgccggcaacggccacaccaaatactcacaacgcttcaaaggccgcgtcaccatcacccgcgacacctccgcccgcaccacctacatggaactccgatcactcacctccgaagacaccgccctctacttctgcgcccgcggccccgaaacctactactacgacaaaaccaactggctcaactcacaccccgacgaatacttccaacactggggccacggaacacaagtcaccgtctcatcc

SEQ ID NO: 58581 - RNA, 399 nt, synthetic construct
  misc_feature 1..399: note = derived and/or modified sequence opt11 from anti-influenza_Chain
  source 1..399: mol_type = other RNA
caagtgcaattggtccagagcgggagcgaggtaaagaaaccgggcgcgagcgtgaaagtgagctgtaaagcgagcgggtacacgttcacgaactatgacataaactggatcaggcaagcgcccgggcaagggctcgagtggatgggctggatcaatcccaatagcgggaccacgggctcggcccagcgctttcaagggcgcgtgaccataaccgtggacacgagcataaccacggtctatatggagctctcgagcttgcgctcagacgataccgcgatctattactgtgccaggggcagggaattgctcaggctccagcactttctaacggactcgcaatcggaaaggcgcgattgctttgacccgtgggggcaagggaccttggtcacggtctcgagc

SEQ ID NO: 58582 - RNA, 402 nt, synthetic construct
  misc_feature 1..402: note = derived and/or modified sequence opt11 from anti-influenza_Chain
  source 1..402: mol_type = other RNA
gaggtccagctcgtggaatcgggcgggggcctggtcaagcccgggggatcgctcaggctctcgtgcgcggcctcgggcttgagctttctaaatgcctggatgtcgtgggtgcgccaggccccgggcaagggcttggaatgggtcgggcgaataaaatcgaacacggacgggggcacgaccgattacgcggccccggtcaagggcaggttcacgatctcgcgcgatgactcgaaaaataccttatacctgcaaatgagctcgctcaagaccgaggacacggccgtgtactattgcacgaccgatggcccgtactcagacgatttcaggagcgggtacgcggccaggtacaggtactttggcatggacgtgtgggggcaagggaccacggtcacggtatcgagc

SEQ ID NO: 58583 - RNA, 402 nt, synthetic construct
  misc_feature 1..402: note = derived and/or modified sequence opt11 from anti-influenza_Chain
  source 1..402: mol_type = other RNA
gaagtgcaattggtcgagagcgggggcgggctagtgaaaccgggagggagcttgcgcttgagctgtgccgcgagcgggttctcgttcttgaacgcgtggatgagctgggtaaggcaagcgcccgggaaagggctcgagtgggtgggaaggatcaagagcaataccgatggcgggacaacggactatgccgcgccagtgaaagggcgctttaccataagcagggacgatagcaagaacacgctatatctccagatgtcgagcttgaaaacggaagataccgcggtatattactgtaccacggacgggccgtatagcgatgactttcgatcgggctatgccgcgcgctatcgctatttcgggatggatgtatggggccagggaacgaccgtgaccgtgagctcg

SEQ ID NO: 58584 - RNA, 402 nt, synthetic construct
  misc_feature 1..402: note = derived and/or modified sequence opt11 from anti-influenza_Chain
  source 1..402: mol_type = other RNA
gaagtgcaattggtcgagagcgggggcgggctcgtgaaaccgggcgggagcttgcgcttgagctgtgccgcgagcgggctcacgttcttgaacgcgtggatgagctgggtcaggcaagcgccagggaaagggctagagtgggtgggcaggatcaagagcaataccgatggcgggaccacggactatgccgcgcccgtgaaagggcgctttaccataagcagggacgatagcaagaacacgctctatctccagatgtcgagcttgaaaacggaagataccgcggtatattactgtaccacggacgggccctatagcgatgactttcgctcgggctatgccgcgcgctatagatatttcgggatggatgtctggggccagggcacgaccgtgaccgtgagctcg

SEQ ID NO: 58585 - RNA, 402 nt, synthetic construct
  misc_feature 1..402: note = derived and/or modified sequence opt11 from anti-influenza_Chain
  source 1..402: mol_type = other RNA
gaagtgcaattggtcgagagcgggggcgggctagtgaaaccgggcgggagcttgcgactgagctgtgccgcgagcgggttctcgttctcgaacgcgtggatgagctgggtcaggcaagcgcccgggaaagggctcgagtgggtgggcaggatcaagagcaataccgatggcgggaccacggactatgccgcgcccgtgaaagggcgctttaccataagcagggacgatagcaagaacacgctctatctccagatgtcgagcttgaaaacggaagataccgcggtctattactgtaccacggacgggccctatagcgatgactttcgatcaggctatgccgcgcgatatcgctatttcggaatggatgtctggggccagggaacgacagtgaccgtgagctcg

SEQ ID NO: 58586 - RNA, 402 nt, synthetic construct
  misc_feature 1..402: note = derived and/or modified sequence opt11 from anti-influenza_Chain
  source 1..402: mol_type = other RNA
gaagtgcaattggtcgagagcgggggcgggctcgtgaaaccgggcgggagcttgcgcttgagctgtgccgcgagcgggctcacgttctcgaacgcgtggatgagctgggtcaggcaagcgcccgggaaagggctcgagtgggtgggcaggatcaagagcaataccgatggcgggaccacggactatgccgcgcccgtgaaagggcgctttaccataagcagagacgatagcaagaacacgctctatctccagatgtcgagcttgaaaacggaagataccgcggtctattactgtaccacggacgggccctatagcgatgactttcgatcgggctatgccgcgcgctatcgctatttcgggatggatgtctggggccagggcacgaccgtgaccgtgagctcg

SEQ ID NO: 58587 - RNA, 402 nt, synthetic construct
  misc_feature 1..402: note = derived and/or modified sequence opt11 from anti-influenza_Chain
  source 1..402: mol_type = other RNA
gaggtacagctcgtggaatcgggcgggggcttggtcaagcccgggggctcgctcaggctctcgtgcgcggcctcgggctttacctttagcaatgcctggatgtcgtgggtgcgacaggccccgggcaagggattggaatgggtcgggcgcataaaatcgaacacggacgggggcacgaccgattacgcggccccggtcaagggcaggttcacgatctcgcgcgatgactcgaaaaataccctgtacctgcaaatgagctcgctcaagaccgaggacacggccgtgtactattgcacgacagatggcccgtactcggacgatttcaggagcgggtacgcggccaggtacaggtactttggcatggacgtgtgggggcaagggaccacggtcacggtctcaagc

SEQ ID NO: 58588 - RNA, 402 nt, synthetic construct
  misc_feature 1..402: note = derived and/or modified sequence opt11 from anti-influenza_Chain
  source 1..402: mol_type = other RNA
gaagtgcaattggtcgtgagcgggggcgggctcgtgaaaccgggcgggagcttgcgattgagctgtgccgcgagcgggctctcgttcttgaacgcgtggatgagctgggtaaggcaagcgcccgggaaagggctcgagtgggtgggcaggatcaagagcaatacagatggcgggaccacggactatgccgcgcccgtgaaagggcgctttagcataagcagggacgatagcaagaacatgctctttctccatatgtcgagcttgcgcacggaagataccgcggtatattactgtgccacggacgggccctatagcgatgactttcgctcgggctatgccgcgcgctatcgctatttcgggatggatgtctggggccagggcacgaccgtgaccgtgagctcg

SEQ ID NO: 58589 - RNA, 402 nt, synthetic construct
  misc_feature 1..402: note = derived and/or modified sequence opt11 from anti-influenza_Chain
  source 1..402: mol_type = other RNA
gaagtgcaattggtcgtgagcgggggcgggctcgtgaaaccgggcgggagcttgcgcttgagctgtgccgcgagcgggctctcattcctgaacgcgtggatgagctgggtcaggcaagcgcccgggaaatgtctcgagtgggtgggcaggatcaagagcaataccgatggcgggaccacggactatgccgcgcccgtgaaagggcgctttagcataagcagggacgatagcaagaacatgctctttctccatatgtcgagcttgcgcacggaagacaccgcggtctattactgtgccacggacgggccctatagcgatgactttcgctcgggctatgccgcgcgctatcgctatttcgggatggatgtctggggccagggcacgaccgtgaccgtgagctcg

SEQ ID NO: 58590 - RNA, 402 nt, synthetic construct
  misc_feature 1..402: note = derived and/or modified sequence opt11 from anti-influenza_Chain
  source 1..402: mol_type = other RNA
gaggtccagctcgtggtctcgggcgggggcttggtcaagcccgggggctcgctcaggctctcgtgcgcggcctcgggcttgagctttctcaatgcctggatgtcgtgggtgcgccaggccccgggcaagggcctggaatgggtcgggcgcataaaatcgaacacggacgggggcacgaccgattacgcggccccggtcaagggcaggttctcgatctcgcgcgatgactcgaaaaatatgttgttcttgcacatgagctcgctcaggaccgaggacacggccgtgtactattgcgcgacagatggcccgtactcggacgatttcaggagcgggtacgcggccaggtacaggtactttggcatggacgtgtgggggtgcgggaccacggtcacggtctcgagc

SEQ ID NO: 58591 - RNA, 402 nt, synthetic construct
  misc_feature 1..402: note = derived and/or modified sequence opt11 from anti-influenza_Chain
  source 1..402: mol_type = other RNA
gaagtgcaattggtcgagagcgggggcggactcgtgaaaccgggcgggagcttgcgcttgagctgtgccgcgagcgggttcacgttcttgaacgcgtggatgagctgggtcagacaagcgccagggaaagggctcgagtgggtgggcaggatcaagagcaataccgatggcgggaccacggactatgccgcgcccgtgaaagggcgatttaccataagcagggacgatagcaagaacacgctctatctccagatgtcgagcctgaaaacagaagataccgcggtatattactgcaccacggacgggccctacagcgatgactttcgatcgggctatgccgcgcgctatcgatatttcgggatggatgtctggggccagggcacgaccgtgaccgtgagctcg

SEQ ID NO: 58592 - RNA, 402 nt, synthetic construct
  misc_feature 1..402: note = derived and/or modified sequence opt11 from anti-influenza_Chain
  source 1..402: mol_type = other RNA
gaggtccagctcgtggaatcgggcgggggcttggtcaagcccgggggctcgctcaggctctcgtgcgcggcctcgggctttacctttctcaatgcctggatgtcgtgggtgcgccaggccccgggcaagtgcttggaatgggtcgggcgcataaaatcgaacacggacgggggcacgaccgattacgcggccccggtaaagggcaggttcacgatctcgcgcgatgactcgaaaaataccttgtacttgcaaatgagctcgctcaagaccgaggacacggccgtgtactattgcacgacagatggaccgtactcggacgatttcaggagcgggtacgcggccaggtacaggtactttggcatggacgtgtgggggcaagggaccacggtcacggtctcgagc

SEQ ID NO: 58593 - RNA, 402 nt, synthetic construct
  misc_feature 1..402: note = derived and/or modified sequence opt11 from anti-influenza_Chain
  source 1..402: mol_type = other RNA
gaggtccagctcgtggaatcgggcgggggcttggtcaagcccgggggctcgctcaggctctcgtgcgcggcctcgggctttacctttctcaatgcctggatgtcgtgggtgcgccaggccccgggcaagggcttggaatgggtcgggcgaataaaatcgaacacggacgggggcacgaccgattacgcggccccggtcaagggcaggttcacgatctcgcgcgatgactcgaaaaataccttgtacttgcaaatgagctcgctcaagaccgaggacacggccgtgtactattgcacgaccgatggcccgtactcggacgatttcaggagcgggtacgcggccagatacaggtactttggcatggacgtgtgggggtgcgggaccacggtcacggtctcgagc

SEQ ID NO: 58594 - RNA, 414 nt, synthetic construct
  misc_feature 1..414: note = derived and/or modified sequence opt11 from anti-influenza_Chain
  source 1..414: mol_type = other RNA
caagtgcaattgcaagagagcgggggcgggctcgtgcaaccgggcgagagcttgcgcttgagctgtgtcgggagcgggagctcgttcggggaatcgaccttgagctattacgcggtatcgtgggtgcgccaggccccgggcaagggattggaatggctctcgatcataaacgcgggcgggggcgatatcgattacgcggactcggtcgagggcaggttcacgatctcgcgcgataactcgaaagagaccttgtacttgcaaatgaccaatctcagggtcgaggacacgggcgtgtactattgcgcgaaacacatgtcgatgcagcaagtggtctcggccgggtgggagcgcgcggacttggtcggggacgcgttcgatgtctggggacagggcacgatggtgaccgtgagctcg

SEQ ID NO: 58595 - RNA, 465 nt, synthetic construct
  misc_feature 1..465: note = derived and/or modified sequence opt11 from anti-influenza_Chain
  source 1..465: mol_type = other RNA
ctctcacgcatcaaccacttcgaaaaaatccaaatcatccccaaatcctcctggtccgaccacgaagcctcctccggcgtctcctccgcctgcccctaccaaggcaccccctccttcttccgcaacgtcgtctggctcatcaaaaaaaacaacacctaccccaccatcaaacgctcctacaacaacaccaaccaagaagacctcctcatcctctggggcatccaccactccaacgacgccgccgaacaaaccaaactctaccaaaaccccaccacctacatctccgtcggcacctccaccctcaaccaacgcctcgtccccaaaatcgccacccgctccaaagtcaacggccaaaacggccgcatggacttcttctggaccatcctcaaacccaacgacgccatcaacttcgaatccaacggcaacttcatcgcccccgaatacgcctacaaaatcgtaaaaaaa

SEQ ID NO: 58596 - RNA, 564 nt, synthetic construct
  misc_feature 1..564: note = derived and/or modified sequence opt11 from anti-influenza_Chain
  source 1..564: mol_type = other RNA
aacgtccccgaatggtcctacatcgtcgaaaaagcaaaccccgccaacgacctctgctaccccggcaacttcaacgactacgaagaactcaaacacctcctctcccgcataaaccacttcgaaaaaatccaaataatccccaaatcctcctggtccgaccacgaagcctcctccggcgtatcctccgcctgcccctaccaaggcaccccctccttcttccgcaacgtcgtctggctcatcaaaaaaaacaacacataccccacaatcaaacgctcctacaacaacaccaaccaagaagacctcctcatcctctggggcatccaccactcaaacgacgccgccgaacaaaccaaactctaccaaaaccccaccacctacatctcagtcggcacctccaccctaaaccaacgcctcgtccccaaaatcgccacccgctccaaagtcaacggccaaaacggccgcatggacttcttctggaccatactcaaacccaacgacgccatcaacttcgaatccaacggcaacttcatcgccccagaatacgcctacaaaatagtcaaaaaa

SEQ ID NO: 58597 - RNA, 609 nt, synthetic construct
  misc_feature 1..609: note = derived and/or modified sequence opt11 from anti-influenza_Chain
  source 1..609: mol_type = other RNA
atgctccgctccctagtcctcaacgaaaaactccgcgcccgcgtcctagaacgcgcagaagaattcctcctcaacaacaaagccgacgaagaagtctggttccgcgaactagtcctctgcatcctcacctccaactcctccttcatctccgcctacaaatcaatgaactacatcctcgacaaaatcctctacatggacgaaaaagaaatctccatcctcctccaagaatcaggataccgcttctacaacctcaaagccaaatacctctaccgcgccaaaaacctctacggcaaagtcaaaaaaacaatcaaagaaatcgccgacaaagaccaaatgcaagcccgcgaattcatcgccacccacatctacggcatcggatacaaagaagcctcccacttcctccgaaacgtaggctacctagacctcgccatcatcgaccgccacatcctccgcttcatcaacaacctcggcatacccatcaaactaaaatccaaacgcgaatatctcctcgccgaatccctcctccgctccatcgccaacaacctaaacgtccaagtaggcctcctcgacctcttcatcttcttcaaacaaaccaacaccatcgtcaaa

SEQ ID NO: 58598 - RNA, 615 nt, synthetic construct
  misc_feature 1..615: note = derived and/or modified sequence opt11 from anti-influenza_Chain
  source 1..615: mol_type = other RNA
ggcctcttcggggcaatagcgggcttcatcgaaggcgggtggacaggcatggtcgacggctggtacgggtaccaccaccaaaacgagcaaggaagcgggtacgcagccgacctcaagagcacgcaaaacgccatagacgagataacgaacaaggtcaacagcgtgatcgagaaaatgaacacacaattcaccgcggtcgggaaagagttcaaccacctagaaaagcgcatagaaaacctcaacaaaaagatcgacgacgggttcctggacatatggacgtacaatgccgagctcctggtcctactcgagaacgagcgcacgctcgactaccacgactcgaacgtgaaaaacctctacgaaaaggtcaggagccagctcaagaacaacgccaaggaaataggcaacggctgcttcgagttctaccacaagtgcgacaacacgtgcatggaatcggtcaagaacgggacctacgactaccccaagtactcggaagaggccaagctcaaccgcgaggaaatagacggggtcaagctagagagcacgcgcatataccagatcctggccatctactcgaccgtggcctcgagcctggtcctagtcgtaagcctaggcgcg

SEQ ID NO: 58599 - RNA, 639 nt, synthetic construct
  misc_feature 1..639: note = derived and/or modified sequence opt11 from anti-influenza_Chain
  source 1..639: mol_type = other RNA
gaaatcgtcctcacccaatcccccggcaccctctccctctccccaggagaacgcgccaccctctcctgccgcgcctcccaacgcgtctcatcctacctagcctggtaccaacaaaaacccggccaagcaccccgcctcctcatctacggcgcctccacccgcgccgccggcatacccgaccgcttctccggctcaggctccggcaccgacttcaccctcaccatatcccgcctagaacccgaagattcagccgtatactactgccaacaatacggccgcacacccctcaccttcggcggcggcaccaaagtcgaaatcaaacgcgccgccgccccctccgtattcatcttcccaccctccgacgaacaactcaaatccggcaccgcctccgtcgtctgcctactcaacaacttctacccccgcgaagcaaaagttcaatggaaagtcgacaacgccctacaatccggcaactcccaagaatccgtcaccgaacaagactccaaagactcaacctactcactctcttcaaccctaaccctctccaaagcagactacgaaaaacacaaagtatacgcctgcgaagtcacccaccaaggactctcctctcccgtcaccaaatcctttaaccgcggcgaatgc

SEQ ID NO: 58600 - RNA, 639 nt, synthetic construct
  misc_feature 1..639: note = derived and/or modified sequence opt11 from anti-influenza_Chain
  source 1..639: mol_type = other RNA
gacatacaaatgacccaatcaccctcctccctctccgcctccctcggcggaaacgtcacaatcacatgcaaagcctcccaagacatcaacaaatacatcgcctggtaccaacacaaacccggcaaaggcccccgcctcgtcatccactacacctccaccctacaacccggcataccctcccgcttctccggatccggctccggcaccgactactccttctccatctccaacctcgaacccgaagacatcgcaacctactactgcctccaatacgacatcctatacaccttcggcggcggcaccaaactcgaaatcaaacgcgccgacgccgcccccaccgtctccatcttccccccctcctcagaacaactcacctccggcggcgcctcagtcgtctgctttctcaacaacttctaccccaaggacatcaacgtcaaatggaaaatcgacggctccgaacgccaaaacggcgtactaaactcctggaccgaccaagactccaaagactccacctactcaatgtcctcaaccctcaccctcaccaaagacgaatacgaacgtcacaactcctacacctgcgaagcaacccacaaaacttccacctcacccatcgtcaaatccttcaaccgaaacgaatgc

SEQ ID NO: 58601 - RNA, 642 nt, synthetic construct
  misc_feature 1..642: note = derived and/or modified sequence opt11 from anti-influenza_Chain
  source 1..642: mol_type = other RNA
gacatccaaatgacccaatccccctcctccctctccgcctccgtaggcgaccgcgtcaccatcacctgccgcgcctcccaaggcatatcctcatacctagcctggtaccaacaaaaacccggcaaagtccccaccctcctcatctacgacgcctccacactccgctcaggcgtcccctcacgcttctccggctccggctccgccaccgacttcaccctcaccatctcctccctccaacccgaagacgtcgccacctactattgccaacgctacaactcagccccccccatcaccttcggccaaggcacccgcctcgaaatcaaacgcgccgccgccccctccgtcttcatcttccccccctccgacgaacaactaaaatcaggcacagcctcagtcgtctgcctcctcaacaacttctacccccgagaagcaaaagtccaatggaaagtcgacaacgccctccaatcaggcaactcccaagaatccgtcaccgaacaagactccaaagactccacctactccctctcctccaccctcaccctatccaaagccgactacgaaaaacacaaagtatacgcctgcgaagtcacccaccaaggcctctcctccccagtcacaaaatccttcaaccgcggcgaatgc

SEQ ID NO: 58602 - RNA, 642 nt, synthetic construct
  misc_feature 1..642: note = derived and/or modified sequence opt11 from anti-influenza_Chain
  source 1..642: mol_type = other RNA
gaaatcgtcctcacccaatcccccggcacactctcactctcccccggcgaacgcgccaccctctcctgccgcgcctcccaatcagtctcctcctcctacctcgcctggtaccaacaaaaacccggccaagcaccccgactactcatctacggcgcctcatcacgcgccacaggcatccccgaccgattctccggctccggctcaggaaccgacttcaccctcaccatctctcgcctcgaacccgaagacttcgccgtctactactgccaacaatacggctcatctccccgcaccttcggaggcggtaccaaagtcgaaataaaacgcgccgccgccccctccgtcttcatcttcccaccctccgacgaacaactcaaatccggcaccgcatccgtcgtctgcctcctaaacaacttctacccccgagaagccaaagtccaatggaaagtcgacaacgccctccaatccggcaactcacaagaatccgtcaccgaacaagactccaaagactccacctactccttatcctccaccctcaccctctccaaagccgactacgaaaaacacaaagtatacgcatgcgaagtcacacaccaaggcctttcatcacccgtcaccaaatccttcaacagaggcgaatgc

SEQ ID NO: 58603 - RNA, 642 nt, synthetic construct
  misc_feature 1..642: note = derived and/or modified sequence opt11 from anti-influenza_Chain
  source 1..642: mol_type = other RNA
tcatacgtcctcacccaacccccctccgtctccgtcgcccccggcgaaacagcaaccgtcacctgcggcggcaacaacatcggctccaaatcagtccactggtaccaacaaaaacccggccaagcacccgtcgtcgtcatctactacgacggagaccgaccctccggcatccccgaacgcttctccggaagcaactccggagacaccgccacactcaccatctcccgcgtcgaagccggcgacgaagccgactactactgcctcgtctgggactacacatccgtacactacgtcttcggtaccggcaccaaagtcaccgtcctcggccaacccaaagccaaccccaccgtcaccctcttccccccctcatcagaagaactccaagccaacaaagccacactcgtctgcctcatctccgacttctaccccggcgcagtcaccgtcgcctggaaagcagacggctcacccgtcaaagccggcgtagaaaccaccaaaccctccaaacaatccaacaacaaatacgccgcctcctcctacctctcactcacccccgaacaatggaaatcccaccgctcctactcctgccaagtcacccacgaaggctcaaccgtcgaaaaaacagtcgcccccaccgaatgcagc

SEQ ID NO: 58604 - RNA, 642 nt, synthetic construct
  misc_feature 1..642: note = derived and/or modified sequence opt11 from anti-influenza_Chain
  source 1..642: mol_type = other RNA
gacatccaaatgacacaaacctcttcctccctctccgcatccctcggcgaccgcgtcaccatctcatgccgcgcatcccaagacatccgcaactacctcaactggtaccaacaaaaacccgacggcaccgtcaaactcctcatctactacacctcccgactccactcaggcgtcccctcccgattctccgactccggctccggcaccgactactccctcaccatctcaaacctcgaacaagaagacctcgccacctacttctgccaacaaacctacacactcccctggaccttcggaggcggcaccaaactcgaaatcaaacgcgccgacgccgcccccaccgtctccatcttccccccctcctccgaacaactcacctccggcggcgcatcagtcgtctgcttccttaacaacttctaccccaaagacatcaacgtcaaatggaaaatcgacggatccgaacgccaaaacggcgtcctcaactcatggaccgaccaagactccaaagactcaacctactccatgtcctccaccctcaccctcaccaaagacgaatacgaacgccacaactcctacacatgcgaagccacccacaaaacctcaacctcccccatagtcaaatccttcaaccgcaacgaatgc

SEQ ID NO: 58605 - RNA, 645 nt, synthetic construct
  misc_feature 1..645: note = derived and/or modified sequence opt11 from anti-influenza_Chain
  source 1..645: mol_type = other RNA
gacggcgtcaaaccactcatcctccgcgactgctccgtcgccggctggctcctcggaaaccccatgtgcgacgaattcataaacgtccccgaatggtcatacatcgtcgaaaaagccaaccccgccaacgacctctgctaccccggcaacttcaacgactacgaagaactcaaacacctcctctcccgcatcaaccacttcgaaaaaatccaaatcatccccaaatcctcctggtccgaccacgaagcctcctcaggcgtctcatccgcctgcccctaccaaggcaccccctcattcttccgcaacgtcgtctggctcatcaaaaaaaacaatacctaccccaccatcaaacgctcctacaacaacaccaaccaagaagacctccttatcctctggggcatccaccactctaacgacgccgccgaacaaaccaaactctaccaaaaccccaccacctacatatccgtcggcacatcaaccctcaaccaacgcctagtccccaaaatcgccacccgctccaaagtcaacggccaaaacggacgcatggacttcttctggaccatcctcaaacccaacgacgccatcaacttcgaatccaacggcaacttcatagcccccgaatacgcctacaaaatcgtcaaaaaa

SEQ ID NO: 58606 - RNA, 645 nt, synthetic construct
  misc_feature 1..645: note = derived and/or modified sequence opt11 from anti-influenza_Chain
  source 1..645: mol_type = other RNA
gacatccaaatgacacaatccccctccaccctctccgcctccgtaggcgaccgcgtaaccataacctgccgcgcctcccaaactatcaacaactacctcgcctggtaccaacaaaaacccggcaaagcccccaaactactcatctacaaagcctcctcactcgaatccggcgttccctcccgcttctccggctccggctccggcacagaattcaccctaaccatctcctcactccaacccgacgacttcgccacctactactgccaagaatacaacaacgactcaccactcaccttcggcggcggcacaaaagtcgaaatcaaacgaaccgtcgccgccccctccgtcttcatcttcccaccatcagacgaacaactcaaatccggcaccgcctccgtcgtctgcctcctcaacaacttctacccccgcgaagccaaagtccaatggaaagtcgacaacgccctccaatccggtaactcccaagaatccgtcaccgaacaagactccaaagactccacctactccctcagctccacactcaccctctccaaagccgactacgaaaaacacaaagtatacgcctgcgaagtcacccaccaaggcctctcctcgccagtcactaaatccttcaaccgcggcgaatgc

SEQ ID NO: 58607 - RNA, 645 nt, synthetic construct
  misc_feature 1..645: note = derived and/or modified sequence opt11 from anti-influenza_Chain
  source 1..645: mol_type = other RNA
tccgtcctcacccaacccccctccgcatccggctctcgcggccaatccatcaccatctcctgcaccggctctacctcagacattggctcctacaactacgtctcctggtaccaacaacaccccggaacagcccccaaagtcatcctctacgaagtatcccaacgaccctccggcgtcccagaccgtttctcaggatcaaaatccggcaacaccgccttcctcaccgtctccggcctccaagccgaagacgaagccgactactactgcgcctcctacgccggcaacaacatctacgtcttcggctccggcaccaaagtcaccgtcctcggccaacccaaagccaaccccaccgtcacactattccccccctcctccgaagaactccaagcaaacaaagccaccctcgtctgcctcatctccgacttctaccccggcgccgtcaccgtcgcctggaaagccgactcctctcccgtaaaagccggcgtcgaaaccacaaccccatcaaaacaatcaaacaacaaatacgccgcctcctcctacctctccctcacacccgaacaatggaaatcccacaaatcatactcatgccaagtcacccacgaaggctccaccgtcgaaaaaaccgtcgccccaaccgaatgcagc

SEQ ID NO: 58608 - RNA, 645 nt, synthetic construct
  misc_feature 1..645: note = derived and/or modified sequence opt11 from anti-influenza_Chain
  source 1..645: mol_type = other RNA
tccgcactcacacaacccccctccgcctccggatcccgcggccaatccatcaccatctcctgcaccggctccacctccgacataggctcctacaactacgtctcctggtaccaacaacaccccggcaccgcccccaaagtaatactctacgaagtctcccaacgaccctccggcgtccccgaccgcttctccggctccaaatccggaaacaccgccttcctcaccgtatccggcctacaagccgaagacgaagccgactactactgcgcatcctacgccggcaacaacatctacgtcttcggatccggcaccaaagtcaccgttctaggccaacccaaagccaaccccaccgtcaccctcttcccaccctcatccgaagaactccaagccaacaaagccaccctcgtctgcctcatctccgacttctacccaggcgccgtaacagtcgcctggaaagccgactcatcacccgtcaaagccggcgtcgaaaccactaccccctccaaacaatccaacaacaaatacgcagcctcctcctacctctccctcacccccgaacaatggaaatcacacaaatcctactcctgtcaagtcacccacgaaggctccaccgtcgaaaaaacagtcgcccccaccgaatgctca

SEQ ID NO: 58609 - RNA, 648 nt, synthetic construct
  misc_feature 1..648: note = derived and/or modified sequence opt11 from anti-influenza_Chain
  source 1..648: mol_type = other RNA
caatccgtcctcacccaacccccctcagaatccgtctcccccggccaaaccgcatccgtcacctgctccggccacaaactcggagacaaatacgtctcctggtaccaacaaaaacccggccaatcccccgtcctactcatctaccaagacaacagacgcccctccggcatcccagaacgcttcatcggatccaattccggcaacaccgctaccctcaccatctccggcacacaagccctcgacgaagccgactactactgccaagcctgggactcttcaacagccgtcttcggaggcggcacaaaactcaccgtactaggcgccgccgcaggccaacccaaagccgccccctccgtcaccctattccccccatcctccgaagaactccaagccaacaaagccaccctcgtctgcctcatatcagacttctaccccggcgctgtaaccgtcgcctggaaagccgactcctcccccgtaaaagccggcgtcgaaaccaccacaccctccaaacaatccaacaacaaatacgccgcatcctcctacctctccctcacaccagaacaatggaaatcccaccgctcctactcctgccaagtaacccacgaaggctctacagtcgaaaaaaccgtcgcccccaccgaatgctcc

SEQ ID NO: 58610 - RNA, 648 nt, synthetic construct
  misc_feature 1..648: note = derived and/or modified sequence opt11 from anti-influenza_Chain
  source 1..648: mol_type = other RNA
caatccgccctcacccaacccgcctccgtctctggctccccaggccaatccatcaccatctcctgcaccggcacatcctccgacgtcggctcttacaacctcgtatcctggtaccaacaacaccccggcaaagcccccaaactcatgatctacgaagtctccaaacgcccctccggcgtctccaaccgcttctcaggctccaaatcaggcaacaccgcctccctcaccatctccggcctccaagccgaagacgaagccgactactactgccacctctacgtcggctcctccaactgggtcttcggcggcggcaccaaactcgccgtcctcggtcaacccaaagccgccccctccgtcactctcttccccccatcttccaaagaactccaagccaacaaagccacactcgtctgccccatctccgacttctaccccggagccgtcacagtcgcctggaaagccgactcctcccccgtaaaagccggtgtcgaaaccactaccccctccaaacaatcgaacaacaaatacgccgcctcatcctacctctccctcacaccagaacaatggaaatcccacaaatcctactcctgccaagtcacccacgaaggctccaccgtcgaaaaaaccgtcgccccaaccgaatgctca

SEQ ID NO: 58611 - RNA, 648 nt, synthetic construct
  misc_feature 1..648: note = derived and/or modified sequence opt11 from anti-influenza_Chain
  source 1..648: mol_type = other RNA
gaaatcgtactcacacaatccccagccaccctctccgtatcccccggcgaacgcgccaccctctcctgccgcgcctcccaatccgtcgactccaacctagcctggtaccaacaaaaacccggccaagccccccggctactcgtctactctgcctctacccgcgccaccggcatccccgcccgcttctccggctccggctccggcaccgaattcaccctagccatctcatcactccaatccgaagacttcgccgtctactactgccaacactacaccaactggcccccccgcctcaccttcggcggcggctccaaagtcgaaatcaaacgcaccgtcgccgcaccctccgtcttcatattcccaccctccgacgaacaactcaaatcaggcaccgcctcagtcgtctgcctcctcaacaacttctacccacgcgaagccaaagtccaatggaaagtcgacaacgccctccaatcaggcaactcccaagaatccgtaaccgaacaagactcaaaagactcaacctacagcctatcatccaccctcacactctcaaaagccgactacgaaaaacacaaagtctacgcctgcgaagtcacccaccaaggcctatcatcccccgtcaccaaatccttcaaccgaggcgaatgc

SEQ ID NO: 58612 - RNA, 648 nt, synthetic construct
  misc_feature 1..648: note = derived and/or modified sequence opt11 from anti-influenza_Chain
  source 1..648: mol_type = other RNA
gaaatcgtcctcacacaatcccccgccaccctctccgtctcccccggtgaacgcgcaacactctcctgccgcgcctcccaatccgtctcccacaacctagcctggtaccaacaaaaacccggacaagcccccagactcctagtctactctgcctccacccgcgccaccggtatcccagcccgattctccggctccggctccggcaccgaattcaccctcgccatctcatccctccaatccgaagacttcgccgtctactactgccagcactacaccaactacccccctcgcctcaccttcggcggcggctctaaagtcgaaatcaaacgcaccgtagccgccccctccgtcttcatcttccccccctcagacgaacaactcaaatccggcaccgcctccgtcgtatgcctactcaacaacttctacccacgcgaagccaaagtccaatggaaagtcgacaacgccctccaatccggcaactcccaagaatccgtcaccgaacaagactccaaagactcaacctactccctctcctccaccctcacactatccaaggccgactacgaaaaacacaaagtctacgcctgcgaagtcacccaccaaggactatcctcccccgtaaccaaatccttcaaccgcggcgaatgc

SEQ ID NO: 58613 - RNA, 648 nt, synthetic construct
  misc_feature 1..648: note = derived and/or modified sequence opt11 from anti-influenza_Chain
  source 1..648: mol_type = other RNA
gagatcgtaatgacgcaatcgccagcaaccctgagcgtgagcccgggcgagcgcgcgaccttgagctgccgcgcgagccagagcgtggactcaaacttggcctggtaccagcaaaaacccggacaagcgcccagactcttggtctatagcgcgagcacgcgcgcgaccgggatcccggccaggttctcgggctcaggatcaggcacggagttcaccttggccatatcctcgctccagagcgaagactttgccgtgtactattgccagcactataccaattggccgcccaggctcacgttcggaggcgggagcaaagtcgagatcaagcgcacggtcgcggccccgagcgtattcatattcccgccctcggacgagcaattgaaatcaggcacggcctcggtagtgtgcctgctcaataacttttacccacgcgaggccaaggtccagtggaaggtcgataacgcgctccagagcgggaactcgcaagagagcgtgaccgagcaagatagcaaggactcgacatatagtttaagctcaaccctgaccctgagcaaggccgactacgagaaacacaaagtgtacgcgtgcgaggtcacgcaccagggcttgagctcgcccgtcacaaagagctttaacagaggcgagtgc

SEQ ID NO: 58614 - RNA, 648 nt, synthetic construct
  misc_feature 1..648: note = derived and/or modified sequence opt11 from anti-influenza_Chain
  source 1..648: mol_type = other RNA
gaaatcgtactcacccaatctcccgccaccctctccgtctcccccggcgaacgcgccaccctatcctgccgcgcctcccaatccgtctcctcaaacctagcctggtaccaacaaaaacccggccaagccccccgcctcctcgtctactccgcatcaacccgagccaccggcatccccgcccgcttctcaggctccggctcaggcacagaattcaccctcgccatctcctcactccagtccgaagacttcgccgtctactactgccaacattacaccaactggccccccagactcaccttcggcggcggctccaaagtcgaaatcaaacgcacagtcgcagccccctctgtcttcatcttccccccctccgacgaacaactcaaatcaggtaccgcctcagtcgtatgcttactcaacaacttctacccccgcgaagccaaagtccaatggaaggtcgacaacgcactccaatccggcaactcccaagaatccgtcacagaacaagactccaaagactccacctactccctatcctccaccctcaccctctccaaagccgactacgaaaaacacaaagtctacgcctgcgaagtaacccaccaaggcctctcctcccccgtcaccaaatccttcaaccgcggcgaatgc

SEQ ID NO: 58615 - RNA, 648 nt, synthetic construct
  misc_feature 1..648: note = derived and/or modified sequence opt11 from anti-influenza_Chain
  source 1..648: mol_type = other RNA
gaaatcgtgctcacacaatcacccgcgaccctaagcgtaagcccaggcgaacgcgccaccctcagctgccgcgcaagccaaagcgtagaccacaacctcgcctggtaccaacaaaaacccggacaagcacccagactcctagtctacagcgcaagcacacgcgcaaccggcatcccagcccggttctcaggctcaggctcaggcacagaattcaccctcgccatatcctcactccaaagcgaagacttcgccgtatactactgccaacactacaccaactggccacccagactcacattcggaggcggcagcaaagtcgaaatcaaacgcacagtcgccgccccaagcgtattcatattccccccctccgacgaacaactaaaatcaggcacagcctcagtcgtctgcctcctcaacaacttctacccccgcgaagccaaagtccaatggaaagtcgacaacgccctacaaagcggaaactcacaagaaagcgtaaccgaacaagacagcaaagactcaacctacagcctaagctcaaccctaacactaagcaaagccgactacgaaaaacacaaagtctacgcctgcgaagtcacccaccaaggcctcagctcacccgtaaccaaatccttcaacagaggcgaatgc

SEQ ID NO: 58616 - RNA, 648 nt, synthetic construct
  misc_feature 1..648: note = derived and/or modified sequence opt11 from anti-influenza_Chain
  source 1..648: mol_type = other RNA
gaaatagtcctcacccaatcccccgccacactctccgtatcccccggcgaacgagccacactatcctgccgcgcatcccaatccgtctcccacaacctcgcctggtaccagcaaaaacccggacaagcaccccgactcctcgtctacagcgcctccacacgcgcaaccggcatccccgcccgattctcaggctccggctccggcaccgaattcaccctcgccatcagctccctccaatccgaagacttcgccgtatactactgccaacactacaccaactggcccccccgcctcaccttcggcggcggctccaaagtcgaaatcaaacgcacagtcgccgccccctccgtcttcatattccccccctcagacgaacaattaaaatccggcaccgcctccgtcgtatgcctcctcaacaacttctacccccgcgaagccaaagtccaatggaaagtcgacaacgcactccaatctggcaactcccaagaatccgtaaccgaacaagactccaaagactccacctactccctatcctccaccttaaccctatccaaagccgactacgaaaaacacaaagtatacgcatgcgaagtcacccaccaaggcctctcctcccccgtaaccaaatccttcaaccgcggcgaatgc

SEQ ID NO: 58617 - RNA, 648 nt, synthetic construct
  misc_feature 1..648: note = derived and/or modified sequence opt11 from anti-influenza_Chain
  source 1..648: mol_type = other RNA
gaaatcgtactcacacaatcccccgccaccctctccgtctcccccggcgaacgcgccaccctctcctgccgtgccagccaatccgtctcccacaacctcgcctggtaccaacaaaaacccggccaagcaccccgcctcctagtctactccgcctccacacgcgcaaccggcatcccagccagattctccggctccggctccggcaccgaattcaccctcgccatctcctccctacaatccgaagacttcgccgtatactactgccaacactacaccaacttccccccccgtctcaccttcggcggcggctccaaagtcgaaatcaaacgcaccgtcgccgccccctccgtcttcatcttccccccctccgacgaacaactaaaatccggcaccgcctccgtcgtatgcctcctcaacaacttctacccacgcgaagccaaagtccaatggaaagtcgacaacgcactccaatccggcaactcccaagaatccgtcaccgaacaagactccaaagactcaacctactccctctcctccacactaactctctccaaagccgactacgaaaaacacaaagtctacgcatgcgaagtcacacaccaaggcctctcctctcccgtaaccaaatccttcaaccgcggcgaatgc

SEQ ID NO: 58618 - RNA, 648 nt, synthetic construct
  misc_feature 1..648: note = derived and/or modified sequence opt11 from anti-influenza_Chain
  source 1..648: mol_type = other RNA
gaaatcgtactcacacaatcacccgccaccctctccgttagccccggcgaacgcgccaccctgtcctgccgcgccagccaaagcgtcgactccaacctcgcctggtaccaacaaaaacccggccaagcaccccgcctcctagtctactccgcctccacccgcgccaccggcatccccgccagattctcaggctcaggctccggcacagagttcaccctcgccatatcctccctccaatccgaagacttcgccgtctactactgccaacactacaccaacttcccaccccgactcacattcggcggcggcagcaaagtcgaaatcaaacgcacagtcgccgccccctccgtcttcatcttcccaccctcagacgaacaactcaaatccggcaccgcctccgtcgtctgcctcctaaacaacttctacccccgcgaagccaaagtccaatggaaagtcgacaacgccctccaatcagggaactcccaagaaagcgtcaccgaacaagactcaaaagactccacctactccctatcctccaccctcaccctaagcaaagccgactacgaaaaacacaaagtctacgcctgcgaagtcacccaccaaggcctcagctcccccgtcaccaaatccttcaaccgaggcgaatgc

SEQ ID NO: 58619 - RNA, 648 nt, synthetic construct
  misc_feature 1..648: note = derived and/or modified sequence opt11 from anti-influenza_Chain
  source 1..648: mol_type = other RNA
gaaatcgtactcacccaatcacccgcaacactatccgtctcccccggcgaacgcgccaccctcagctgccgcgcctcccaatccgtcgactcgaacctagcctggtaccaacaaaaacccggccaagccccacgactcctagtctacagcgcatccacccgagccaccggaatccccgcccgcttctcaggctcaggctccggcaccgaattcaccctcgccatctcctccctacaatcagaagacttcgccgtctactactgccagcactacaccaactaccccccccgcctcacattcggcggcggctcaaaggtcgaaatcaaacgcacagtcgccgccccctccgtcttcatcttccccccctccgacgaacaactcaaatccggcaccgcctcagtcgtctgccttctcaacaacttctacccccgcgaagccaaagtccaatggaaagtcgacaacgccctccaatccggcaactcccaagaaagcgtcaccgaacaagactcaaaagactcaacctactcactcagctccaccctaaccctatccaaagccgactacgaaaaacacaaagtatacgcctgcgaagtaacccaccaaggcctctcatcccccgtaaccaaatccttcaaccgcggcgaatgc

SEQ ID NO: 58620 - RNA, 648 nt, synthetic construct
  misc_feature 1..648: note = derived and/or modified sequence opt11 from anti-influenza_Chain
  source 1..648: mol_type = other RNA
gaaacaaccctcacccaatcccccgcaaccctttccgtctcacccggcgaacgcgccacactctcctgccgcgcctcacaagtcatctcccacaacctagcctggtaccaacaaaaacccggacaagcaccccgactcctaatctacggcgcctccacccgcgcctccggcatccccgcccgcttctctggatccggctccggcaccgactacacccttaccatcacctcactccaatccgaagacttcgccgtatactattgccaacactactcaaactggccaccccgcctcaccttcggcggcggcaccaaagtcgaaatcaaacgcaccgtcgccgcccccagcgtcttcatattcccaccctccgacgaacaactcaaatccggcaccgcctccgtcgtctgcctcctcaacaacttctacccccgcgaagccaaagtccaatggaaagtcgacaacgccctccaaagcggaaactcacaagaatccgtcaccgaacaagactctaaagactccacctactccctcagctccaccctcaccctctccaaagccgactacgaaaaacacaaagtctacgcctgcgaagtcactcaccaaggcctatcctccccagtaaccaaatcctttaaccgaggcgaatgt

SEQ ID NO: 58621 - RNA, 648 nt, synthetic construct
  misc_feature 1..648: note = derived and/or modified sequence opt11 from anti-influenza_Chain
  source 1..648: mol_type = other RNA
gaaatcgtcctcacccaatcccccgccaccctatccgtctcccccggcgaacgcgccaccctctcctgccgcgcctcccaagtcatctcccacaacctcgcctggtaccaacaaaaacccggccaagcccccagactactcatctacggcgcatccacccgagccagcggtatccccgcccgcttctcaggctccggctcaggcaccgactacacactcaccatcacctcactccaatccgaagacttcgcagtctactactgccaacactactccaactggccaccccgcctcaccttcggcggcggcaccaaagtcgaaatcaaacgcaccgtcgctgcaccctccgtcttcatcttcccaccctccgacgaacaactaaaatccggcaccgcctccgtcgtctgcctcctcaacaacttctacccccgcgaagccaaagtccaatggaaagtagacaacgccctccaatccggcaactcccaagaatccgtcaccgaacaagactccaaagactccacctactccctctcctccaccctcaccctctccaaagccgactacgaaaaacacaaagtatacgcctgcgaagtcacccaccaaggactatcctcccccgtcaccaaatccttcaaccgaggcgaatgc

SEQ ID NO: 58622 - RNA, 648 nt, synthetic construct
  misc_feature 1..648: note = derived and/or modified sequence opt11 from anti-influenza_Chain
  source 1..648: mol_type = other RNA
gaaatcgtcctcacccaatcacccgccaccctctcagtctcccccggagaacgcgccaccctatcctgccgcgcctcccaagtcatctcccacaacctagcctggtaccaacaaaaaccaggccaagcaccccgcctcctaatatacggcgccagcacccgcgcctccggaatccccgcccgcttctccggatccggctccggaaccgactacaccctcaccatcacctcactccaacccgaagacttcgccgtctactactgccaacactactccaattggccaccccgcctcacattcggcggcggaacaaaagtagaaatcaaacgcaccgtcgctgccccctccgtctccatcttcccaccctccgacgaacaactcaaatccggcaccgcctccgtcgtctgcctcctcaacaacttctacccccgcgaagccaaagtccaatggaaagtcgacaacgcactccaatccggcaactcccaagaatccgtcaccgaacaagactccaaagactccacctactcactcagctccaccctcaccctctccaaagccgactacgaaaaacacaaagtgtacgcatgcgaagtcacccaccaaggactctcctcccccgtcaccaaatcattcaacagaggcgaatgc

SEQ ID NO: 58623 - RNA, 648 nt, synthetic construct
  misc_feature 1..648: note = derived and/or modified sequence opt11 from anti-influenza_Chain
  source 1..648: mol_type = other RNA
gaaatcgtcatgacccaatcccccgccaccctatcagtcagccccggagaacgcgccaccctatcatgccgcgcctcacaagtcatctcccacaacctcgcctggtaccaacaaaaacccggccaagcaccccgcctcctcatctacggcgcctccacacgcgcctccggtatccccgcccgattctcaggctccggctcaggaaccgactacaccctcaccatcacctccctccaatccgaagacttcgccgtttactactgccaacactactccaactggccaccccgcctcacattcggcggcggaaccaaagtcgaaatcaaacgcaccgtcgccgccccctccgtcttcatattcccaccctccgacgaacaactcaaatccggcacagcctcagtcgtatgcctactcaacaacttctacccccgcgaagccaaagtccaatggaaagtagacaacgcccttcaatcaggaaactcacaagaatccgtaacagaacaagactccaaagactcaacatacagcctctcctccaccctcaccctctccaaagccgactacgaaaaacacaaagtctacgcctgcgaagtcacccaccaaggcctatcatcccccgtcaccaaatccttcaaccgcggcgaatgc

SEQ ID NO: 58624 - RNA, 648 nt, synthetic construct
  misc_feature 1..648: note = derived and/or modified sequence opt11 from anti-influenza_Chain
  source 1..648: mol_type = other RNA
gaaatcgtcctcacccaatcccccgccaccctctcagtctcccccggcgagcgcgccaccctatcctgccgagccagccaagtcatctcacacaacctcgcctggtaccaacaaaaacccggacaagcccccagactcctcatctacggcgcctccacccgcgcctccggcatccccgcccgtttctccggctcaggctcaggcaccgactacaccctcaccatcacctccctccaatccgaagacttcgccgtctactactgccaacactactccaacttcccaccccgactaacattcggcggcggcaccaaagtcgaaatcaaacgcaccgtcgcagccccatccgtattcatcttcccaccctccgacgaacaactcaaatcaggaacagcctccgtagtatgcctcctaaacaacttctacccccgcgaagccaaagtccaatggaaagtcgacaacgccctccaaagcggcaactcccaagaatccgtcaccgaacaagactccaaagactcaacctactccctctcctccaccctaaccctctcaaaagccgactacgaaaaacacaaagtatacgcctgcgaagtcacccaccaaggcctctcctcccccgtcaccaaatccttcaaccgcggcgaatgc

SEQ ID NO: 58625 - RNA, 648 nt, synthetic construct
  misc_feature 1..648: note = derived and/or modified sequence opt11 from anti-influenza_Chain
  source 1..648: mol_type = other RNA
gaaatcgtccttacacaatcacccgccaccctctccgtctcccccggagaacgagccaccctatcctgccgcgcctcccaagttatctcccacaacctagcctggtaccaacaaaaacccggccaagcaccccgtctcctcatctacggcgcctccacacgcgcctccggcatccccgcccgcttctccggctcaggctcaggcacagactacaccctgaccatcacctcactccaatccgaagacttcgccgtctactactgccaacactactccaactacccaccccgcctcaccttcggcggcggcaccaaagtcgaaatcaaacgcaccgtcgccgccccctccgtcttcatcttccctccctccgacgaacaactaaaatccggcacagcctccgtcgtctgcctccttaacaacttctacccccgcgaagccaaagtccaatggaaagtcgacaacgccctccaatccggcaactcccaagaatccgtcaccgaacaagactccaaagattccacatactccctctcctctacactaaccctctccaaagccgactacgaaaaacacaaagtctacgcctgcgaagtcacccaccaaggcctctcctcccccgtcaccaaatcatttaaccgcggcgaatgc

SEQ ID NO: 58626 - RNA, 648 nt, synthetic construct
  misc_feature 1..648: note = derived and/or modified sequence opt11 from anti-influenza_Chain
  source 1..648: mol_type = other RNA
gaaatcgtcctcacccaatcccccgcaaccctctccgtcagcccaggagaacgcgtcaccctctcctgccgagcctcccaaagcgtcgccaacaacctcgcctggtaccagcaaaagcccggacaatccccccgactcctcatctacggcgccagcacacgcgacaccggcatacccgccagattctccggctccggctccggcaccgaattcaccctcaccataagctcactccaatccgaagacttcgccgtctactactgccaacaatacaacaactggccccccatgtacacattcggccaaggaaccaaactcgaaatcaaacgcaccgtcgcagcaccatccgtcttcatcttccccccctccgacgaacaactcaaatccggcaccgcctcagtcgtctgcctactcaacaacttctacccccgcgaagccaaagtccaatggaaagtcgacaacgccctccaaagcggcaactcacaagaaagcgtcaccgaacaagactccaaagactcaacctactccctcagctcaaccctcaccctctccaaagccgactacgaaaaacacaaagtatacgcctgcgaagtcacacaccaaggcctctcatccccagtcaccaaaagcttcaaccgcggcgaatgc

SEQ ID NO: 58627 - RNA, 648 nt, synthetic construct
  misc_feature 1..648: note = derived and/or modified sequence opt11 from anti-influenza_Chain
  source 1..648: mol_type = other RNA
gacatcgtcatgacccaatcaccctccaccctcagcgccagcgtaggcgaccgcgtcaccataacctgccgcgcatcccaaagcatcggcaactggctcgcctggtaccaacaaaaacccggcaaagcccccaaactcctcatctacaaagtctcaaccctcgaaagcggcgtcccctcccgcttctcaggctcaggctcaggcaccgaattcaccctcacaataaactcactccaaccagacgacttcgccacctactactgccaacgctacacctccaactcccaaggattcaccttcggacaaggcaccaaactcgaaatcaaacgcaccgtcgcagccccctctgttttcatcttccccccctccgacgaacaactaaaatccggcacagcatccgtcgtatgcctactcaacaacttctacccccgcgaagccaaagtccagtggaaagtcgacaacgccctccaatccggcaactcacaagaatccgtaaccgaacaagacagcaaagactccacctacagcctctcctccaccctaaccctatcaaaagccgactacgaaaaacacaaagtctacgcctgcgaagtcacccaccaaggcctatcctcacccgtcaccaaatccttcaaccgaggcgaatgc

SEQ ID NO: 58628 - RNA, 648 nt, synthetic construct
  misc_feature 1..648: note = derived and/or modified sequence opt11 from anti-influenza_Chain
  source 1..648: mol_type = other RNA
gacatccaactcacccaatcacccctctctccccccgtcaccctcggccaacccgcctccatctcatgccgctcctcacaatccctcctctacaccgacggcttcacctacctctcatggtaccaccaacgtcccggccaatccccccgccgacttatctacaaaatatccaaccgcgactccggcgtacccgaccgcttctcaggctccggctcaggcaccgacttcaccctcaaaatctcccgcgtcgaagccgaagacgtcggcgtctactactgcatgcaagccacccactggcccctcaccttcggcgaaggcaccaaagtcgaaatcaaacccaaagccgcgccatccgtcaccctattccccccatcctccgaagaactccaagccaacaaagccaccctcgtctgcctcatctccgacttctaccccggcgccgtcaccgtcgcctggaaagccgactcctcccccgtcaaagccggcgtcgaaaccaccaccccatccaaacaatccaacaacaaatacgccgcctcctcctacctatccctcacccccgaacaatggaaatcacacaaatcctactcctgccaagtcacccacgaaggctccaccgtcgaaaaaaccgtcgcccccacagaatgctcc

SEQ ID NO: 58629 - RNA, 648 nt, synthetic construct
  misc_feature 1..648: note = derived and/or modified sequence opt11 from anti-influenza_Chain
  source 1..648: mol_type = other RNA
gaaatagtcctcacacaatcacccggaaccctgtccctaagcccgggagaacgcgcaaccttaagctgccgcgcaagccaaagcgtacgctcaaacaacctcgcctggtaccaacataaaccaggccaagccccgcgcctactcatattcggagcctcaagcagggccaccggcatacccgaccgattcagcggaagcggaagcggaaccgatttcacactcacaatctcgcgcctagaaccagaagacttcgcagtatactactgccaacaatacggaagctctcccgcactcacgttcggaggcgggaccaaagtcgaaatcaaacgaacagtcgcggcaccaagcgtattcatattcccaccatcagacgaacaactaaaatcaggcacggcctcggtcgtatgcctactcaacaacttctacccgcgcgaagccaaagtccaatggaaagtcgacaacgcactccaaagcggaaactcacaagaaagcgtaaccgaacaagacagcaaggactcaacctacagcctaagctcaaccctaaccctgagcaaagccgactacgaaaaacacaaagtatacgcatgcgaagtcacacaccaaggcctgagctcccccgtgaccaagagcttcaacagaggcgaatgc

SEQ ID NO: 58630 - RNA, 648 nt, synthetic construct
  misc_feature 1..648: note = derived and/or modified sequence opt11 from anti-influenza_Chain
  source 1..648: mol_type = other RNA
caatcagtcctcacacaacctccctccgcctcaggctcccgcggacaatcgatcaccatctcctgcaccggctccacctccgacatcggatcctacaactacgtctcctggtaccaacaacaccccggcaccgcccccaaagtcatcctatacgaagtctcccaacgcccctccggcgtccccgaccgcttctccggctccaaatcaggcaacaccgccttcctcaccgtctccggcctccaaaccgacgacgaagccgactactactgcgcctcctacgccggcaacaacatctacgtcttcggatcaggcaccaaagtaaccgtcctcggtcaacccaaagccaaccccaccgtaaccctcttccccccctcctccgaagaactacaagcaaacaaagccaccctcgtctgcctcatctccgacttctaccccggcgccgtcacagtcgcctggaaagccgactcctcccccgtcaaagccggcgtcgaaaccaccaccccctccaaacaatccaacaacaaatacgccgcctcttcatacctctccctcacccccgaacaatggaaatcacacaaatcatactcctgccaagtcacccacgaaggctccaccgtagaaaaaacagtcgcacccaccgaatgctcc

SEQ ID NO: 58631 - RNA, 651 nt, synthetic construct
  misc_feature 1..651: note = derived and/or modified sequence opt11 from anti-influenza_Chain
  source 1..651: mol_type = other RNA
caacccgtcctcacccaaccaccctccgcctccggatcccccggccaacgcgtcaccatctcctgctccggatcctcttccaacataggctcctacaccgtcaactggtaccaacaactccccggcaccgcacccaaactcctcatctactccctaaaccaacgcccctcaggagtacccgacagattctcaggctccaaatccggcacctccgcctccctcgcaatatctggcctccaatccgaagacgaagccgtctactactgcgcagcctgggacgactcactctccgcccacgtcgtcttcggcggcggcacaaaactcaccgtcctaggacaacccaaagccgcccccagcgtcaccctcttcccaccctcctccgaagaactccaagccaacaaagccaccctcgtctgcctaatctccgacttctaccccggcgccgtcaccgtcgcctggaaagccgactcatcacccgtcaaagccggcgtagaaaccaccaccccctcaaaacaatccaacaacaaatacgccgcctcctcatacctctcactaacacccgaacaatggaaatcacaccgctcttactcctgccaagtcacccacgaaggctccaccgtcgagaaaaccgtcgcacccaccgaatgctcc

SEQ ID NO: 58632 - RNA, 651 nt, synthetic construct
  misc_feature 1..651: note = derived and/or modified sequence opt11 from anti-influenza_Chain
  source 1..651: mol_type = other RNA
caacccgtccttacccaacccccctccgcctccggaacccccggacaacgcgtcacaatctcctgctccggatcctcctccaacatcggctccaacaccgtctcctggtaccaacaagtccccggcaccgcccccaaactcctaatctacggcaacaacgaacgcccatccggcgtcccagaccgcttctccggctccaaatccgccacctccgcctccctagccatctcaggcctccaatccgaagacgaagccgattactactgcgcagcctgggacgactccctcaacggcttttgggtcttcggcggcggcaccaaactcaccgtcctcggccaacccaaagccgccccctccgtcaccctcttccccccctcctcagaagaacttcaagcaaacaaagccaccctagtctgccttatctccgacttctacccaggcgccgtcaccgtcgcctggaaagccgactcctcaccagtcaaagccggcgtcgaaaccaccaccccctccaaacaatcaaacaacaaatacgccgcctcctcatacctctccctcacccccgaacaatggaaatcccacaaatcctactcatgccaagtcacccacgaaggatccaccgtcgaaaaaaccgtcgcccccacagaatgctct

SEQ ID NO: 58633 - RNA, 651 nt, synthetic construct
  misc_feature 1..651: note = derived and/or modified sequence opt11 from anti-influenza_Chain
  source 1..651: mol_type = other RNA
tcctacgtcctcacccaacccccctccgtctccggaacccccggccaacgcgttatcatctcctgctccggctactcctccaacataggctccaacaccgtcaactggtaccaacaattccccggcaccgccccccgcctactaatctacgccaacaaccaacgccccccaggcgtccccgaccgcttctccggctccaaatccggcacctcagcctcactcgccatttccggcctacaatccgacgacgaatccgactactactgcgccgcctgggacgactccctcaacggccactgggtcttcggcggcggcacaaaactcaccgtcctcggccaacccaaagccgccccctcagtcaccctcttccccccctcctccgaagaactccaagccaacaaagccaccctcgtttgcctcatctccgatttctaccccggcgcagtaaccgtcgcctggaaagccgactcctcccccgtcaaagccggcgtcgaaaccaccaccccctccaaacaatccaacaacaaatacgccgcatcatcttacctatccctcacacccgaacaatggaaatcccaccgctcctactcctgtcaagttacccacgaaggctccaccgtcgaaaaaaccgtcgcccccaccgaatgctcc

SEQ ID NO: 58634 - RNA, 654 nt, synthetic construct
  misc_feature 1..654: note = derived and/or modified sequence opt11 from anti-influenza_Chain
  source 1..654: mol_type = other RNA
tcctacgtcctcacccaacccccctccgtctccgtcgcccccggacaaaccgcccgaatcacctgcggaggcaacaacatcggatccaaatcagtccactggtaccaacaaaaaccaggccaagcccccgtcctcgtcgtctacgacgactccgaccgaccctccggcatccccgaacgcttctccgggagcaactccggcaacacagccaccctcaccatctcccgcgtcgaagccggcgacgaagcagactactactgccaagtctgggacagctcctccgaccacgccgtcttcggcggcggcacccaactcaccgtccttggagccgccgccggccaacccaaagccgccccctccgtaaccctcttccccccatcctccgaagaactccaagcaaacaaagccaccctcgtctgcctcatctcagacttctatcccggcgccgtaaccgtcgcctggaaagccgactcctcacccgtaaaagccggcgtcgaaactaccaccccctccaaacaaagcaacaacaaatacgccgcctcaagctacctatccctcacccccgaacaatggaaatcccaccgatcctactcctgccaagtcacacacgaaggctcaaccgtcgaaaaaaccgtcgcacccaccgaatgctcc

SEQ ID NO: 58635 - RNA, 654 nt, synthetic construct
  misc_feature 1..654: note = derived and/or modified sequence opt11 from anti-influenza_Chain
  source 1..654: mol_type = other RNA
caatccgtagtaacccaacccccctccgtctccgtcgcccccggccaaaccgcacgcatcacctgcggcggcaacaacatcggctccaaatccgtccactggtaccaacaaaaacccggccaagcccccgtcctagtcgtctacgacgactccgaccgaccatccggcatacccgaacgattctccggatccaattccggcaacacagccaccctcacaatctcacgcgtcgaagcaggtgacgaagccgactactactgccaagtctgggactcctcctccgaccactacgtcttcggaaccggcaccaaagtcaccgtactaggcgccgccgcaggccaacccaaagccgccccctcagtcaccctcttccccccatcctccgaagaactccaagcaaacaaagcaaccctcgtctgcctcatctccgacttctaccccggcgccgtcacagtcgcctggaaagccgactcctcacccgtcaaagcaggagtcgaaacaaccaccccctcaaaacaatccaacaacaaatacgccgcctcctcatacctctcactcacccccgaacaatggaaatcccaccgctcctactcctgccaagtcacccacgaaggctccaccgtcgaaaaaaccgtcgcccccaccgaatgctcc

SEQ ID NO: 58636 - RNA, 654 nt, synthetic construct
  misc_feature 1..654: note = derived and/or modified sequence opt11 from anti-influenza_Chain
  source 1..654: mol_type = other RNA
ctctcacgcataaaccacttcgaaaaaatccaaatcatccccaaatcctcctggtccgaccacgaagcctcatccggagtctcctccgcctgcccctaccaaggcaccccatccttcttccgcaacgtcgtctggctcatcaaaaaaaacaacacctaccccaccatcaaacgctcctacaacaacaccaatcaagaagacctcctaatcctctggggcatccaccactccaacgacgccgccgaacaaaccaaactctaccaaaaccccaccacttacatctccgtcggcacctccacacttaaccaacgcctcgtccccaaaatcgccacccgatccaaagtcaacggccaaaacggccgcatggacttcttctggaccatcctcaaacccaacgacgccatcaacttcgaatccaacggcaacttcatcgcccccgaatacgcctacaaaatcgttaagaaaggcgactccgcaatcgtcaaatctgaagtcgaatacggcaactgcaacaccaaatgccaaacacccatcggcgccatcaactcatccatgcccttccacaacatccacccccttaccatcggagaatgccccaaatacgtcaaatccaacaaactcgtcctcgccacaggcctccgaaactcccccctc

SEQ ID NO: 58637 - RNA, 657 nt, synthetic construct
  misc_feature 1..657: note = derived and/or modified sequence opt11 from anti-influenza_Chain
  source 1..657: mol_type = other RNA
tcctccgaactcacccaaccccccagcgcatccggcacccccggccaacgcgtcaccatatcctgctccggatccacctccaacatcggatacaaccccgtctcctggtaccaacaagtccccggcaccgcccccaaactcctcatctactccaacaccgaacgcccctccggagtccccgaccgcttctccggctccaaatccggcacatccgcctccctcgccatctccggcctccaatccgaagacgaagccgactactactgcgccgcctgggacgacaccctcaacggccccgtcttcggaggcggcaccaaagtcaccgtcctaggccaacgcaccgtcgccgccccctccgtcttcatcttccccccctcagacgaacaactcaaatccggcaccgcctccgtcgtctgcctcctcaataacttctacccacgcgaagccaaagtccaatggaaagtcgacaacgcactccaatccggcaactcccaagaatcagtcaccgaacaagactccaaagactcaacctattccctctcctcaaccctcaccctctccaaagccgactacgaaaaacacaaagtctacgcctgcgaagtcacccaccaaggcctctcctcacccgtcaccaaatccttcaaccgaggcgaatgc

SEQ ID NO: 58638 - RNA, 657 nt, synthetic construct
  misc_feature 1..657: note = derived and/or modified sequence opt11 from anti-influenza_Chain
  source 1..657: mol_type = other RNA
gacatcgtcatgacccaatcccccctctcactccccgtcacccccggcgaacccgcatccatctcctgccgatcatcccaatcactcctacgatccaacggatacaactacctcgactggtacctccaaaaacccggccaatcaccccaactcctcatctacctcggctccaaccgcgcctccggagtccccgaccgcttctccggctccggctccggcaccgacttcacactcaaaatctcccgagtcgaagccgaagacgtcggcgtatactactgcatgcaagccctccaaaccccctacaccttcggacaaggaaccaaactcgaaatcaaacgcaccgtcgccgccccctccgtattcatattccccccctccgacgaacaactaaaatccggcaccgcctccgtcgtctgcctcctcaacaacttctacccccgcgaagccaaagtccaatggaaagtcgacaacgccctccaatcaggcaactcccaagaatccgtcaccgaacaagactccaaagactccacctactccctctcctcaaccctcaccctgtccaaagccgactacgaaaaacacaaagtatacgcttgcgaagtcacccaccaaggcctatcctcccccgtcaccaaatcattcaaccgcggcgaatgc

SEQ ID NO: 58639 - RNA, 660 nt, synthetic construct
  misc_feature 1..660: note = derived and/or modified sequence opt11 from anti-influenza_Chain
  source 1..660: mol_type = other RNA
tcctacgtcctcacccaacccccctcagcctccggcacccccggccaacgtgtcaccatctcctgctccggttccaccttcaacatcggttccaacgccgtcgactggtaccgacaactccccggcaccgcccccaaactcctaatctactccaacaaccaacgcccctccggcgtccccgaccgcttctccggctcccgctctggcacatccgcctccctcgccatctccggcctccaatcagaagacgaagccgactactactgcgccgcctgggacgacatcctcaacgtccccgtcttcggcggcggaaccaaactcaccgtcctcggcgccgccgccggccaaccaaaagccgccccctccgtcaccctattccccccctcctcagaagaactccaagccaacaaagccaccctcgtctgcctaatctccgacttctaccccggcgccgtcaccgtcgcctggaaagccgactcctcccccgtcaaagcaggcgtcgaaaccaccaccccctccaaacaatcaaacaacaaatacgccgcctcctcctacctctcactcacccccgaacaatggaaatcccaccgctcatactcctgccaagtcacccacgaaggctccaccgtcgaaaaaacagtcgccccaacagaatgctca

SEQ ID NO: 58640 - RNA, 660 nt, synthetic construct
  misc_feature 1..660: note = derived and/or modified sequence opt11 from anti-influenza_Chain
  source 1..660: mol_type = other RNA
caatccgcactcacccaaccagccgccgtctcaggctcacccggccaatccatcaccatctcctgcaccggcaccagctcagacgtcggcggctacaactacgtctcctggtaccaacaacacccaggcaaagcccccaaactcatgatctacgaagtctccaaccgcccatcaggcgtctccaaccgcttctccggctccaaatcaggcaacaccgcctcactaaccatcagcggcctccaagccgaagacgaagccgactactactgctcctcatacacctcctcttccacctacgtcttcggcactggcacaaaagtcaccgtactcggcgccgccgccggccaacccaaagccgccccctccgtcaccctcttccccccctcctccgaagaactccaagccaacaaagcaaccctcgtatgcctcatctccgacttctaccccggcgccgtcacagtcgcctggaaagccgactcctcccccgtcaaagcaggcgtcgaaacaaccaccccatcaaaacaatccaacaacaaatacgcagcctcctcatacctctcactcacccccgaacaatggaaatcacaccgctcctactcatgccaagtcacccacgaaggatcaactgtcgaaaaaaccgtcgcccccaccgaatgctcc

SEQ ID NO: 58641 - RNA, 660 nt, synthetic construct
  misc_feature 1..660: note = derived and/or modified sequence opt11 from anti-influenza_Chain
  source 1..660: mol_type = other RNA
tcctacgtcctcacccaacccccctccgtctcaggcacccccggacaacgcgtcaccatctcctgctcaggatcccgctccaacgtcggagacaactccgtctactggtaccaacacgtcccagaaatggcacccaaactactagtatacaaaaacacccaacgcccctccggcgtccccgcacgtttctccggctccaaatccggtacctcagcctcactcgccatcatcggcctccaatccggcgacgaagctgactactactgcgtcgcctgggacgactcagtcgacggatacgtcttcggctctggcaccaaagtcaccgtcctcggagccgccgccggccaacccaaagccgccccctcagtcaccctcttccccccctcctcagaagaactccaagccaacaaagcaacactcgtctgcctcatctccgacttctaccccggagccgtcaccgtcgcctggaaagcagactcctcccccgtcaaagccggagtagaaaccaccaccccctccaaacaatccaacaacaaatacgccgcctcatcatacctctccctcacccccgaacaatggaaatcacatcgctcctactcctgccaagtcacccacgaaggctctaccgtcgaaaaaaccgtcgcccccaccgaatgctcc

SEQ ID NO: 58642 - RNA, 660 nt, synthetic construct
  misc_feature 1..660: note = derived and/or modified sequence opt11 from anti-influenza_Chain
  source 1..660: mol_type = other RNA
tcctacgtcctcacccaacccccctccgcctccggcacccccggccaacgcgtcaccatatcctgctccggctcatcctcaaacatcggctccaactacgtctactggtaccaacaactacccggaaccgcccccaaactcctcatctaccgagacggccaacgcccctccggcgtccccgaccgattctcaggctccaagtccggcacctccgcctccctcgccatctccggactccgctccgacgacgaagccgactactactgcgccacctgggacgacaacctctccggccccgtcttcggcggcggaaccaaacttaccgtcctcggcgccgcagccggccaacccaaagccgccccctccgtaaccctattccccccatcctccgaagaactccaagccaacaaagccacactagtatgcctcatctccgacttctaccccggcgccgtcaccgtcgcctggaaagcagattcctcccccgtcaaagcaggagtcgaaaccaccaccccctcaaaacaatccaacaacaaatacgccgcctcctcctacctctccctaacccccgaacaatggaaatcccaccgctcttactcctgccaagtcactcacgaaggctccaccgtcgaaaaaaccgtagcccccaccgaatgctca

SEQ ID NO: 58643 - RNA, 660 nt, synthetic construct
  misc_feature 1..660: note = derived and/or modified sequence opt11 from anti-influenza_Chain
  source 1..660: mol_type = other RNA
caatcagccctcacacaacccgcctccgtatccggctcccccggccaatccatcaccatctcctgcaccggcacctcttcagacgtaggcggctacaactacgtctcctggtaccaacaacaccccggcaaagcccccaaactcatgatctacgaagtaagcaaccgcccctccggagtctctaaccgattctcaggctccaaatctggcaacaccgcctccctcaccatctccggcctccaagccgaagacgaagccgactactactgctcctcctacacctcctcctccaccctcgtattcggcacaggcaccaaagtaacagtcctcggcgcagcagccggacaacccaaagccgccccctccgtaaccctcttccccccctcctccgaagaactacaagccaacaaagccaccctcgtctgcctcatctccgacttctaccccggcgccgtaaccgtcgcctggaaagccgacagctccccagtcaaagccggcgtcgaaacaactaccccctccaaacaatccaacaataaatacgctgcctcctcctacctctccctcaccccagaacaatggaaatctcaccgctcatactcctgccaagtcacccacgaaggctccaccgtcgaaaaaaccgtcgcccccaccgaatgctcc

SEQ ID NO: 58644 - RNA, 660 nt, synthetic construct
  misc_feature 1..660: note = derived and/or modified sequence opt11 from anti-influenza_Chain
  source 1..660: mol_type = other RNA
accgtcctcacccaacccccctccgtatccggcgcccccggccaacgcgtcaccatctcctgcaccggctcctcctccaacatcggcgccggctacgacgtacactggtatcaacaactccccggcaccgcccccaaactcctaatctacggcaactccaaccgcccctccggagtccccgacagattctccggctccaaatccggaacatccgccaccctaggaatcacaggcctccaaaccggcgacgaagccgactactactgcggcacatgggactcctccctctccgcatacgtcttcggaaccggaaccaaagtcaccgtcctaggcgccgcagccggccaacccaaagccgcaccctccgtcacactcttccccccctcctccgaagaactccaagccaacaaagccactctcgtctgcctaatctccgacttctaccccggcgccgtcaccgtcgcctggaaagccgactcctcacccgtcaaagccggcgtcgaaaccaccaccccctccaaacaatcaaacaacaaatacgccgcctcctcctacctatccctcacccccgaacaatggaaatcccaccgctcctactcctgccaagtcacccacgaaggctcaaccgtcgaaaaaacagtcgcccccaccgaatgttcc

SEQ ID NO: 58645 - RNA, 663 nt, synthetic construct
  misc_feature 1..663: note = derived and/or modified sequence opt11 from anti-influenza_Chain
  source 1..663: mol_type = other RNA
caatcagtcctcacccaaccaccctccgtctcagccgcccccggccaaaaagtcaccatctcctgctccggctcctcctccaacatcggcaacgactacgtctcatggtaccaacaactccctggcaccgcccccaaactactcatctacgacaacaacaaacgcccctccggaatcccagaccgattctccggctcaaaatccggcacctccgcaaccctaggcatcacaggactccaaaccggcgacgaagccaactactactgcgccacctgggacagacgccccaccgcctacgtcgtcttcggcggcggcaccaaactcaccgtcctcggagccgcagccggccaacccaaagcagccccctcagtcacactcttccccccctcctccgaagaactccaagccaacaaagccaccctcgtatgcctcatctccgacttctaccccggcgccgtcaccgtcgcctggaaagccgactcctcccccgtcaaagcaggcgtcgaaaccaccaccccctcaaaacaatccaacaacaaatacgcagcctcctcctacctctcactcacccccgaacaatggaaatcacaccgctcctactcctgccaagtaacccacgaaggatccaccgttgaaaaaaccgtcgcaccaaccgaatgctcc

SEQ ID NO: 58646 - RNA, 675 nt, synthetic construct
  misc_feature 1..675: note = derived and/or modified sequence opt11 from anti-influenza_Chain
  source 1..675: mol_type = other RNA
atggtcgggttcacaccagtggccctggccgcgctagcggcaacgggcgcgctagcattcccggccggaaacgcgacagagctagagaaaagacaaacgaccccgaactcagaagggtggcacgacgggtactactactcgtggtggagcgacggcggggcccaggccacgtacacgaacctagaagggggcacatacgagatctcgtggggagacgggggcaacctcgtaggcggaaaagggtggaaccccggactcaacgccagagcaatacacttcgaaggggtctaccaaccgaacgggaactcgtacctggcagtgtacgggtggacacgaaaccccctggtcgagtactacatcgtagaaaacttcgggacctacgacccgagctcgggagcgaccgacctcgggaccgtggaatgcgacgggagcatatacagactaggaaaaacaacaagggtaaacgccccgagcatagacgggacccagacctttgaccagtactggagcgtgcgacaggacaagagaacgagcgggaccgtgcaaacgggatgccacttcgacgcgtgggcacgagcgggactgaacgtaaacggggaccactactaccaaatagtcgcgaccgagggctacttctcgagcggatacgcgcgcataaccgtggcagacgtaggg

SEQ ID NO: 58647 - RNA, 687 nt, synthetic construct
  misc_feature 1..687: note = derived and/or modified sequence opt11 from anti-influenza_Chain
  source 1..687: mol_type = other RNA
cgctccgacaaaacacacacttgcccaccatgccccgccccagaactccttggtggcccatccgtcttcctcttcccccccaaacccaaagacaccctcatgatctcacgaacccccgaagtcacctgcgtcgtagtcgacgtctcccacgaagaccccgaagtcaaattcaactggtacgtcgacggcgtcgaagtccacaacgccaaaaccaaaccacgcgaagaacaatacaactcaacctaccgcgtcgtctccgtcctcaccgtcctccaccaagactggctcaacggcaaagaatacaaatgcaaagtctcaaacaaagccctccccgcccccatcgaaaaaaccatatccaaagccaaaggccaacccagagaaccccaagtctacaccctccccccctcccgcgaagaaatgaccaaaaaccaagtctccctcacctgcctcgtcaaaggcttctacccctccgacatagcagttgaatgggaaagcaacggccaaccagaaaacaactacaaaaccaccccccccgtcctcgactctgacggctccttcttcctctactccaaactcaccgtcgacaaatcccgctggcaacaaggcaacgtcttctcatgctcagtcatgcacgaagccctacacaaccactacacccaaaaatccctctcactatcccccggcaaa

SEQ ID NO: 58648 - RNA, 696 nt, synthetic construct
  misc_feature 1..696: note = derived and/or modified sequence opt11 from anti-influenza_Chain
  source 1..696: mol_type = other RNA
cacgcacaagacatcctcgaaaaaacccacaacggcaaactctgcgacctcgacggcgtaaaacccctaatcctacgcgactgctccgtcgccggctggctcctcggaaaccccatgtgcgacgaattcatcaacgtccccgaatggtcctacatcgtcgaaaaagccaaccccgccaacgacctctgctaccccggcaacttcaacgactacgaagaactcaaacacctactctcccgcatcaaccacttcgaaaaaatccaaatcatccccaaatcctcatggtccgaccacgaagcctcctcaggcgtctcctccgcctgcccctaccaaggcaccccctccttcttccgcaacgtcgtctggctcataaaaaaaaacaacacctaccccacaatcaaacgctcctacaacaacaccaaccaagaagacctcctaatactatggggcatccaccactccaacgacgcagccgaacaaaccaaactctaccaaaaccccaccacctacatatccgtcggcacatccacactaaaccaacgactcgtacccaaaatcgccacccgctcaaaagtcaacggccaaaacggccgcatggacttcttctggaccatcctcaaacccaacgacgccatcaacttcgaatccaacggaaacttcatcgcccccgaatacgcctacaaaatcgtaaaaaaa

SEQ ID NO: 58649 - RNA, 699 nt, synthetic construct
  misc_feature 1..699: note = derived and/or modified sequence opt11 from anti-influenza_Chain
  source 1..699: mol_type = other RNA
atgcgaccctccatccaattcctcggcctcctcctcttctggctacacggcggccaatgcgacatccaaatgacccaaagcccctcctccctctccgcctcactcggcggcaacgtcaccataacctgcaaagcctcccaagacatcaacaaatacatcgcatggtaccaacacaaacccggcaaaggcccccgactcgtcatccactacacatccaccctccaacccggcatcccatcccgcttctccggctccggctccggcaccgattactcattctccatctccaacctcgaacccgaagacatcgccacctactactgcctccaatacgacatcctctacacattcggcggcggcaccaaactagaaatcaaacgagcagacgcagcccccaccgtctcaatcttcccaccctcatccgaacaactcacatcaggaggcgcctccgtcgtctgcttcctcaacaacttctaccccaaagacatcaacgtcaaatggaaaatcgacggctccgaacgccaaaacggcgtactcaactcctggaccgaccaagactccaaagactccacctactcaatgtcatcaaccctcaccctcaccaaagacgaatacgaacgccacaactcctacacatgcgaagcaacccacaaaaccagcacctcccccatcgtcaaatccttcaaccgcaacgaatgc

SEQ ID NO: 58650 - RNA, 702 nt, synthetic construct
  misc_feature 1..702: note = derived and/or modified sequence opt11 from anti-influenza_Chain
  source 1..702: mol_type = other RNA
atgatgtcctccgcacaattcctaggcctcctactcctctgcttccaaggcacccgctgcgacatccaaatgacccaaacctcatcatccctatccgcctccctgggcgaccgcgtcaccatctcctgccgtgcctctcaagacatccgcaactacctcaactggtatcaacaaaaacccgacggcaccgtcaaactcctaatctactacacctcacgcctccactcaggcgtccccagccgcttctcagactcaggctccggcaccgactactcccttaccatctcaaacctcgaacaagaagacctcgccacctacttctgccaacaaacctacaccctcccctggaccttcggcggcggcaccaaactcgaaatcaaacgcgccgacgccgcccccaccgtctccatcttccctccctcctccgaacaactcacctccggcggcgcctcagtcgtctgcttcctcaacaacttctaccccaaagacataaacgtcaaatggaaaatcgacggctccgaacgccaaaacggcgtcctaaactcatggaccgaccaagactccaaagactccacatactccatgtcctccaccctcaccctcaccaaagacgaatacgaacgccacaactcatacacatgcgaagcaacacacaaaacctcaacctcccccatcgtcaaatccttcaaccgaaacgaatgc

SEQ ID NO: 58651 - RNA, 702 nt, synthetic construct
  misc_feature 1..702: note = derived and/or modified sequence opt11 from anti-influenza_Chain
  source 1..702: mol_type = other RNA
atggaagcccccgcccaactactttttctcctactcctatggctacccgacaccacaggcgaaatcgtactcacacaatcacccgccaccctgtccctaagcccaggcgaacgcgccaccctatcctgccgcgcatccgaaaacatctggaataacctagcctggtaccaacaaaaacccgggcaagcaccccgcctcctcatctcaggcgccagcaccggagcgaccggagtcccatccagattccgcggctcaggctcccgcacagagttcaccctcaccatcagctccctccaatccgaagacttcgccatatacttctgccaacaatacaactcctggccacgcaccttcggccccggaaccaaagtcgaaatcaaacgcaccgtcgcagcccccagcgtcttcatattcccaccctcggacgaacaactaaaatccggcacagcctcagtagtctgcctcctcaacaacttctacccacgcgaagccaaagtccaatggaaagtcgacaacgccctccagagcggaaactcacaagaaagcgtcaccgaacaagactccaaagactccacctactccctaagctcaaccctaaccctgagcaaagccgactacgaaaaacacaaagtctacgcatgcgaagtcacacaccagggcctaagctcacccgtaaccaaatccttcaaccgcggcgaatgc

SEQ ID NO: 58652 - RNA, 705 nt, synthetic construct
  misc_feature 1..705: note = derived and/or modified sequence opt11 from anti-influenza_Chain
  source 1..705: mol_type = other RNA
atggaaacccccgcccaactcctcttcctcctcctcctctggctccccgacaccaccggcgaaatcgtcctcacccaatcccccggcaccctctccctctcccccggcgaacgcgccaccctctcctgccgcgcctcccaatccctctcatcctcatccctcgtctggtaccaacaaaaacccggccaagcaccccgcctcctaatctacggcgcctcctctcgcgccaccggcatacccgaccgattctccggctccggatccggcaccgacttcaccctcacaatctcccgcctcgaacccgaagacttcgccgtctactactgccaacaatacggcaactccccctacaccttcggccaaggaacacaagtcgaaatcaaacgaaccgtcgccgccccctccgtcttcatattcccaccctccgacgaacaactcaaatcaggaacagcctccgtcgtctgcctcctcaacaacttctacccccgcgaagccaaagtccaatggaaagtcgacaacgccctccaatccggcaactctcaagagtccgtcaccgaacaagactccaaagactccacctactcactctcctccaccctaaccctctccaaagccgactacgaaaaacacaaagtctacgcctgcgaagtcacccaccaaggcctctcctcccccgtcaccaaatctttcaaccgcggagagtgc

SEQ ID NO: 58653 - RNA, 705 nt, synthetic construct
  misc_feature 1..705: note = derived and/or modified sequence opt11 from anti-influenza_Chain
  source 1..705: mol_type = other RNA
atggaaaccccagcccaacttcttttcctcctccttctatggctacccgacacaaccggcgaaaccgtcctcacccaatcccccggcaccctcagcctctcacccggcgaacgcgccaccctctcctgccgcgcctcccaatccgtctcaatatcctatctcgcctggtaccaacgcaaacccggccaagccccacgcctactaatctacggcgcctcccgccgcgctaccggaatccctgaccgcttctccggctcaggctccggcaccgacttcaccctcaccatctcccgcctcgaacccgaagacttcgccgtctactactgccaacaatacggatcctccccctacacattcggccaaggcacaaaactcgaaatcaaacgcaccgtcgccgccccctcagtcttcatcttcccaccctccgacgaacaactcaaatccggcaccgcctccgtcgtctgcctcctcaacaacttctacccccgcgaagcaaaagtccaatggaaagtcgacaacgcactccaatccggcaacagccaagaatcagtaactgaacaagactccaaagactcaacctactcactctcctcaaccctcaccctatccaaagccgactacgaaaaacacaaagtatacgcatgcgaagtcacccaccaaggcctctcctcacccgtcaccaaatccttcaaccgcggagaatgc

SEQ ID NO: 58654 - RNA, 705 nt, synthetic construct
  misc_feature 1..705: note = derived and/or modified sequence opt11 from anti-influenza_Chain
  source 1..705: mol_type = other RNA
atggcctggatgatgctcctcctcaccctcctaatacactgcaccggatcatgggcccaatccgtcctcacccaacccccctccgtctccgccgcacccggccaaaaagtcaccatctcctgctccggctcctcatccaacatcggcaaaaactacgtctcatggtaccaacaactcccaggcacagcccccaaactcctcatctacgacaacgacaaacgcccctcaggcatacccgaccgcttctcaggctccaaatccggaacatcagcaaccctcggaatcaccggcctacaaaccggcgacgaagccgactaccactgcggcgcctgggactcctccctcaacggcggtgtcttcggcggcggaaccaaagtcaccgtcctcggtcaacccaaagcagccccatcagtaaccctcttccccccatcctccgaagaactacaagccaacaaagccaccctcgtatgcctaatctccgacttctaccccggcgccgtaaccgtcgcctggaaagccgactcatcacccgtcaaagccggcgtagaaaccaccacaccctccaaacaatccaacaacaaatacgcagcatcctcatacctctcactaactcccgaacaatggaaatcccaccgctcctactcatgccaagtcacccacgaaggctcaaccgtcgaaaaaaccgtcgccccaaccgaatgctcc

SEQ ID NO: 58655 - RNA, 714 nt, synthetic construct
  misc_feature 1..714: note = derived and/or modified sequence opt11 from anti-influenza_Chain
  source 1..714: mol_type = other RNA
atgatgaaaaaaaaatcctggttcacactcatgataaccggcgtcatcagcctattcttctccgtctccgcattcgcaggcaacgtcttctgggaacccctcagctacttcaactcctccacctggcaaaaagccgacggctactccaacggccaaatgttcaactgcacatggagagccaacaacgtcaacttcacaaacgacggcaaactcaaactctcactcacctcccccgccaacaacaaattcgactgcggcgaataccgatccaccaacaactacggctacggcctctacgaagtcagcatgaaacccgccaaaaacaccggcatcgtatcctccttcttcacctacaccggcccctcccacggtacccaatgggacgaaatagacatcgaattcctcggcaaagacaccaccaaagtccaattcaactactacaccaacggcgtcggaggccacgaaaaaatcatcaacctcggcttcgacgcctccacctccttccacacctacgccttcgactggcaacccggatacatcaaatggtacgtcgacggtgtcctcaaacacaccgccaccacaaacatcccctccacccccggcaaaatcatgatgaacctctggaacggcaccggcgtcgactcctggctcggctcctacaacggcgccaaccccctctacgccgaatacgactgggtcaaatacacctcaaac

SEQ ID NO: 58656 - RNA, 729 nt, synthetic construct
  misc_feature 1..729: note = derived and/or modified sequence opt11 from anti-influenza_Chain
  source 1..729: mol_type = other RNA
caagtacaattggtccagagcggggcagaggtcaagaaaccgggcagcagcgtgaaagtaagctgcaaagcgagcggaggaacgttctcgagctacgccataagctgggtaagacaagcgccagggcagggacttgagtggatgggcgggatcatgggcatgttcgggacaacgaactacgcccagaaattccaaggaagagtgacaataacagcagacgagttcacgagcgcggcatacatggaactaagaagcctacgctcggaagatacagcagtctactactgcgcgaggagcagcggctactacccggaatacttccaggactggggccagggcacactcgtgaccgtgagctcgggcacgggcggaagcgggggcacgggctccggcacgggcggaagcacacaatcggtcctaacccagcccccaagcgagagcgtgagcccaggccagaccgcgagcgtaacctgtagcgggcacaaactaggggacaagtacgtgagctggtaccagcaaaagcccggacaatcacccgtgctactaatctaccaagacaaccggcgcccaagcgggatcccggaaagattcataggcagcaactcaggcaacaccgcgaccctaacaataagcgggacccaggccctggacgaggccgactactactgccaggcctgggactcgagcacagcagtattcgggggcgggaccaagctaacggtcctgggc

SEQ ID NO: 58657 - RNA, 729 nt, synthetic construct
  misc_feature 1..729: note = derived and/or modified sequence opt11 from anti-influenza_Chain
  source 1..729: mol_type = other RNA
caggtccagctagtacaatcaggcgcagaagtaaagaaacccggaagctcagtcaaagtatcatgcaaagcctcaggcgggcccttccgcaacttcgcaatcaactgggtgcgccaagcccccggccaaggactggaatggatgggaggcataatcgcagtcttcggcacaacaaaatacgcacacaaattccaaggccgagtcacgatcacagccgacgactcgacaaacaccgcatacatggaactaggctcactcaaaagcgaagacacggccgtatactactgcgcacgcggaccccactactacagctcatacatggacgtatggggagaagggaccaccgtcacagtctcaagcgggaccgggggctcaggaggaaccggaagcggaaccggcggctcaaccgacatccaactcacgcaatccccctcaagcctcagcgcaagcgtgggcgaccgcgtgaccataacctgccgcgcaagccagggcataagcacctacctagcctggtaccaacaaaaacccggaaaagtgcccaaactcctaatctacgccgcaagcacgctccaaagcggagtcccaagcagattctcaggctcaggctcaggaacagacttcaccctgaccataagctcactccaacccgaagacgtagcaacatactactgccagaaatacaactcagccccgagcttcggcccaggcacaaaagtggacataaaaagg

SEQ ID NO: 58658 - RNA, 729 nt, synthetic construct
  misc_feature 1..729: note = derived and/or modified sequence opt11 from anti-influenza_Chain
  source 1..729: mol_type = other RNA
atgtcctaccgcgtcaaacgcatgctcatgctcctcgtcaccggcctcttcctaagcctctcaaccttcgccgcctccgcctcagcccaaaccggcggatccttctacgaacccttcaacaactacaacaccggactctggcaaaaagcagacggctactcaaacggcaacatgttcaactgcacatggagagccaacaacgtctcaatgacctccctcggcgaaatgcgcctctccctcacctctccctcctacaacaaattcgactgcggcgaaaacagatccgtccagacctacggctacggcctctacgaagtcaacatgaaacccgcaaaaaacgtcggcatcgtctcctccttcttcacctacaccggccccaccgacggcaccccctgggacgaaatcgacatcgaattcctaggcaaagacaccaccaaagtccaattcaactactacaccaacggcgtcggcaaccacgaaaaaatcgtcaaccttggattcgacgcagcaaactcctaccacacatacgccttcgactggcaacccaactcaatcaaatggtacgtcgacggccaactcaaacacaccgccaccacccaaatcccccaaacacccggcaaaatcatgatgaacctctggaacggcgccggcgtcgacgaatggctcggctcctacaacggcgtcacccccctctctcgctccctccactgggtccgttacaccaaacgc

SEQ ID NO: 58659 - RNA, 735 nt, synthetic construct
  misc_feature 1..735: note = derived and/or modified sequence opt11 from anti-influenza_Chain
  source 1..735: mol_type = other RNA
caggtccagctacagcaatcgggcgcggaagtcaaaaagcccgggagctcagtaaaggtatcgtgcaaggtctcgggcgtgatatttagcgggagcgcgatctcgtgggtacgccaggccccgggccagggcctggaatggatgggcgggataagccccctcttcggcacgaccaactacgcgcaaaagttccagggcagggtaacgatcacggccgatcaatcgaccaacaccacatacatggaagtaaactcgctccggtacgaggacacagccgtgtacttctgcgcgcgcgggccgaagtactatagcgagtatatggacgtgtgggggaaaggcaccacagtcacggtatcgagcgggacagggggctcgggcggaacaggaagcggaacaggaggctccaccgacatacagatgacacaatcgccatcgagcctgagcgcaagcgtgggcgaccgcgtgaccataacctgccgcgcaagccagggcataagctcatacttggcctggtaccagcaaaaacccgggaaagtgcccacgctcctgatatacgacgcgagcacgctaaggagcggagtcccgagcaggttctcgggctcgggctcggccacggacttcaccctgaccataagttcactccagcccgaggacgtggccacatactactgccagagatataactcggccccgcccatcacatttggccagggcacgcgcctagaaataaaaaga

SEQ ID NO: 58660 - RNA, 735 nt, synthetic construct
  misc_feature 1..735: note = derived and/or modified sequence opt11 from anti-influenza_Chain
  source 1..735: mol_type = other RNA
gaagtccaactcgtcgaatccggcgccgaagtcaaaaaacccggctcatccgtcaaagtctcatgcaaagcctccggcggcaccttctcctcctacggcatcagctgggtacgccaagcacccggacaaggcctcgaatggatgggcgacatcatcggcatgttcggctcaaccaactacgcccaaaacttccaaggcagactcaccataaccgccgacgaatccacaagcaccgcctacatggaactctcgagcctccgctcagaagacacagcagtctactactgcgctcgctcctccggctactaccccgcatacctcccccactggggccaaggcacacttgtcaccgtctcctcaggcaccggcggaagcggcggcaccggctcaggaacaggcggctcaaccgaaatcgtcctcacacaatcccccggcaccctatccctatcacccggcgaaagagccacactctcatgccgagcaagccaatcggtctccagctcctacctcgcctggtaccaacaaaaacccggccaagcccccagactcctcatctacggagccagctcacgagccaccggcatccccgaccgcttctcaggctcaggctccggaaccgacttcaccctaacaatctcccgcctagaacccgaagacttcgccgtatactactgccaacaatacggctcctccccaagaaccttcggcggcggaaccaaagtcgaaatcaaacgc

SEQ ID NO: 58661 - RNA, 735 nt, synthetic construct
  misc_feature 1..735: note = derived and/or modified sequence opt11 from anti-influenza_Chain
  source 1..735: mol_type = other RNA
gaagtacaactggttgagagcggggccgaggtcaagaaaccgggatcgagcgtgaaagtaagctgtaaagcgagcgggggaacgttctcgagctatgcaataagctgggtcaggcaagcacccgggcaggggcttgagtggatgggcgggatcataggaatgttcgggacagcaaactatgcacagaaattccaagggcgcgtgaccataaccgcagacgagttcacgagcacggcctatatggagctatcgagcttgcgatcggaagataccgcggtctattactgtgccaggggcaattactattacgagagctcactcgattactggggccagggaacgctcgtgaccgtgagctcgggcacgggcgggagcgggggaacgggctcaggcacaggcgggagcacgcaatcggtcgtgacccagccaccgagcgtgagcgtggccccgggccagaccgcgcgaataacctgtggcgggaacaatatcggaagcaagagcgtgcactggtaccagcaaaagcccgggcaagcgcccgtgctcgtagtctatgacgatagcgatcggccgagcgggatcccggaaagattctcgggctcgaactcgggcaataccgcgaccttgaccataagcagggtagaggccggggacgaagccgattactattgccaggtctgggactcgagctcggaccattacgtgttcggaaccgggaccaaggtaacggtcctaggc

SEQ ID NO: 58662 - RNA, 735 nt, synthetic construct
  misc_feature 1..735: note = derived and/or modified sequence opt11 from anti-influenza_Chain
  source 1..735: mol_type = other RNA
gaagtccaactcgtccaatccggcgcagaagtcaaaaagccaggcgcctcagtaaaagtctcctgcaaagcctccggctacaccttcaccggctactacgtctactgggtgcgccaagcccccggccaaggactagaatggatgggctggatcagcgcctacaacggcaacaccaactacgcccaaaaattccaaggccgagtcaccatcacagccgacaaatccacctcaaccgcctatatggaactctcctccctccgaagcgaagacacagccgtatactactgcgcacgatcacgctccctagacgtctggggccaaggaaccaccgtcaccgtcagctccggcaccggcggctccggaggcacaggatccggcaccggcggcagcaccgacgtagtcatgacccaaagccccgactcactcgccgtatccctaggcgaacgagccaccatcaactgcaaatcctcacaatccgtcctatactccagcaacaacaaaaactacctagcctggtaccaacaaaaacccggacaaccacccaaactcctcatctactgggcatccacccgcgaatccggcgtccccgaccgattcagcggcagcggctccggcaccgacttcacactcaccatatccagcctccaagccgaagacgtcgcagtatactactgccaacaatactacagcacacccctcaccttcggcggcggaaccaaagtcgacataaaaaga

SEQ ID NO: 58663 - RNA, 735 nt, synthetic construct
  misc_feature 1..735: note = derived and/or modified sequence opt11 from anti-influenza_Chain
  source 1..735: mol_type = other RNA
gaggtccagctagtagaaaccggcgcggaagtgaaaaagcccgggagctcagtaaaggtcccgtgcaagagttcaggatcgcccttccgatccaacgcggtctcgtgggtgagacaggccccgggccaaggcttggaatgggtcggaggaatactcggggtctttggctcaccatcatacgcgcaaaagttccagggaagggtcacaatcacggccgacgaatcgacaaatacagtgcacatggaactgcgcgggctcaggagcgaggacacagccgtatactactgcgcgcgcgggcccacgtactactactcatacatggacgtatggggcaaagggacaacagtcacggtctcgagcggaaccgggggatcgggagggaccgggagcgggacagggggatcaacctcatacgtgctcacgcaaccgccctcggaatcagtcgcgcccgggcaaacggccaggataacgtgcgggggcaataacataggaaggaactcggtccattggtaccaacagaaaccgggccaggccccggtcctggtcgtgtacgacgactcggacaggccctcgggcatacccgagcgcttcagtgggagcaagagcgggaacacggccacgctaataatctcgcgcgtagaagtgggcgacgaagcagactactactgtcaagtatggcacagttcgagcgaccactacgtctttggcacgggcacaaaagtgaccgtgctcggg

SEQ ID NO: 58664 - RNA, 735 nt, synthetic construct
  misc_feature 1..735: note = derived and/or modified sequence opt11 from anti-influenza_Chain
  source 1..735: mol_type = other RNA
caaatgcaattggtccagagcggggccgaggtcaagaaaccgggctcgagcgtgaaagttagttgtaaagcaagcggaggcacgttctcgagctatgccataagctgggtaaggcaagcacccgggcaagggctagagtggatgggcgggatcttcggcatgttcgggaccgcgaactatgcacagaaatttcaagggagagtgaccataaccgcggacgagttcacgagcgcggcctatatggagctctcgagcttgggctcagaagataccgcgatgtattactgtgcaaggagctcaggctattacccgcaatatttccaggactggggccagggcacgcttgtgacagtgagctcaggcacgggcgggagcgggggcacaggatcaggaacgggcgggagcacggaaatagtcatgacccaaagcccgggcacgctctcgctatcgcccgggcaaagggccacgctatcgtgcagagcctcacaatcagtctcgagctcgtacttggcctggtaccagcaaaagcccgggcaagcgcccaggctcttaatgtatggcgcaagctcacgcgcgaccgggataccagacaggttctcgggctcgggatcgggcacggactttacattgaccataagcaggctcgagccagaggacttcgccgtgtactactgccagcaatatggctcgagctcgctcacgttcgggggcgggaccaagctagagatcaagcgc

SEQ ID NO: 58665 - RNA, 735 nt, synthetic construct
  misc_feature 1..735: note = derived and/or modified sequence opt11 from anti-influenza_Chain
  source 1..735: mol_type = other RNA
caagtacagctagtacaaagcggggccgaagtaaagaaaccaggctcgagcgtaaaagtgagctgcaaagcgagcggggtcacattctcgtactacgccatgagctgggtcaggcaagcgcccgggcaaggcctagagtggatgggcgggatctcgcccatgttcggaaccacaacatacgcccaaaaattccaaggacgcgtaaccataaccgcagacgacagcacgagcacggcatacatggaggtcaggagcctacgatcagaagacaccgcagtctactactgcgccaggagctcaaactactacgacagcgtatacgactactggggacagggaaccctagtgacagtaagctcaggaacgggaggaagcggaggcacgggctcgggcacgggcgggtcaacgcaatcagtcgtaacacagccaccaagcgagagtgtggcaccgggccagacagcgcgaataacctgcggcggacacaacatcggaagcaacagcgttcactggtaccagcaaaagccaggacaagcacccgtgctcgtggtctacgacaacagcgaccgcccgagcgggatcccggaaagattctcgggctctaactccggcaacaccgcgaccctgaccataagcagggtcgaagcaggggacgaggccgactactactgccaggtctggggctcaagctcggaccactacgtgttcggcaccggaaccaaggtaacggtcctgggc

SEQ ID NO: 58666 - RNA, 738 nt, synthetic construct
  misc_feature 1..738: note = derived and/or modified sequence opt11 from anti-influenza_Chain
  source 1..738: mol_type = other RNA
caggtacagctcgtgcaatcgggagggggattggtcaagcccgggggatcgctaagactctcgtgcgcggcctcaggctttacatttagctcgtactcaatgaattgggtgcgccaggccccgggaaagggcctggaatgggtctcgagcataagctcgagctcgagctatatctattacgtggactcagtcaagggaaggttcacgatctcgcgagataacgcgaaaaatagcctatacctgcaaatgaactcgctcagggccgaggacacggccgtatactactgcgcgcgcgggggagggagctatggcgcgtacgagggctttgactactgggggcaagggaccctggtcacagtctcgagcgggaccgggggctcgggcgggaccgggagcgggaccgggggctcgaccgagatcgtgctcacgcaatcacccgggacattgagcttgagcccgggcgagcgcgcgaccttgagctgccgcgcaagtcaacgcgtgagctcgtacttggcatggtaccagcaaaagccagggcaagcgcccagactattaatctatggcgcgagcacgcgcgcggccgggatcccggacaggttctcgggctcgggctcaggcacggactttaccttgaccataagcaggctcgaaccagaggactcagccgtatactattgccagcaatatggcaggaccccgctcacgttcggtggagggaccaaggtcgagatcaagcgc

SEQ ID NO: 58667 - RNA, 738 nt, synthetic construct
  misc_feature 1..738: note = derived and/or modified sequence opt11 from anti-influenza_Chain
  source 1..738: mol_type = other RNA
gaagtgcaattggtcgagagcggggccgaggtcaagaaaccgggatcgagcgtaaaggtgagctgtaaagcgagcggaggcccgttcaggagctacgccataagctgggtcaggcaagcgcccggacaagggcccgagtggatgggcgggataatacccatattcgggacaacgaaatatgccccgaaatttcaagggcgcgtaaccataacagcggacgatttcgcgggaacggtctatatggaactatcgagcctgcgatcggaagatacagcaatgtattactgtgcaaagcacatgggctaccaagtacgcgagaccatggatgtgtgggggaaaggaacaacggtaacagtatcgagcggaaccgggggctcgggcgggaccgggagcgggaccgggggatcgacctcgtacgtgctcacgcaaccgccctcggtctcggtcgcgcccgggcaaacagccaggatcacgtgcgggggcaacaacataggatcgaaatcggtacattggtaccaacagaaaccgggccaggccccggtattagtagtgtacgatgactcggacaggccctcaggcataccagagcgatttagcgggagcaatagcggaaacacggcaacgctaacgatcagtcgcgtggaagcgggcgatgaagcggactattactgtcaagtatgggacagctcgagcgatcacgcggtctttggcgggggaacgcaactgaccgtgctaggg

SEQ ID NO: 58668 - RNA, 738 nt, synthetic construct
  misc_feature 1..738: note = derived and/or modified sequence opt11 from anti-influenza_Chain
  source 1..738: mol_type = other RNA
gaagtgcaactggtcgagaccggggccgaggtaaaaaaaccgggcgcaagcgtgaaagtgagctgcaaagcaagcggatacacgttcacaagctactacatgcactgggtcaggcaagcgcccgggcaaggactagagtggatgggatggatcaaccccaacagcgggggcacgaactacgcccagaaattccaagggcgagtaaccatgaccagagacacgagcataagcacggcatacatggagctctcgcgcctgcgctcagacgataccgcggtctactactgcgccagagaaggaaaatggggcccgcaagcagcattcgacatatgggggcaagggacaatggtcacggtatcgagcgggaccgggggatcaggcgggaccgggagcggaaccgggggctcgacagagatcgtaatgacacaatcgcccgggaccttgagcctaagcccgggcgagcgcgcgacactaagctgccgcgcgagccaaagtgtaagctcaagctacctcgcgtggtaccaacagaaaccgggccaggccccgcgcctgctcatatacgacgcatcgagcagggccacggacatacccgaccgattcagcggcagcgggagcgggacagacttcacactcacgatctcgcgcctagaaccggaagacttcgcggtctactactgtcaacagtacggaagctcgctctggaccttcggccaaggcacaaaagtagaaataaaaaga

SEQ ID NO: 58669 - RNA, 738 nt, synthetic construct
  misc_feature 1..738: note = derived and/or modified sequence opt11 from anti-influenza_Chain
  source 1..738: mol_type = other RNA
gaggtccaactcgtggaatcgggcgggggcctggtccagcccgggggctcactcaggctatcgtgcgcggcctcgggctttacctttagcatatacgcgatgtcgtgggtgcgccaggccccgggcaagggcctggaatgggtctcagccataagctcgagcggggactcgacctattacgcggactccgtcaagggcaggttcacgatctcacgcgataacgcgcgcaataccttgtacctgcaaatgaactcgctcagagccgaggacacggccgtatactattgcgcgagagcgtacgggtacacattcgacccctggggccagggcacgctcgtgaccgtgagctcgggcactggcgggagcgggggaacaggctcgggcacgggcgggagcacggaaatagtactgacccagagcccgctctcgctcccggtaacgcccggggaaccggcctcaatctcatgcaggagctcgcaatcgctcctacactcaaacgggtacaactacttggactggtacttgcaaaagcccgggcaatcgccacagctattgatctatctcgggagcaatcgcgcgagcggggtaccggacagattctcgggctcaggctcgggcacagacttcaccctgaaaatcagcagggtcgaggccgaggacgtgggagtatactattgcatgcaagcactccagaccccgctaacgttcgggggcggaactaaagtcgagatcaagcgc

SEQ ID NO: 58670 - RNA, 738 nt, synthetic construct
  misc_feature 1..738: note = derived and/or modified sequence opt11 from anti-influenza_Chain
  source 1..738: mol_type = other RNA
gaggtccagctcgtagaaacaggagcagaagtgaaaaagcccggaagttcggtaaaggtctcgtgcaaggcctcgggcggaacctttcgcacgcacgcgatctcgtgggtgcgccaggccccgggccagggcttggaatggatgggcgggataatagcgatcttcggaacggccaattacgcgcaaaagttccagggcaggatcacgatcacggccgatgaatcgacctcgaccgcatacatggaattaagctcgctaagaagcgaggacacggccgtgtacttttgcgcgcgcgggagcgggtaccatatctcgaccccgttcgataactggggacagggcacgctcgtgacagtgagctcgggcacgggaggaagcgggggcacgggctcgggcacgggcgggagcacaagctatgtactgacccagcccccgagcgtgagcgtagcaccgggacagaccgcgcgcataacctgtggcggaaacaacatcgggagcaagggcgtgcactggtaccagcaaaagccaggacaagcgcccgtgctcgtggtatatgacgatagcgaccgcccgagcggaataccggaaaggttctcaggctcgaactcgggcaataccgcgaccttgacaataagcagggtagaggccggagatgaggccgactactattgccaggtctgggactcgagctcggaccatgtcgtgttcgggggcgggaccaagctcacggtcctaggc

SEQ ID NO: 58671 - RNA, 738 nt, synthetic construct
  misc_feature 1..738: note = derived and/or modified sequence opt11 from anti-influenza_Chain
  source 1..738: mol_type = other RNA
gaggtccagctagtgcagtcaggagctgaagtgaaaaagccagggagctcagtcaaggtctcgtgcaaggcatcaggcgggatctttcgatcgaactcgatctcatgggtgcgccaggcaccgggacagggtttggaatggatgggcgggatattcgcgctctttggcacgaccgattacgcgcaaaagttccagggcagggtaacgataacagccgatgagtcgagtacaaccgtgtacttggaattgagttcgctcacgagcgaggacacggccgtgtactattgcgcgcgcgggagcgggtacacgacaaggaactatttcgattactggggccaaggcacactcgtaacagtgagttcaggcacgggcggaagcgggggaacgggctcgggcacgggcgggagcacggaaatagtcttgacccagagcccgggcacgctttcgctctcacccggggaaagggcaacgctctcgtgcagagcctcacaatcggtatcgagcaactacttgggctggtaccagcaaaagccagggcaagcgcccagactactgatatatggcgcgagctcacgagcgagcgggatcccggacaggttctcgggcgggggctccggcacggacttcaccctgaccataagcaggctcgagcccgaggactttgcagtgtactattgccagcaatatggctcaagcccgctcacgttcgggggcgggaccaaggtcgagatcaagaga

SEQ ID NO: 58672 - RNA, 738 nt, synthetic construct
  misc_feature 1..738: note = derived and/or modified sequence opt11 from anti-influenza_Chain
  source 1..738: mol_type = other RNA
gaggtccagctcgtggaatcaggcgcggaagtgaaaaagccagggagctcagtcaaagtatcgtgcaaggcatcgggcgggatctttaactcgtacgcgatctcgtgggtgcgacaggccccaggccagggattggaatggatgggcgggataatcgcaatatttcacacgcccaagtacgcacaaaagttccagggaagggtcacgatcacggcagacgaatcgacaaatacagcgtacatggaattgcgctcgctaaagagcgaggacacagccttgtactattgcgcgcgcgggagcacgtatgatttctcaagcggactcgattactggggacagggcacgctcgtgaccgtgagttcgggcacaggcgggagcgggggcacgggctcgggcacgggcgggagcacgcaagcgggcctgacccagcccccaagcgtaagcgtggccccgggccagaccgcgcgcataacctgtggcgggaacaatatcgggagcaagagcgtgcactggtaccagcaaaagcccggacaagcgcccgtgctagtggtctatgacgatagcgatcgcccgagcgggatcccggaaaggttctcgggctcgaactcgggcaatacagcgacattgaccataagcagggtcgaggccggggacgaggcagattactactgccaagtctgggactcgagctcagaccatgtcgtgttcggaggagggacaaagctcacggtcttggga

SEQ ID NO: 58673 - RNA, 741 nt, synthetic construct
  misc_feature 1..741: note = derived and/or modified sequence opt11 from anti-influenza_Chain
  source 1..741: mol_type = other RNA
caaatgcaactcgtccaatccggcgccgaagtcaaaaaacccggcagctccgtaaaagtctcctgcaaagcatcaggaggaaccttctcatcctacgcaataacctgggtccgacaagcccccggccaaggcctcgaatggatgggaggcatcatcggaatgttcggctccaccaactacgcacaaaacttccaaggcagagtaaccatcaccgcagacgaatcaacctccaccgcgtacatggaactcagctcactccgcagcgaagacaccgccgtctactactgcgcccgctcaaccggctactaccccgcctacctacaccactggggccaaggcaccctcgtaaccgtatccagcggcaccggcggatccggcggcaccggcagcggcaccggcggctccacccaatccgcactaacccaaccacgatccgtctccggctcacccggccaatcagtcaccatatcctgcacaggcacaagctcagacgtcggaggatacaactacgtctcctggtaccaacaacaccccggaaaagcccccaaactaatgatctatgacgtcagcaaacgccccagcggcgtcccagaccgcttctccggctcaaaatccggcaacaccgccagcctaaccatctccggcctccaagccgaagacgaagcagactactactgctcgagctacacatcaagctccacccacgtcttcggcaccggcacaaaagtcaccgtcctcggc

SEQ ID NO: 58674 - RNA, 744 nt, synthetic construct
  misc_feature 1..744: note = derived and/or modified sequence opt11 from anti-influenza_Chain
  source 1..744: mol_type = other RNA
gaagtacaactcgtcgaatccggcgccgaagtcaaaaaacccggctcctccgtcaaagtctcctgcaaagcatccggcggccccttccgctcctacgccatcagctgggtacgccaagcccccggacaaggccccgaatggatgggcggcatcatcccaatcttcggaaccacaaaatacgcccccaaattccagggccgcgtaaccatcacagccgacgacttcgccggaacagtctacatggaactctcctcactacgctccgaagacaccgccatgtactactgcgccaaacacatgggataccaagtccgcgaaaccatggacgtatggggcaaaggcaccaccgtaacagtcagcagcggcacaggaggatccggcggcaccggctcaggcaccggcggatccacaagctacgtcctcacacaaccccccagcgcctccggcacccccggacaacgcgtcacaatctcctgcagcggctccaccttcaacatcggctcaaacgccgtcgactggtacagacaactgcccggaacagcccccaaactcctaatatactccaacaaccaacgccccagcggagtccccgaccgcttctccggcagccgctccggcaccagcgcctccctcgccatctccggcctacaatccgaagacgaagccgactactactgcgcagcctgggacgacatactcaacgtccccgtcttcggcggcggcaccaaactcaccgtcctcggc

SEQ ID NO: 58675 - RNA, 744 nt, synthetic construct
  misc_feature 1..744: note = derived and/or modified sequence opt11 from anti-influenza_Chain
  source 1..744: mol_type = other RNA
caggtgcaattggtccagagcggggccgaggtcaagaaaccgggctcgagcgtgaaagtgagctgtaaagcgagcgggggaccgttcaggagctatgccataagctgggtcagacaagcacccgggcaaggtcccgagtggatgggagggatcatacccatattcggtaccacaaaatatgccccaaaatttcaaggtcgcgtaaccataaccgcggacgacttcgcgggcacggtctatatggaactctcgagcttgcgatcggaagataccgcgatgtattactgtgccaagcacatgggctatcaagtgcgcgagaccatggacgtgtgggggaaagggaccacggtaacggtctcgagcgggaccgggggctcgggcgggaccgggagcgggaccggaggctcgacccagagtgcgctcacgcaaccggccgcagtctcaggatcacccgggcaatcgatcacgatctcgtgcacgggaacaagctcagacgtaggaggatacaattacgtgagctggtaccagcaacaccccgggaaagcgcccaagctcatgatctatgaagtgagcaatcgaccgagcggggtctcgaacagattctcgggctcgaaatcgggaaataccgcaagcctgaccataagcgggctccaggccgaggacgaggccgactactattgctcgagctatacatcgagctcgacctatgtctttggcacgggcacaaaagtgaccgtgctcggg

SEQ ID NO: 58676 - RNA, 744 nt, synthetic construct
  misc_feature 1..744: note = derived and/or modified sequence opt11 from anti-influenza_Chain
  source 1..744: mol_type = other RNA
gaagtacagttggtggagagcggggcagaggtgaagaagccggggagcagcgtgaaagtgagttgcaaggcgagtggagggccgttccggagctatgcgataagctgggtgaggcaggcaccggggcaggggccggagtggatgggagggataataccaatattcgggacgacgaagtacgcgccgaagttccaggggagggtgacgataacggcggacgactttgcggggacagtatacatggagctgagcagcctgagaagcgaggacacagcgatgtactactgcgcaaagcacatggggtaccaggtgagggagacgatggacgtgtgggggaaggggacgacggtgacagtgagcagcgggacgggagggagcggagggacggggagtgggacgggagggagcacaagctacgtgctaacgcagccgccgagtgtgagtgggacaccagggcagagggtgacaataagttgcagcgggagcaggagtaacgtgggggacaatagcgtgtactggtaccagcacgtaccagagatggcaccgaaattgctggtgtacaagaacacgcagaggccaagcggggtgccggcaaggtttagcgggagtaagagcggaaccagcgcgagcctagcgataatagggctgcagagcggggacgaggcagactactactgcgtggcgtgggacgacagcgtggacggatacgtgttcgggagcgggacgaaggtgacggtactgggg

SEQ ID NO: 58677 - RNA, 744 nt, synthetic construct
  misc_feature 1..744: note = derived and/or modified sequence opt11 from anti-influenza_Chain
  source 1..744: mol_type = other RNA
gaggtccagctcgtggaaagcggagcggaagtgaaaaagcccgggagctcggtaaaggtctcgtgcaaggcctcgggcgggccattccgatcgtacgcgatctcatgggtgcgacaagccccgggccagggcccggaatggatgggaggcataatcccgatctttggcacgaccaagtacgcacccaagttccagggcagggttacaataacggccgatgactttgccgggacagtgtacatggaattgagctcactaagaagcgaggacacggccatgtactattgcgcgaaacatatgggataccaggtcagggaaacgatggatgtctggggcaagggcacgacagtgaccgtgagctcgggcacgggcgggagcggaggaacaggctcaggaacgggcgggagcacaagctatgtcctgacccagcccccaagcgcaagcgggaccccgggacagcgcgtgacaataagctgtagcggaagctcgagcaacatcgggagcaattacgtgtactggtaccagcaattgccagggacagcgccaaagctactgatatatcgcgatggacagcgcccgagcggggtcccggacaggttctcgggctcgaaatcgggcacgagcgcgagcttggccataagcgggctaaggagcgatgatgaggccgattactactgcgcgacctgggacgataacttgagcggacccgtgttcgggggcgggaccaagctcacggtcttgggc

SEQ ID NO: 58678 - RNA, 744 nt, synthetic construct
  misc_feature 1..744: note = derived and/or modified sequence opt11 from anti-influenza_Chain
  source 1..744: mol_type = other RNA
gaagtgcaactggtcgagagcggggcagaagtaaagaaaccgggctcaagcgtgaaagtaagctgcaaagcgagcgggggcacattctcgttctacagcatgagctgggtaaggcaagcacccgggcaagggctcgagtggatgggcgggatcatacccatgttcgggacaacaaactacgcccagaaattccaagggcgagtgacaataaccgcggtagagagcacgagcacggcctatatggaggtatcgagcttgcgctcggaagataccgcggtctattactgcgccagaggcgataaagggatctactactattacatggacgtatgggggaaagggaccacggtcacggtctcgagcggaaccgggggatcgggcggaaccgggagcgggaccgggggatcgacccagagcgcgctcacacaaccagcctcggtatcgggatcgcccggacaatccataacgatatcatgcacaggcacgagctcggacgtgggagggtacaactacgtgagctggtaccagcaacacccagggaaagcgccaaagctaatgatctatgaagtgagtaaccgcccgagcggggtatcgaaccggttctcaggctcaaaatcgggcaatacagcgagcctgaccataagcgggctccaggccgaggacgaggcagattactattgctcgagctatacatcaagctcgaccttggtctttggcacgggcacgaaagtgaccgtgctcggg

SEQ ID NO: 58679 - RNA, 744 nt, synthetic construct
  misc_feature 1..744: note = derived and/or modified sequence opt11 from anti-influenza_Chain
  source 1..744: mol_type = other RNA
atgagcctcttcggcgataccatagcctacctcctatcgctaatcgaggacggggaagggaaagcggaactggccgagaaactacactgttggttcggcgggaaagagttcgacctcgacagcgcactcgagtggatcaaaaacaaaaggtgtttaaccgacatacagaaagcgctaataggcgcgagcatatgcttcctcaagcccaaagaccaagaaaggaaaaggcgctttatcacagaaccgctctcaggaatgggcacgaccgcgaccaagaagaaaggcctaatactggccgagcgcaaaatgagacgatgcgtctccttccacgaagcgttcgagatcgcagaagggcacgagagctcagccctgctctactgcttgatggtgatgtacctcaaccccgagaactacagcatgcaagtgaaattgggcacgctctgcgccctatgcgagaaacaggcatcacactcgcacagggcccacagcagggccgcgcgctcaagcgtgcccggggtcaggcgcgagatgcaaatggtgagcgcgatgaacaccgcgaaaacgatgaacggcatgggcaagggagaggacgtgcaaaagctcgcggaggaactccagaacaatatcggggtactgcgctcgctcggggcctcacaaaagaacggggaagggatcgcgaaagacgtcatggaagtactcaaacaatcgagcatgggcaacagcgcgctcgtgcgcaagtactta

SEQ ID NO: 58680 - RNA, 747 nt, synthetic construct
  misc_feature 1..747: note = derived and/or modified sequence opt11 from anti-influenza_Chain
  source 1..747: mol_type = other RNA
gaagtccaactcgtggaatcaggagcggaagtgaaaaagcccggaagctcggtaaaggtctcatgcaaggcctcgggcgggcccttccgctcatacgcaatatcatgggtgcgccaagccccaggccagggaccagaatggatgggagggataatcccgatcttcggcacaacaaagtacgcgcccaaattccaaggcagggtcacaatcacagccgacgacttcgccgggaccgtatacatggaactaagctccctcaggagcgaggacacagccatgtactactgcgcaaaacacatggggtaccaggtccgggaaacgatggacgtctggggcaaaggcacaaccgtaacagtcagctcgggcacaggcggaagcggaggcacaggctcgggcacaggcgggagcacacaatcggtcctgacccaaccaccgagcgtaagcgcagcaccgggccagaaagtcaccataagctgctccggaagctcgtccaacatcgggaacgactacgtgagctggtaccagcaactacccggaaccgcgcccaaactcctaatctacgacaacaacaagcgcccgagcggaatcccagacagattctcaggctcgaaatcaggaacaagcgcaaccctgggaataacaggactccagacaggagacgaggccaactactactgcgccacctgggacagacgaccgacagcatacgtggtcttcggaggaggcacaaaactaacagtgctagga

SEQ ID NO: 58681 - RNA, 750 nt, synthetic construct
  misc_feature 1..750: note = derived and/or modified sequence opt11 from anti-influenza_Chain
  source 1..750: mol_type = other RNA
caggtccagctcgtacaatcgggcgcggaagtgaagaaacccgggagctcggtcagagtctcgtgcaaagcatcgggctcgatatttcgaaattacgcgatgtcgtgggtgcgccaggcaccgggccagggcctggaatggatgggagggataatagcgatcttcggcacgcccaagtacgcgcaaaagttccagggcagagtcacgatcacagcagacgaatcgacctcgaccgtgtacatggaattgagcgggctaaggagcgaggacacggcaatgtactattgcgcgcgcataccccattacaatttcgggagcgggagttatttcgattactggggccagggcacgctagtgaccgtaagctcgggaacgggagggagcgggggaacgggctcgggcacgggcgggagcacgaccgtactcacgcaaccaccctcggtctcgggagcgccagggcaaagagtcacgatctcgtgcacgggctcgagctcgaacataggagcgggctatgacgtgcactggtaccaacaattacccgggaccgcgccaaagctattgatatatggcaatagcaaccgcccgagcggggtcccggacaggttctcaggctcaaaatcgggaacgagcgctaccttgggcataaccgggctgcagacaggggacgaggccgattactattgcgggacctgggactcgagcttgagtgcgtacgtgttcgggaccgggacaaaggtcacagtcctgggc

SEQ ID NO: 58682 - RNA, 756 nt, synthetic construct
  misc_feature 1..756: note = derived and/or modified sequence opt11 from anti-influenza_Chain
  source 1..756: mol_type = other RNA
gaggtacagctcgtggaatcaggcgcggaagtcaaaaagcccggaagctcggtaaaggtatcatgcaaggcatcgggacatatatttagcgggtacgcgatctcgtgggtacgacaagccccgggccagggattggaatggatgggcgggataatcccgatctttggcacgaccaattacgcacaaaaattccagggcagggtcacgatcacagccgatcaatcgacctcgaccgcatacatggacttaagcaatctaaggagcgaagacacggccgtgtactattgcgcacgagtgaaagacggatattgcacgcttacgagctgtcccgtgggctggtactttgacttgtgggggcgcgggacattggtcacggtctcgagcgggaccgggggctcgggcgggaccgggagcgggaccgggggctcaaccgagatagtgatgacgcaatcgcccgggaccctgagcttaagcccgggcgagcgcgcgaccttgagctgtcgagcaagccagagcgtcagctcgagctacctcgcgtggtatcaacagaaaccaggccaggccccgcgcttactcatattcggggcatcgagcagagcaacgggcatacccgatcgatttagcgggagcggaagcgggaccgatttcacgctaacgatatcgcgcctggaaccggaagacttcgcggtatattactgccaacagtacgggagctcgctcacgttcggaggcgggaccaagctcgagatcaagcgc

SEQ ID NO: 58683 - RNA, 768 nt, synthetic construct
  misc_feature 1..768: note = derived and/or modified sequence opt11 from anti-influenza_Chain
  source 1..768: mol_type = other RNA
caagtacaactcgtccaaagcggcgccgaagtcaaaaaacccggatcatccgtcaaagtctcatgcaaagcctcaggaggcttcttctccagctacgccatctcatgggtacgccaagcccccggccaaggcctcgaatggatgggcggcgtaatacccatattccgcaccgcaaactacgcccaaaacttccaaggacgagtcacaatcaccgccgacgaattcacctcctacatggaattatcctccctcagatccgacgacaccgccgtctactactgcgcacgcctcaactaccacgactccggcacctactacaacgccccccgcggctggttcgacccctggggacaaggaacactcgtcacagtatcctccggaaccggcggctcaggcggaaccggctccggcaccggcggcagcaccgacatccaaatgacccaatcacccgactccctcgccgtctccctcggcgaaaaagccacaataaactgcaaatcatcacaatccatcctaaactcctccaacaacaaaaactacctcgcctggtaccaacaaaaaccaggccaacccccaaaactcctcatctactgggcctccacccgcgaatccggcgtccccgaccgcttctccggctcaggctccggaaccgacttcaccctaaccatctcctccctccaagccgaagacgtcgccgtatactactgccaacaatactactcatcaccccccaccttcggccaaggcacaaaagtagaaatcaaacga

SEQ ID NO: 58684 - RNA, 768 nt, synthetic construct
  misc_feature 1..768: note = derived and/or modified sequence opt11 from anti-influenza_Chain
  source 1..768: mol_type = other RNA
caagtccaactcgtccaatccggagccgaagtcaaaaaacccggttcctccgtcaaagtaagctgcaaagcatcaggaggcttcttctcctcatatgccatctcctgggtccgccaagcaccaggccaaggcctagaatggatgggtggcgtcatccccatcttccgaaccgccaactacgcccaaaacttccaaggcagagtcaccatcacagccgacgaattcacctcctacatggaactctcatccctccgctcagacgacaccgccgtctactactgcgcccgcctcaactaccacgactccggcacatactacaacgccccccgaggctggttcgacccctggggccaaggcaccctcgtcaccgtatcctccggcaccggcggctcaggcggcaccggctccggaaccggcggcagcaccgacatccaaatgacccaatcccccgactccctcgccgtctcactcggcgaaaaagccaccatcaactgcaaatcctcacaatccatcctcaactcctccaacaacaaaaactacctagcctggtatcaacaaaaacccggccaaccacccaaactactcatctactgggcctcaacccgagaatccggagtccccgacagattctccggctcaggctcaggcacagacttcaccctcaccatctcctccctccaagccgaagacgtcgccgtatattactgccaacaatactactcctccccacccacattcggccaaggcaccaaagtcgaaatcaaacgc

SEQ ID NO: 58685 - RNA, 771 nt, synthetic construct
  misc_feature 1..771: note = derived and/or modified sequence opt11 from anti-influenza_Chain
  source 1..771: mol_type = other RNA
atctgcatcggctaccacgccaacaactccaccgaacaagtcgacaccatcatggaaaaaaacgtcaccgtcacccacgcccaagacatcctcgaaaaaacccacaacggcaaactatgcgacctcgacggcgtcaaacccctaattctacgcgactgctccgtcgccggctggctcctcggaaacccaatgtgcgacgaattcatcaacgtacccgaatggtcctacatcgtcgaaaaagccaaccccgccaacgacctctgctaccccggaaacttcaacgactacgaagaactcaaacacctcctctcccgcatcaaccacttcgaaaaaatacaaatcatccccaaatcctcctggtccgaccacgaagcctcctccggcgtcagctccgcctgcccctaccaaggcaccccctccttcttccgaaacgtagtctggctcatcaaaaaaaacaacacctacccaaccatcaaacgaagctacaacaacaccaaccaagaagacctcctaatactctggggcatccaccactcaaacgacgccgccgaacaaaccaaactctaccaaaacccaaccacatacatcagcgtcggcaccagcacactcaaccaacgcctcgtccccaaaatagccacccgctccaaagtcaacggccaaaacggccgcatggacttcttctggaccatactcaaacccaacgacgccatcaacttcgaatccaacggaaacttcatcgcccccgaatacgcctacaaaatcgtcaaaaaa

SEQ ID NO: 58686 - RNA, 771 nt, synthetic construct
  misc_feature 1..771: note = derived and/or modified sequence opt11 from anti-influenza_Chain
  source 1..771: mol_type = other RNA
atctgcatcggctaccacgccaacaactccaccgaacaagtcgacaccatcatggaaaaaaacgtaaccgtcacccacgcacaagacatactcgaaaaaacacacaacggcaaactctgcgacctcgacggagtcaaacccctcatactccgcgactgctcagtcgccggctggctcctcggcaaccccatgtgcgacgaattcatcaacgtccccgaatggtcctacatcgtcgaaaaagccaaccccgccaacgacctctgctaccctggcaacttcaacgactacgaagaactcaaacacctcctctcacgcataaaccacttcgagaaaatccaaatcatccccaaatcctcctggtccgaccacgaagcctcatccggcgtctcatcagcatgtccataccagggcaccccatccttcttccgcaacgtagtctggctcatcaaaaaaaacaacacctaccccaccataaaacgctcctacaacaacaccaaccaagaggacctcctaatactctggggcatccaccactccaacgacgccgccgaacaaaccaaactataccaaaaccccaccacctacatctccgtcggcacctctaccctcaaccaacgcctcgtccccaaaatcgccacccgctccaaagtaaacggacaaaacggccgaatggacttcttctggaccatcctcaaacccaacgacgccatcaacttcgaatccaacggcaacttcatcgcccccgaatacgcctacaaaatcgtaaaaaaa

SEQ ID NO: 58687 - RNA, 777 nt, synthetic construct
  misc_feature 1..777: note = derived and/or modified sequence opt11 from anti-influenza_Chain
  source 1..777: mol_type = other RNA
atggtcaaatccaaatacctcgtcttcatctcagtattctccctcctcttcggcgtcttcgtagtcggattctcacaccaaggcgtcaaagccgaagaagaacgccccatgggaaccgccttctacgaatcattcgacgccttcgacgacgaacgctggtccaaagccggcgtctggaccaacggccaaatgttcaacgccacctggtaccccgaacaagtcaccgccgacggcctcatgcgcctcaccatcgccaaaaaaaccacctccgcccgcaactacaaagccggagaactccgcaccaacgacttctaccactacggcctattcgaagtatcaatgaaaccagccaaagtcgaaggcaccgtctcctcattcttcacctacaccggagaatgggactgggacggcgacccctgggacgaaatcgacatcgaattcctcggcaaagacaccacccgaatccaattcaactacttcaccaacggcgtcggcggcaacgaattctactacgacctcggcttcgacgcctccgaatcattcaacacctacgccttcgaatggcgcgaagactccatcacctggtacgtaaacggcgaagccgtccacaccgccactgaaaacatcccccaaaccccccaaaagatcatgatgaacttatggcccggcgtcggcgtcgacggctggaccggagtcttcgacggcgacaacaccccagtctactcatactacgactgggtccgctacacacccctccaaaactaccaaatccaccaa

SEQ ID NO: 58688 - RNA, 777 nt, synthetic construct
  misc_feature 1..777: note = derived and/or modified sequence opt11 from anti-influenza_Chain
  source 1..777: mol_type = other RNA
atggtaaaatccaaatacctcgtcttcataagcgtcttcagcctcctcttcggagtattcgtcgtaggcttcagccaccaaggggtaaaagccgaagaagaacgccccatgggcaccgcattctacgaatccttcgacgccttcgacgacgaacgctggtcaaaagccggcgtctggaccaacggacaaatgttcaacgccacctggtaccccgaacaagtcaccgccgacggcctcatgcgcctcaccatcgccaaaaaaaccacctcagccagaaactacaaagccggcgaactccgcaccaacgacttctaccactacggactcttcgaagtctccatgaaaccagcaaaagtcgaaggcaccgtctcctccttcttcacatacaccggagaatgggactgggacggcgacccatgggacgaaatcgacatcgaattcctcggcaaagacaccacccgaatacaattcaactacttcaccaacggcgtcggaggcaacgaattctactacgacctaggcttcgacgcctcagaatcattcaacacctacgccttcgaatggcgagaagactccatcacctggtacgtaaacggcgaagccgtacacaccgccaccgaaaacatcccccaaacgccccaaaaaatcatgatgaacctctggcccggcgtcggcgtagacggatggaccggagtattcgacggcgacaacacccccgtctacagctactacgactgggtccgttacacacccctgcaaaactaccaaatccaccaa

SEQ ID NO: 58689 - RNA, 783 nt, synthetic construct
  misc_feature 1..783: note = derived and/or modified sequence opt11 from anti-influenza_Chain
  source 1..783: mol_type = other RNA
gatatccagatgacgcaatcaccctcgagcgtgagtgcgagcgtgggcgatagagtaaccataacctgccgagcaagccaggacataagcacgtggttggcttggtaccagcaaaagcccgggaaagcaccaaagctcctgatctatgccgcaagctcactccagagcggggtcccgagcaggttctcgggatcgggctcgggcacagactttaccctgaccataagctcgctccagcctgaggactttgcaacgtacttttgccagcaagcgaactcattcccgcccacgttcggatgcgggaccaagctagagatcaaaggagggggaggaagcggaggcgggggctcgggcgggggcgggagcggaggcggaggctcagaagtgcaattggtcgtgagcgggggcgggctcgtgaaaccgggcgggagcttgcgcttgagctgtgccgcgagcggactatcgttcctgaacgcatggatgagctgggtcagacaagcacccgggaaatgtctcgagtgggtgggcaggatcaagagcaataccgatggcgggaccacggactacgccgcacccgtgaaagggcgctttagcataagcagggacgatagcaaaaacatgctctttctccatatgagctcattgcgcacggaagataccgcggtctactactgcgcaacagacgggccctatagcgatgactttcgctcgggctatgccgcgcgctatcgctatttcggaatggacgtctggggccagggcacgaccgtaaccgtgagttca

SEQ ID NO: 58690 - RNA, 783 nt, synthetic construct
  misc_feature 1..783: note = derived and/or modified sequence opt11 from anti-influenza_Chain
  source 1..783: mol_type = other RNA
gatatccaaatgacacaatcgccctcgagcgtaagtgcgagcgtgggcgatcgcgtgaccataacctgtcgagcgagccaggacataagcacgtggctggcctggtaccagcaaaagcccgggaaagcgcccaagctcctgatctatgccgcgagctcactccagagcggggtcccaagcaggttctcgggctcgggctcaggcacggactttaccttaacaataagctcgctccagcccgaggactttgccacgtacttctgccagcaagcgaactcgttcccgcccacgttcggatgcgggaccaagctcgagatcaagggagggggcggaagcgggggagggggctcgggagggggcgggagcgggggcgggggatcggaagtacaactggtcgtgagcgggggcggactcgtgaaaccgggcgggagcctgcgcttaagctgtgccgcaagtgggctttcgttcctgaacgcgtggatgagctgggtcaggcaagcgcccggaaaatgcctagagtgggtgggcaggataaagagcaacaccgatggcgggaccacggactatgccgcgcccgtgaaagggcgattcagcataagcagggacgatagcaagaacatgctctttctccatatgtcgagcttgcgcacggaagatacagcggtctactactgcgccacggacggaccctatagcgatgactttagatcaggctatgccgcgcgctatcgctatttcgggatggatgtctggggccagggcacgaccgtgaccgtgagctcg

SEQ ID NO: 58691 - RNA, 789 nt, synthetic construct
  misc_feature 1..789: note = derived and/or modified sequence opt11 from anti-influenza_Chain
  source 1..789: mol_type = other RNA
atgggattcgtcctcttctcacaactcccctcattcctcctcgtctctaccctcctcctattcctcgtcatcagccactcctgccgcgcccaaaacggcggcagctacccctacaaatctggcgaatacagaaccaaaagcttcttcggctacggctactacgaagtccgcatgaaagccgccaaaaacgtcggcatcgtctccagcttcttcacctacaccggcccctccgacaacaacccatgggacgaaatcgacatcgagttcctcggcaaagacaccaccaaagtccaattcaactggtacaaaaacggcgtaggcggcaacgaatacctacacaacctaggcttcgacgcctcccaagacttccacacctacggcttcgaatggcgccccgactacatcgacttctacgtcgacggcaaaaaagtataccgcggcacccgcaacatccccgtaacccccggcaaaatcatgatgaacctctggcccggcatcggcgtagatgaatggctcggcagatacgacggcagaaccccactccaagcagaatacgaatacgtcaaatactacccaaacggccgatccaaactcgtcgtcaacacacccttcgtcgccgtcttctccaacttcgacagctcccaatgggaaaaagcagactgggccaacggaagcgtcttcaactgcgtctggaaaccctcacaagtcaccttctccaacggcaaaatgatcctcaccctcgaccgcgaatacgtcgaccaccaccaccatcaccacaaagacgaactc

SEQ ID NO: 58692 - RNA, 789 nt, synthetic construct
  misc_feature 1..789: note = derived and/or modified sequence opt11 from anti-influenza_Chain
  source 1..789: mol_type = other RNA
atgggattcgtcctcttcagccaactcccatcattcctactcgtctccaccctcctcctcttcctcgtcatctcccactcctgccgcgcccaaaacggcggctcctacccctacaaatccggcgaataccgcacaaaaagcttcttcggctacggctactacgaagtccgcatgaaagcagccaaaaacgtcggcatcgtatcctcattcttcacttacaccggaccctccgacaacaacccctgggacgaaatcgacatcgaattcctcggcaaggacaccaccaaagttcaattcaactggtacaaaaacggcgtaggcggcaacgaatacctccacaacctcggcttcgacgcatcccaagacttccacacctacggcttcgaatggcgacccgactacatcgacttctacgtcgacggcaaaaaagtctacagaggcacccgcaacatcccagtcacccccggcaaaatcatgatgaacctctggcccggcatcggcgtcgacgaatggctcggccgctacgacggccgcaccccactccaagccgaatacgaatacgtaaaatactaccccaacggccgctccaaacttgtcgtcaacacacccttcgtcgccgtcttctccaacttcgactcctcccaatgggaaaaagccgactgggcaaacggatcagtcttcaactgcgtctggaaaccatcccaagtcaccttctccaacggcaaaatgatcctcaccctcgaccgcgaatacgtcgaccaccaccaccaccaccacaaagacgaactc

SEQ ID NO: 58693 - RNA, 840 nt, synthetic construct
  misc_feature 1..840: note = derived and/or modified sequence opt11 from anti-influenza_Chain
  source 1..840: mol_type = other RNA
atggcccaagtcggacgcggcgcctcacccctctcccgcgcacgagtccctcccctcccccaccccctagacggcgaacacctcccccacgatcccgcaggcggcggccacggcaaagcctcctcccaagacgcacccgtcggccaactccccggccacctagcccgcccagccttcttccactacctgaaaaactcattcctcgtctgctcacttaccaccgtcttcgcactcgcagtcgccaccttcgccggctacgctctcgcccgcttccgtttccccggcgccgaactcttcggcggctcagtactcgttacccaagtcatcccaggcatccttttcctaatccccatctacatcatgtacatctacgtccaaaactgggtccgctccgcccttggcctcgaagtacgcctggtcggctcctacggcggcctcgtattcacttacaccgccttcttcgtccccctctccatctggatacttcgcggcttcttcgcctccattcccaaagaactcgaagaagccgccatggtcgacggcgccacccccttccaagccttccaccgcgtcatcctccccctcgcactccccggcctcgccgccacagccgtctacatcttcctcaccgcctgggacgaactcctcttcgcccaagtcctaaccaccgaagccacagccaccgtccccgtaggcatccgaaacttcgtcggcaactaccaaaaccgctacgaccttgtaatggccgccgccaccgtcgccaccctccccgtccttgtcttattcttcttcgtccaacgccaactcatacaaggactcaccgcaggagctgtcaaaggc

SEQ ID NO: 58694 - RNA, 840 nt, synthetic construct
  misc_feature 1..840: note = derived and/or modified sequence opt11 from anti-influenza_Chain
  source 1..840: mol_type = other RNA
atggcccaagtcggccgcggagcctcacccctatcccgcgcccgcgtaccacccctcccccaccccctcgacggcgaacacctcccccacgaccccgcaggcggcggccacggcaaagcctcatctcaagatgcccccgtcggccaactaccaggccacctcgcccgcccagccttcttccactacctcaaaaactccttcctcgtctgttccctcactacagtattcgccctcgccgtcgccaccttcgccggctacgccctcgcccgcttccgattccccggcgccgaactcttcggcggctccgtcctagtcacacaagtcatcccaggcatcctcttcctcatcccaatttacatcatgtacatatacgtccaaaactgggtccgatctgcactcggcctcgaagtacgcctcgtaggctcctatggcggactcgtcttcacctacaccgccttcttcgtcccactatccatatggatcctccgaggcttcttcgcctcaatcccaaaagaactcgaagaagccgcaatggtcgacggcgccacccccttccaagccttccaccgcgtcatcctccccctagccctccccggacttgccgcaaccgccgtctacatcttcctcaccgcctgggacgaactcctcttcgcacaagtcctaaccactgaagccaccgccaccgtccccgtcggaatccgcaacttcgtaggcaactaccaaaaccgatacgacctcgtcatggcagccgccaccgtagccacactccccgtcctcgtcctattcttcttcgtccaaagacaactcatccaaggcctcaccgccggcgccgtcaaaggc

SEQ ID NO: 58695 - RNA, 843 nt, synthetic construct
  misc_feature 1..843: note = derived and/or modified sequence opt11 from anti-influenza_Chain
  source 1..843: mol_type = other RNA
atggccgacaacatgaccaccacccaaatcgaagtcggccccggggccacaaacgccacaataaacttcgaagccggcatcctcgaatgctacgaacgcttctcgtggcaacgcgcactcgactacccaggccaagaccgactacaccgcctaaaacgcaaactggaaagccgaatcaaaacacacaacaaatcagaacccgaaaacaaacgaatgtccctcgaagaacgcaaagcaataggcgtcaaaatgatgaaagtcctgctattcatggacccaagcgcaggcatagaaggcttcgaaccatactgcgtaaaaaacccctcaaccagcaaatgccccaactacgactggacagactaccccccaacacccggcaaatacctcgacgacatcgaagaagaacccgaaaacgtagaccaccccatagaagttgtcctccgcgacatgaacaacaaagacgcccgccaaaaaataaaagacgaagtaaacacacaaaaagaaggaaaattccgactaaccatcaaaagagacatccgcaacgtcctaagcctccgagtactcgtcaacggaaccttcctaaaacacccaaacggagacaaaagcctaagcaccctccaccgcctaaacgcatacgaccaaaacggcggcctcgtagccaaactcgtagccacagacgaccgcaccgtcgaagacgaaaaagacggacaccgcatactcaacagcctattcgagcgcttcgacgaaggccacagcaaacccatccgcgccgccgaaaccgccgtcggagtcctcagccaattcggacaagaacaccgcctatccccagaagaaggcgacaac

SEQ ID NO: 58696 - RNA, 843 nt, synthetic construct
  misc_feature 1..843: note = derived and/or modified sequence opt11 from anti-influenza_Chain
  source 1..843: mol_type = other RNA
atggccgacaacatgaccacaacccaaatcgaagtcggacccggagccacgaacgcaaccataaacttcgaagcaggcatcctcgaatgctacgaaagattctcatggcaacgcgcactcgactacccgggccaagacagactccaccgtctaaaaagaaaactagaatcgcgaataaaaacacacaacaaatcagaaccagaaaacaaaaggatgtcactcgaagaaagaaaagcaatcggagtcaaaatgatgaaagtactcctgttcatggacccaagcgcaggcatagaaggattcgaaccctactgcgtaaaaaacccctcgacctcaaaatgcccaaactacgactggacagactaccccccaacccccggcaaatacctagacgacatcgaagaagaacccgaaaacgtagaccaccccatagaagtagtcctacgcgacatgaacaacaaagacgcacgccaaaaaataaaagacgaagtaaacacacaaaaagaaggaaaattccgcctgaccataaaaagggacatacgaaacgttctcagcctacgcgtcctcgtaaacggaacattcctaaaacacccgaacggagacaaaagcttaagcacactacaccgactaaacgcatacgaccaaaacggcggactcgtagccaaactcgtagccacagacgaccgcaccgtcgaggacgaaaaagacggccaccgcatactcaacagcctattcgagcgcttcgacgaaggccacagcaaacccatacgcgcagctgagaccgctgtcggggtcctgagccaattcggacaagagcacaggctctcacccgaagaaggggacaac

SEQ ID NO: 58697 - RNA, 858 nt, synthetic construct
  misc_feature 1..858: note = derived and/or modified sequence opt11 from anti-influenza_Chain
  source 1..858: mol_type = other RNA
atgtgtaccatgcccctgatgaagctaaagaaaatgatgaggagaacagcctttctcttgagcgtgctcataggctgtagcatgctcgggagcgatcgctcggacaaggcaccgcactgggaattggtctggagcgatgaatttgactatagcgggctcccggacccggaaaagtgggattacgacgtcgggggacatggctggggaaatcaagagctacaatactatacaagggccaggatcgagaacgcgagagtgggcgggggcgtgctcataatcgaggccaggcacgagccatatgaagggcgcgagtatacgagcgcgcgcttggtcacgagagggaaagcgagctggacctatggcaggttcgagatcagggccaggctcccgagcgggcgcgggacctggcccgcgatatggatgctgccagaccgacagacatacggatcggcatactggccagacaatggcgagatcgatatcatggaacatgtaggattcaaccccgatgtcgtgcacgggaccgtgcacacgaaagcgtacaatcacttgctcgggacccagcgcgggggctcaatcagagtaccgacagcacgcacggactttcacgtgtacgcgatcgagtggacgccagaggaaatacgctggttcgtggacgatagcctgtactatcgctttcccaatgaaaggctaacggacccggaagcggactggcgacattggccgttcgatcaaccgttccatctcataatgaatatcgcggtagggggagcatggggcgggcagcaaggggtcgatccagaggcctttcccgcgcaactggtcgtggactatgtcagggtctatagatgggtagag

SEQ ID NO: 58698 - RNA, 858 nt, synthetic construct
  misc_feature 1..858: note = derived and/or modified sequence opt11 from anti-influenza_Chain
  source 1..858: mol_type = other RNA
atgtgcaccatgcccctgatgaagctaaagaaaatgatgaggcgcacagcattcctcctaagcgtactaataggctgcagcatgctcgggagcgaccgatcggacaaggcaccgcactgggaattggtctggagcgacgagttcgactacagcgggctaccggacccagaaaagtgggactacgacgtcggaggacacggctggggaaaccaagaactccagtactacaccagggccaggatagaaaacgcgcgcgtaggcggaggcgtgctaataatcgaggcaagacacgagccctacgaagggcgagaatacaccagcgcgcgcttagtaacgagagggaaagcaagctggacctacggcagattcgagatcagggcaaggctaccaagcgggcgcgggacctggccagcgatctggatgctgccagaccgccagacctacggcagcgcatactggccggacaacggcgaaatagacataatggaacacgtcgggttcaacccagacgtcgtgcacggaacagtacacacgaaagcgtacaaccacctcctggggacccagcgcggaggctcaatccgggtcccgacagcgcgcacggacttccacgtgtacgcaatcgagtggacacccgaggaaatccgctggttcgtggacgacagcctgtactaccgattcccaaacgaaagactcacggacccggaagcggactggagacactggccgttcgaccaaccgttccacctcataatgaacatcgcagtcgggggagcgtggggcgggcagcaaggagtcgaccccgaagccttccccgcgcaactggtagtggactacgtccgggtataccgatgggtcgag

SEQ ID NO: 58699 - RNA, 900 nt, synthetic construct
  misc_feature 1..900: note = derived and/or modified sequence opt11 from anti-influenza_Chain
  source 1..900: mol_type = other RNA
aacgtacccgaatggagctacatagtcgaaaaagccaaccccgcaaacgacctctgctaccccggcaacttcaacgactacgaagaactcaaacaccttctctcacgcatcaaccacttcgaaaagatacaaggctacatccccgaagcaccccgcgacggacaagcctacgtccgaaaagacggcgaatgggtgctcctatcaaccttcctccgatcagacaaaacccacacatgcccaccctgccccgccccagaactactcggcggcccctccgtcttcctcttccctcccaaacccaaagacaccctcatgatctcccgcacccccgaagtaacctgcgtagtagtagacgtatcacacgaagaccccgaagttaaattcaactggtacgtagacggcgtcgaagtacacaacgccaaaactaaaccccgcgaagaacaatacaactccacctaccgcgtcgtctccgtcctcaccgtcctccaccaagactggctcaacggcaaagaatacaaatgcaaagtatctaacaaagccctccccgcccccatcgagaaaaccatctcaaaagccaaaggccaaccccgagaaccacaagtctacaccctcccaccctctcgagaagaaatgaccaaaaaccaagtatccctaacctgcctcgtcaaaggcttctacccctccgacatcgccgtcgaatgggaatccaacggccaacccgaaaacaactacaaaaccacccctcccgtcctcgactctgacggctcattcttcctctactccaaactcacagtcgacaaatctcgctggcaacaagggaacgtcttctcctgctccgtcatgcacgaagcccttcacaaccactacacccaaaaatccctgtccctatcccccggtaaa

SEQ ID NO: 58700 - RNA, 900 nt, synthetic construct
  misc_feature 1..900: note = derived and/or modified sequence opt11 from anti-influenza_Chain
  source 1..900: mol_type = other RNA
aacgtacccgaatggtcatacatcgtcgaaaaagcaaaccccgccaacgacctatgctacccaggcaacttcaacgactacgaagaattaaaacacctcctctcccgcatcaaccacttcgaaaaaatacaaggctacatcccagaagccccccgcgacggccaagcctacgtccgcaaagatggcgaatgggtcctactctcaaccttcctccgctccgacaaaacccacacctgccccccctgccctgcacccgaactcctaggcggcccctctgtcttcctcttcccacccaaaccaaaagacaccctcatgatctcccgcacacccgaagtcacctgcgtcgtcgtcgacgtatcccacgaagaccccgaagtcaaattcaactggtacgtcgacggcgtcgaagtacacaacgccaaaaccaaaccccgagaagaacaatacaactccacctaccgagtcgtctccgtactcaccgtcctccaccaagactggctaaacggcaaagaatacaaatgcaaagtctcaaacaaagccctccccgcccccatcgaaaaaaccatctccaaggcaaaaggacaaccccgagaaccccaagtatacaccctcccaccctcccgagaagaaatgaccaaaaaccaagtcagcctcacctgcctagtcaaaggcttctacccctccgacatcgccgtcgaatgggaatccaacggccaacccgaaaacaactacaaaaccaccccacccgtcctggactccgacgggtccttcttcctatactccaaactaaccgtcgacaaatcccgctggcaacaaggaaacgtcttctcctgcagcgtcatgcacgaagccctccacaaccactacacccaaaaatccctaagcctctcgccaggcaaa

SEQ ID NO: 58701 - RNA, 927 nt, synthetic construct
  misc_feature 1..927: note = derived and/or modified sequence opt11 from anti-influenza_Chain
  source 1..927: mol_type = other RNA
atggtcaaccgccgcgacctaataaaatggtcagccgtcgccctcggcgccggcgccggcctcgccggacccgcccctgcagcccacgccgccgacctcgaatgggaacaatacccagtacccgcagcccccggcggaaaccgctcatggcaactcctaccctcccactccgacgacttcaactacacaggcaaaccccaaaccttccgcggccgatggctcgaccaacacaaagacggctggtcaggccctgcaaactccctctactccgcccgacacagctgggtcgcagacggaaacctcatcgttgaaggccgcagagcccccgacggacgtgtctactgcggctacgtcacctccagaacacccgtcgaatacccactctacaccgaagtcctcatgcgcgtctccggactaaaactctcatccaacttctggctcctatcacgcgacgacgtcaacgaaatcgacgtcatagaatgctacggcaacgaatcactccacggaaaacacatgaacacagcctaccacatcttccaacgaaaccccttcacagaactagcacgatcccaaaaaggctacttcgccgacggctcctacggctacaacggcgaaaccggccaagtattcggcgacggcgccggacaacccctcctccgcaacggattccaccgctacggcgtccactggatctccgccaccgaatttgacttctacttcaacggccgcctcgtccgccgactcaaccgctcaaacgaccttcgcgacccccgctcccgtttcttcgaccaaccaatgcaccttatcctaaacaccgaatcccaccaatggcgcgtcgaccgcggcatcgaacccaccgacgcagaactcgccgacccatcaatcaacaacatctactaccgctgggtcagaacctatcaagccgtc

SEQ ID NO: 58702 - RNA, 927 nt, synthetic construct
  misc_feature 1..927: note = derived and/or modified sequence opt11 from anti-influenza_Chain
  source 1..927: mol_type = other RNA
atggtcaaccgccgtgacctcataaaatggtccgccgtcgccctcggcgccggagcaggcctcgccggacccgcgcccgccgcacacgccgccgacctcgaatgggaacaatacccagtacccgcagcccccggcggcaaccgcagctggcaactcctgccctcccactcagacgacttcaactacacaggcaaaccccaaaccttccgcggccgctggctcgaccaacacaaagacggctggtcaggccccgccaattccctctactccgcccgacactcctgggtcgccgacggcaacctcatagtcgaaggacgccgagcacccgacggacgagtatactgtggctacgtcacctccagaacacccgtcgaataccccctctacactgaagtcctcatgcgagtctccggactcaaactctccagcaacttctggctactatctcgcgacgacgtaaacgaaatcgacgtaatcgaatgctatggaaacgaatccctccacggcaaacacatgaacactgcctatcacatcttccaacgcaacccattcaccgaacttgcacgatcacaaaaaggatacttcgccgacggctcctacggctacaacggagaaaccggccaagtattcggtgacggcgcaggccaacccctcctccgaaacggcttccaccgatacggcgtccactggatctccgccaccgaatttgacttctacttcaacggaagattagttcgccgcctaaaccgctcaaacgacctccgagacccccgttccagattcttcgatcaacctatgcacctaatactaaacaccgaatcccaccaatggcgagtagaccgcggcatcgaacccacagacgccgaactagccgacccctccataaacaacatatactatcgctgggtccgcacctaccaagctgtc

SEQ ID NO: 58703 - RNA, 960 nt, synthetic construct
  misc_feature 1..960: note = derived and/or modified sequence opt11 from anti-influenza_Chain
  source 1..960: mol_type = other RNA
atctgtatcggctaccacgccaacaactctaccgaacaagtcgataccatcatggaaaagaacgtcaccgtcacccatgcccaggacatcctcgaaaaaacccacaacggcaaactctgcgacctagacggcgtcaaacccctcatcctccgagactgctccgtcgccggctggctcctaggcaatccaatgtgcgacgaattcatcaacgtcccagaatggtcctacatcgtcgaaaaagccaaccccgccaacgacctctgctacccaggaaacttcaatgattacgaagaactaaagcacctcctatcccgaatcaaccatttcgaaaaaatccaaatcatccccaaatcctcctggtccgaccacgaagcctcctccggagtctcctccgcatgcccctaccaaggcacaccctccttcttccgcaacgtcgtctggctcatcaaaaaaaacaacacctaccccaccatcaaacgctcctacaacaatacaaaccaagaggacctcctaatcctatggggaattcaccactccaacgacgccgccgaacaaacaaagctctaccaaaaccccaccacctacatctccgtcggcacctccaccctcaaccaacgactcgttcccaaaatagccacccggagcaaggtaaacggccaaaacggacgcatggacttcttctggaccatcctcaagcctaacgacgccatcaacttcgaatccaacggcaacttcatcgcccccgaatatgcctacaaaatcgtcaaaaaaggcgactccgctatcgtaaaatctgaagtcgaatacggcaactgcaacaccaaatgccaaacccccataggcgccataaactcctccatgcccttccacaacatccaccccctaaccatcggcgaatgccccaaatacgtaaaatccaacaaactcgtcctcgccaccggcctccgaaactcccccctc

SEQ ID NO: 58704 - RNA, 960 nt, synthetic construct
  misc_feature 1..960: note = derived and/or modified sequence opt11 from anti-influenza_Chain
  source 1..960: mol_type = other RNA
atctgcatcggataccacgccaacaactccaccgaacaagtcgacaccatcatggaaaaaaatgtcaccgtaacacacgcccaagacatcctcgagaaaacccacaacggcaaactctgcgacctcgacggagtcaaacccctcatcctacgcgactgctccgtagcaggatggctcctcggcaaccccatgtgcgacgaattcatcaacgtccccgaatggtcctacatcgtcgaaaaagccaaccccgccaacgacctctgctatcccggcaacttcaacgactacgaagaactcaaacacctcctctccagaatcaaccacttcgagaagatacaaataatccccaaatcatcctggtccgaccacgaagcctcctccggcgtctcatcagcatgcccctatcaaggcacaccctccttcttccgaaacgtcgtgtggctcatcaaaaaaaacaacacataccccaccatcaaacgctcatacaacaacaccaaccaagaagacctcctaatcctatggggcatccaccactcaaacgacgccgccgaacaaaccaaactctaccaaaacccaacaacctacatctccgtcggaacctccaccctaaaccaacgcctagtacccaaaatagccacccgctccaaagtcaacggacagaacggccgcatggacttcttctggacaatactcaaacccaatgacgccatcaacttcgaatccaacggcaacttcatcgccccagaatacgcctataaaatcgtcaaaaaaggcgactcagcaatcgtcaagtccgaagtagaatacggcaactgcaacaccaaatgccaaacccccataggcgccatcaactcctccatgcccttccacaacatacaccccctaacaatcggagaatgccccaaatacgtcaaatccaacaaactcgtcctcgcaaccggactacggaactccccccta

SEQ ID NO: 58705 - RNA, 960 nt, synthetic construct
  misc_feature 1..960: note = derived and/or modified sequence opt11 from anti-influenza_Chain
  source 1..960: mol_type = other RNA
atctgcatcggctatcacgcaaacaacagcaccgaacaagtcgacaccatcatggaaaaaaacgtcaccgtcacccacgcccaagacatcctcgaaaaaacacacaacggcaaactttgcgacctagacggcgtcaaacccctcatcctcagagactgcagcgtcgccggctggctcctcggcaacccaatgtgcgacgaattcatcaacgtccctgaatggtcatacatagtcgaaaaagccaaccccgcaaacgatctctgctacccaggcaacttcaacgactacgaagaactcaaacacctcctatcccgcataaaccacttcgaaaaaatccaaatcatccccaaatcctcctggtccgaccacgaagcatcctccggcgtctcctccgcctgcccctaccaaggcaccccatcattcttccgcaacgtcgtctggctcatcaaaaaaaacaacacctaccccaccatcaaacgctcctacaataacactaaccaagaagacctcctcatcctctggggaatccaccactccaacgacgccgccgagcaaaccaagctctaccaaaacccaacaacctacatctccgtaggaacctcaaccctcaaccaacgactagtacccaaaatagcaacccgctctaaagtcaacggccaaaacggacgaatggacttcttctggaccatattaaaacccaacgatgccatcaacttcgaatccaacgggaacttcatagcacccgaatacgcctacaaaatcgtaaaaaaaggcgacagcgccatagtcaaatccgaagtcgaatacggcaactgcaacaccaaatgccaaaccccaatcggcgccataaacagctccatgcccttccacaacatccacccactcacaatcggcgaatgcccaaaatacgtcaagtcaaacaaactcgtactcgcaaccggcctccgaaactccccactc

SEQ ID NO: 58706 - RNA, 978 nt, synthetic construct
  misc_feature 1..978: note = derived and/or modified sequence opt11 from anti-influenza_Chain
  source 1..978: mol_type = other RNA
acactctgcatcggctaccacgccaacaactccaccgacactgtcgacacagtcctagaaaaaaacgtcaccgtcacccacagcgtaaacctcctcgaagacaaacacaacggaaaactctgcaagctccgcggtgtcgcccccctccacctaggcaaatgcaacatcgcaggctggatactaggcaaccccgaatgcgaaagcctcagcacagcatcctcctggtcctacatagttgaaacatcctccagcgacaacggcacctgctaccccggcgacttcatcgactacgaagaactcagagaacaactatcctcagtcagctcattcgaacgcttcgaaatcttccccaaaacctcatcctggcccaaccacgactccaacaaaggtgtcacagccgcctgcccacacgccggcgccaaatccttctacaaaaacctcatatggctcgtcaaaaaaggaaactcataccccaaactctccaaatcctacatcaacgacaaaggcaaagaagtcctcgttctatggggcatacaccacccctccacctccgccgaccagcaaagcctctaccaaaacgcagacgcctacgtcttcgtaggcacctctcgctactctaaaaaattcaaacccgaaatagccatccgaccaaaagtccgcgaccaagaaggccgcatgaactactattggacccttgtagaacccggcgacaaaatcaccttcgaagccaccggcaaccttgtcgtcccccgctacgccttcgccatggaacgagacgccggcagcggcatcatcatctcagacacccccgtccacgactgcaacaccacttgccaaacccccaaaggcgccatcaacacctccctacccttccaaaacatacaccccataaccatcggcaaatgccccaaatacgtcaagtctaccaaactacgcctagcaacaggcctccgcaacgtcccctccatccaatcccgc

SEQ ID NO: 58707 - RNA, 978 nt, synthetic construct
  misc_feature 1..978: note = derived and/or modified sequence opt11 from anti-influenza_Chain
  source 1..978: mol_type = other RNA
accctctgcatcggctaccacgccaacaactccaccgacaccgtcgacaccgtcctcgaaaaaaacgtcaccgtcacccactcagtcaacctcctcgaagacaaacacaacggcaaactatgtaaactacgcggcgtagcccccctacacctcggcaaatgcaacatagccggctggatcctcggcaaccccgaatgcgaatccctctcaacagcctcctcctggagctacatcgtagaaacatcctcatccgacaacggcacctgctaccccggcgacttcatcgactacgaagaactcagagaacaactatcatcagtctcctcattcgaacgcttcgaaatcttccccaaaacatcctcctggcccaaccacgacagcaataaaggcgtcactgccgcctgcccccacgccggcgccaaatccttctacaaaaacctaatctggctcgtgaaaaaaggcaacagctatcccaaactctccaaatcttacatcaacgacaaaggcaaagaagtactcgtcctatggggcatccaccacccctccacctccgccgaccaacaatcactctaccaaaacgccgacgcctacgtatttgtcggcacctcccgctactccaaaaaattcaaaccagaaattgccatacgccccaaagtccgcgaccaagaaggccgcatgaactactactggaccctcgtcgaaccaggcgacaaaatcaccttcgaagccaccggaaacctcgtcgtaccccgatacgccttcgccatggaacgtgacgcaggatccggcatcatcatctccgacacccccgtccacgactgcaacaccacatgccaaacccccaaaggagccatcaacacctccctccccttccaaaacatccaccccatcaccatcggcaaatgccctaaatacgtcaaatccaccaaactccgcctagccaccggcctccgcaacgtcccctccatacaatcccgc

SEQ ID NO: 58708 - RNA, 960 nt, synthetic construct
  misc_feature 1..960: note = derived and/or modified sequence opt11 from anti-influenza_Chain
  source 1..960: mol_type = other RNA
atctgcatcggctaccacgccaacaactccaccgaacaagtagacaccatcatggaaaaaaacgtcacagtcacgcacgcccaagacatactcgaaaaaactcacaacggcaaactttgcgacctcgacggagtcaaacccctcatcctccgagactgctccgtagccggctggcttctcggcaacccaatgtgcgacgaattcataaacgtacccgaatggtcctacatcgtcgaaaaagcaaaccccgcaaacgacctctgctaccccggaaacttcaacgactacgaagaactgaaacacctcctctcccgaatcaaccacttcgaaaaaatccaaatcatccccaaaagcagctggagcgaccacgaagcctcctccggcgtgtcctccgcctgcccctaccaaggaaccccctccttcttccgaaacgtcgtctggctcataaaaaaaaacaacacctaccctaccatcaaacgctcctacaacaacaccaaccaagaagacctactcatcctctggggcatccatcacagcaacgacgccgccgaacaaaccaaactctaccaaaaccccacaacctacatctccgtaggcacctccaccctcaaccaacgactcgtccccaaaatcgccacccgatccaaagtcaacggccaaaacggccgcatggacttcttctggaccatcctcaaacccaacgacgccataaacttcgaatccaacggcaacttcatcgcccccgaatacgcctacaaaatcgttaaaaaaggcgactcagccatagtcaaatcagaagtcgaatacggcaactgcaacaccaaatgccaaacaccaatcggagcaataaactcctctatgcccttccacaatatacatccactcaccatcggcgaatgccccaaatacgtcaaatccaacaagctagtcctagccaccggcctccgaaatagccccctc

SEQ ID NO: 58709 - RNA, 990 nt, synthetic construct
  misc_feature 1..990: note = derived and/or modified sequence opt11 from anti-influenza_Chain
  source 1..990: mol_type = other RNA
atgtgctcctccatcccatccctaagagaagtcttcgccaacgacttccgcatcggcgccgcagtcaacccagtcacccttgaagcccaacaatcactcctcatccgccacgtcaactcactcaccgccgaaaaccacatgaaattcgaacacctacaaccagaagaaggccgcttcaccttcgacatagccatcaaatcatccacctccccattctcctcacacggcgtccgcggccacaccctagtatggcacaaccaaacaccatcatgggtcttccaagattcccaaggccacttcgtcggccgcgacgtcctcctcgaacgcatgaaatcccacatctccaccgtcgtccaacgctacaaaggtaaagtctactgctgggacgtcatcaacgaagccgtcgccgacgaaggctcagaatggctacgatcctccacttggagacaaatcataggcgacgacttcatccaacaggccttcctctacgcacacgaagccgaccccgaagccctcctgttctataacgactacaacgaatgcttccccgaaaaacgcgaaaagatctacacactcgtcaaaagcctacgcgacaaaggcatcccaatccacggcataggcatgcaagcccactggagcctcaaccgccccaccctcgacgaaatccgcgccgccatcgaacgctacgcatccctcggcgtaattctccacatcaccgaactcgacatctccatgttcgagttcgacgaccaccgaaaagacctcgccgcacccacaaacgaaatggtcgaacgccaagccgaacgctacgaacaaatcttcagcctcttcaaagaataccgagacgtcatccaaaacgtcacattctggggtatcgccgacgaccacacctggctcgaccacttccccgtccaaggccgcaaaaactggcccctactcttcgacgaacaacacaaccccaaacccgccttctggcgagtcgtcaacatc

SEQ ID NO: 58710 - RNA, 990 nt, synthetic construct
  misc_feature 1..990: note = derived and/or modified sequence opt11 from anti-influenza_Chain
  source 1..990: mol_type = other RNA
atgtgctcctccatcccctccctccgcgaagtcttcgccaacgacttccgcatcggcgcagccgtcaacccagtcaccctagaagcccaacaatcccttctcatccgccacgtcaattccctcaccgccgaaaaccacatgaaattcgaacacctacaacccgaagaaggcagattcaccttcgacatcgcaatcaaaagctcaacctcacccttctcatcccacggcgtccgaggacacaccctagtctggcacaaccaaacaccctcatgggtcttccaagactcccaaggacacttcgtcggcagagacgtcctactcgaacgcatgaaatcacacatctccaccgtcgtacaacgctacaaaggaaaggtctactgctgggacgtaatcaacgaagccgtagccgacgagggatccgaatggctccgctcatcaacctggcgccaaatcattggcgacgacttcatccaacaagcattcctctacgcccacgaagccgaccccgaagccctcctattctacaacgattacaacgaatgcttcccagaaaaacgcgagaaaatctacaccctcgtaaagtccctccgcgacaaaggcatccccatccacggcatcggcatgcaagcccactggtccctaaaccgccccaccctagacgaaatacgcgccgcaattgaacgctacgcctccctcggagtcatcctacacatcacggaactcgacatctccatgttcgagttcgacgaccaccgcaaagacctcgccgcccccaccaatgaaatggtcgaacgccaagccgaacgctacgaacaaatcttctccctattcaaagaataccgcgacgtcatacaaaacgttaccttctggggaatcgccgacgaccacacctggctcgaccacttccccgtacaaggccgcaaaaactggcccctactcttcgacgaacaacacaacccaaaacccgccttctggcgagttgtcaacatc

SEQ ID NO: 58711 - RNA, 1002 nt, synthetic construct
  misc_feature 1..1002: note = derived and/or modified sequence opt11 from anti-influenza_Chain
  source 1..1002: mol_type = other RNA
atgaaaaaccgcgtcatcagcctcctcatggcctccctgctcctagtcctcagcgtcatcgtcgcccccttctacaaagccgaagcagcaaccgtagtaaatacccccttcgtcgccgttttctccaacttcgactccagccagtgggaaaaagccgactgggccaacggctcagtattcaactgcgtatggaaaccctcccaagtcaccttctccaatggcaaaatgatcctcaccctagaccgcgaatacggcggctcttacccatacaaaagcggagaataccgcacaaaatccttcttcggttacggctactacgaagtccgcatgaaagcagctaaaaacgtcggcatcgtctcctccttcttcacctacaccggaccctccgacaacaacccctgggacgaaatagacatagaatttctaggcaaagacaccaccaaagtccaattcaactggtacaaaaacggcgtcggcggcaacgaatacctccacaacctcggcttcgacgcctcccaagacttccacacctacggcttcgaatggcgcccagactacatcgacttctacgtcgacggcaagaaagtctaccgaggcacccgtaacatccccgtaacccccggaaaaatcatgatgaacctctggccaggcatcggcgtcgacgaatggctcggccgatacgacggaagaaccccactccaagccgaatacgaatacgtcaaatactatccaaacggagtcccccaagacaaccccacccccaccccaaccattgccccctccacacccacaaaccccaacctccccctcaaaggagacgtcaacggcgacggccacgtcaacagctcagactactccctattcaaacgctaccttctccgcgttatcgaccgattccccgtcggcgaccaatccgtcgcagacgtcaaccgagacggacgcatcgactccactgacctcacgatgctcaaacgctacctaatccgcgccatccccagcctc

SEQ ID NO: 58712 - RNA, 1002 nt, synthetic construct
  misc_feature 1..1002: note = derived and/or modified sequence opt11 from anti-influenza_Chain
  source 1..1002: mol_type = other RNA
atgaaaaaccgcgtcatctcacttctaatggcctccctactcctagtcctatccgtcatcgtagcccccttctacaaagccgaagccgccacagtcgtcaacaccccattcgtcgcagtcttctcaaacttcgacagctcacaatgggaaaaagccgactgggccaacggatcagtcttcaattgcgtatggaaaccatcccaagtcaccttctcaaacggcaaaatgatcctaaccctcgaccgtgaatacggaggctcctacccctacaaatcaggtgaataccgcaccaaatccttcttcggctacggctactacgaagtccgaatgaaagccgccaaaaacgtaggcatcgtctcatccttcttcacctacaccggccccagcgacaacaacccctgggacgaaatcgacatcgagttcctaggcaaagacaccacaaaagtacaattcaactggtacaaaaacggagtcggcggcaacgaatacctccacaacctaggcttcgacgcatcccaagacttccacacctacggcttcgaatggcgccccgactacatagacttctacgtcgacggcaagaaagtctaccgaggcacccgaaacataccagtaaccccaggcaaaatcatgatgaacctctggcccggaatcggcgtcgacgaatggctcggccgatacgacggccgcacacccctccaagcagaatacgaatacgtcaaatactaccccaacggcgtcccccaagacaaccccaccccaacccccaccattgccccctccacccccaccaaccccaacctcccactcaaaggcgacgtcaacggcgacggacacgtcaactcatccgactactctctattcaaacgctacctcctccgcgtaatcgaccgattcccagtcggagaccaatcagtcgccgacgtcaaccgcgacggccgcatcgactcaaccgacctaaccatgctcaaacgctacctcatccgcgccataccatcactc

SEQ ID NO: 58713 - RNA, 1041 nt, synthetic construct
  misc_feature 1..1041: note = derived and/or modified sequence opt11 from anti-influenza_Chain
  source 1..1041: mol_type = other RNA
atctgcatcggctaccacgctaacaactccaccgaacaagtcgacaccatcatggaaaaaaacgtaacagtaacacacgcccaagacattctagaaaaaacccacaacggcaaactctgcgacctcgacggcgtcaaacctctcatcctccgagactgctcagtcgccggctggctcctcggaaacccaatgtgcgacgaattcataaacgtccccgaatggtcctacatagttgaaaaagctaaccccgccaacgacctatgctacccaggcaacttcaacgactacgaagaacttaaacacctactaagcagaatcaaccacttcgaaaaaatccaaatcatccccaaatcatcttggtcagaccacgaagcatcatcaggcgtctcctccgcatgcccctaccaaggcaccccctccttcttccgcaacgtagtctggctcatcaaaaaaaacaacacataccctaccatcaaacgctcatacaacaacaccaaccaggaagacctcctcatcctatggggcatacaccactccaacgacgccgccgaacaaaccaaactctaccaaaaccccaccacctacatctccgtcggcacatccaccctcaaccaacggctcgtccccaaaatcgccactcgctccaaagtcaacggacaaaacggccgcatggacttcttctggactatcctaaaacccaacgacgccatcaacttcgaaagcaacggaaacttcatcgcccccgaatacgcctacaaaatcgtcaaaaaaggcgattcggcaatcgtcaaatccgaagtcgaatacggaaactgcaacaccaaatgccaaacccccatcggcgccataaactcctccatgcccttccacaacatacatccactcacaatcggcgaatgccccaaatacgtcaaatcaaacaaactcgtcctcgccactggcctccgcaactccccactcggatacatccccgaagccccccgcgacggccaagcatacgtcagaaaagacggcgaatgggtcctactttccacattccta

SEQ ID NO: 58714 - RNA, 1041 nt, synthetic construct
  misc_feature 1..1041: note = derived and/or modified sequence opt11 from anti-influenza_Chain
  source 1..1041: mol_type = other RNA
atctgcataggctaccacgccaacaactccaccgaacaagtcgacaccatcatggaaaagaacgtaaccgtaacccacgcccaggacatactcgagaaaacccacaacggcaaactatgcgacctcgacggcgtcaaaccccttattctccgcgactgctccgtcgccggctggctcctcggcaatccaatgtgcgacgagttcatcaacgtcccagaatggtcctacatcgtcgaaaaagccaaccccgccaacgacctatgctaccccggcaacttcaacgactacgaagaactaaaacacctcctctcccgaatcaaccacttcgagaaaatccaaatcatcccaaaatcctcctggtcagaccatgaagcatcctccggcgtctcaagcgcctgcccctaccaaggcaccccctcctttttccgaaacgtcgtctggctcatcaagaaaaacaacacctaccccaccataaaacgcagctacaacaacaccaaccaagaagacctactcatactctggggaatccaccactcaaacgacgccgcagaacaaactaaactataccaaaatcccaccacctacatctccgtcggcacctccaccctcaaccaacgccttgtcccaaaaatcgccacccggtcgaaagtaaacggccaaaacggccgcatggacttcttctggaccatcctaaaacccaacgacgccataaacttcgaatccaacggcaacttcatcgccccagaatacgcatacaaaatcgtaaagaaaggcgactccgccatcgtcaaatcagaagtcgaatacggcaactgcaacactaaatgtcaaaccccaatcggagccatcaactcctctatgcccttccacaacatccatccactcaccatcggcgaatgtcccaaatacgtaaaatcaaacaaactcgtcctagccaccggcctccgtaacagccccctcggctacatccctgaagcaccccgagacggccaagcctacgtccgcaaagacggcgaatgggtcctcctctccacattctta

SEQ ID NO: 58715 - RNA, 1047 nt, synthetic construct
  misc_feature 1..1047: note = derived and/or modified sequence opt11 from anti-influenza_Chain
  source 1..1047: mol_type = other RNA
atgaacatcaaaaagacagcagtcaaaagtgcactcgccgtagcagccgcagccgcagccctaaccacgaacgtgagcgcgaaagacttctcgggcgcagaactgtacacactagaggaagtacaatacggaaaattcgaagccagaatgaaaatggcggcagcgagcggaacagtgagctcaatgttcctataccaaaacggctcagagatcgcagacggcagaccctgggtagaagtagacatagaagtcctaggcaaaaacccgggatcattccaaagcaacataataacaggaaaagcaggcgcacaaaagacatcggaaaaacaccacgcagtaagcccggccgccgaccaagcattccacacatacggactcgaatggacgcccaactacgtgcgctggacagtagacggacaagaagtcagaaaaacagaagggggccaagtatcaaacctaaccgggacccaaggcctacgcttcaacctgtggtcgagcgagagtgcagcctgggtcggccaattcgacgaaagcaaactaccactattccaattcatcaattgggtaaaagtgtacaaatacacaccaggacaaggagaaggaggatcggacttcaccttagactggacagacaacttcgacacattcgacggctcgcggtggggaaaaggcgactggacatttgacggcaaccgcgtagacctaaccgacaaaaacatctacagtcgagacggaatgttaatactagcactaaccagaaaaggacaagagagctttaacggacaagtaccaagggacgacgaaccggccccacaatcgagctcaagcgcacccgcgagctcaagctcagtcccggcctccagctcaagcgtaccagcaagctcaagctcagcattcgtcccgcccagcagctcaagcgcgaccaacgccatacacgggatgaggaccacaccagcagtcgcgaaagaacacaggaacctagtcaacgccaaaggagcaaaagtcaacccgaacggccacaaaagataccgagtgaacttcgaacac

SEQ ID NO: 58716 - RNA, 1047 nt, synthetic construct
  misc_feature 1..1047: note = derived and/or modified sequence opt11 from anti-influenza_Chain
  source 1..1047: mol_type = other RNA
gaagtccaactcgtcgaatccggaggcggcgtagtccaacccggacgctccctacgcctatcatgcgcagcctcaggcttcgccttccacaaccgcgccatgcactgggtacgccaggcccccggcaaaggcctcgaatgggtagcccttatctacttcgacggatccaaacaatactacgcagactcagtcaaaggccgattcaccatatcccgcgacaactccaaaaacaccgtcttcctacaaatgaactcactacgcccagaagacaccgccgtatactactgcgcagtcccaggacccatcttcggaatcttccccccatggagctacttcgaccactggggccaaggcatccttgtcaccgtcagctcggcctccaccaaaggcccctccgtgttccccttagccccatcctccaaaagcacctccggcggaaccgccgccctaggctgcctcgtcaaagactacttccccgaacccgtcactgtctcctggaactccggagccctcacctcaggcgtccacaccttccctgccgtcctacaatcctccggcctttactcactctcctcagtcgttaccgtcccctcttcctcactcggcacccaaacctacatctgcaacgtaaaccataaaccctccaacaccaaagtcgacaaaaaagtcgaacccaaaagctgcgacaaaacccacacatgccccccctgccccgcccccgaactcctcggcggcccctccgtcttcctcttccccccaaaacccaaagatacactcatgatctcccgaaccccagaagtcacctgcgtcgtcgtcgacgtctcacacgaagaccccgaggtcaaattcaactggtacgtcgacggagttgaagtccacaacgcaaaaaccaaaccacgcgaagaacaatataactccacatacagagtcgtctccgtcctcaccgtcctccaccaagactggctcaacggcaaagaatacaaatgcaaagtctccaacaaagccctacccgcccccatagaaaaaaccatctccaaagccaaaggc

SEQ ID NO: 58717 - RNA, 1047 nt, synthetic construct
  misc_feature 1..1047: note = derived and/or modified sequence opt11 from anti-influenza_Chain
  source 1..1047: mol_type = other RNA
gaagtccaacttgtcgaatcaggcggaggcgtagtccaacccggccgatcactccgcctctcctgcgcagcctctggcttcgccttccacaaccgcgccatgcactgggtccgacaagcccccggcaaaggactcgaatgggtcgccctaatctacttcgacggctccaaacaatactacgcagactccgtcaaaggaagattcacaatttcccgagacaactccaaaaacaccgtattcctacaaatgaactcactccgcccagaagacaccgccgtatactactgcgccgttccaggccccatcttcggaatattccctccctggagctacttcgaccactggggccaaggcatacttgtaaccgtttcctccgcctctaccaaaggcccctctgtattcccactcgccccctcctccaaatccacctctggcggcaccgctgcacttggctgcctcgtcaaagactacttccccgaacccgtaaccgtctcctggaactccggcgcactcacctcaggcgtacacaccttccccgccgtcctccaatccagcggactatactccctctcctcagtcgtcaccgtaccatctagctcactcggcacccaaacctacatctgcaacgtcaaccacaaaccctccaacaccaaagtcgacaagaaagtagaacccaaatcctgtgacaaaacccacacctgtccaccctgccccgcccccgaactcctcggcggcccctccgtcttcctgttccctcccaaacccaaagacaccctcatgatctcccgcacccccgaagtaacctgcgtcgtagtcgacgtctcccacgaagatcccgaagtcaaattcaactggtacgtagacggcgtcgaagtccacaacgccaaaacaaaaccccgcgaagaacaatacaacagcacctaccgtgttgtctcagtactcacagtcctacaccaagactggctaaacggcaaagaatacaaatgcaaagtatcaaacaaagccctccccgcccccatcgaaaagaccatatcaaaagccaaagga

SEQ ID NO: 58718 - RNA, 1047 nt, synthetic construct
  misc_feature 1..1047: note = derived and/or modified sequence opt11 from anti-influenza_Chain
  source 1..1047: mol_type = other RNA
atgaacatcaagaaaaccgccgtaaaaagcgccctagccgtcgccgccgccgcagccgccctcaccaccaacgtctccgccaaagatttctccggcgccgaactatacactctcgaagaagtacaatacggaaaattcgaagcccgcatgaaaatggccgccgcctctggcaccgtctcttccatgttcctataccaaaacggcagcgaaatcgccgacggacgcccctgggtcgaagtcgacattgaagtcctaggcaaaaaccccggctccttccaaagcaacataatcacaggcaaagccggcgcacagaaaacctccgaaaagcaccacgccgtctcacccgccgccgaccaagcattccacacctacggcctcgaatggacccccaactacgtccgatggacagtagacggacaagaagtccgcaaaaccgaaggcggccaagtatcaaacttaacaggcacccaaggcctacgattcaatctctggtcatccgaatcagccgcatgggtcggccaattcgacgaaagcaaattaccactcttccaattcatcaactgggtaaaagtctacaagtacacccccggccaaggcgaaggcggatctgacttcacactcgactggaccgacaacttcgacaccttcgacggctcacgatggggcaaaggcgactggacattcgacggaaaccgcgtcgacctaaccgacaaaaacatatactcccgagacggcatgctcatcctcgcactcacccgcaaaggccaagaatcattcaacggccaagtaccacgcgacgacgaacccgcaccccaaagcagctcctccgcccccgccagctcctcctcagtcccagcatcctcaagctccgtacccgcaagctcctcctccgccttcgtcccaccctcctcctcctcagccacgaacgcaatccacggaatgcgaacaacacccgcagtcgccaaagaacaccgcaacctcgtcaacgctaaaggagcaaaagtcaaccccaacggacacaaacgctaccgcgtaaacttcgaacac

SEQ ID NO: 58719 - RNA, 1161 nt, synthetic construct
  misc_feature 1..1161: note = derived and/or modified sequence opt11 from anti-influenza_Chain
  source 1..1161: mol_type = other RNA
atgaacaaattcctcaacaaaaagtggtccctcatcctaaccatgggcggcatcttcctcatggccaccctatccctaatcttcgccaccggaaagaaagccttcaacgaccaaacctcagccgaagacatcccctccctcgcagaagccttcagagactacttccccatcggcgcagccatcgaacccggctacacaaccggccaaatcgccgaactatacaagaaacacgtcaacatgctagtcgccgaaaacgcgatgaaacccgcctccctacaacccaccgaaggcaacttccaatgggccgacgcggaccgcatagtccaattcgcaaaagaaaacggaatggaactgcgattccacactctcgtctggcacaaccaaacccccaccggcttctccctcgacaaagaaggaaaacccatggtcgaagaaacagacccccaaaaacgcgaagaaaaccgtaaactcctcctccaacgcctcgaaaactacatccgcgccgtcgtcctcagatacaaagacgacatcaaatcctgggacgtagtcaacgaagtcatcgaacccaacgaccccggaggcatgagaaactctccatggtaccaaataaccggcaccgagtacatcgaagtcgcattccgcgccacccgagaagccggcggctccgacatcaaactctacataaacgactacaataccgacgaccccgtaaaaagagacatcctgtacgaactcgttaaaaacctcctcgaaaaaggcgtccccatcgacggagtaggccaccaaacacacatcgacatctacaatccccctgtcgaacgcatcatcgaaagcatcaagaaattcgcaggccttggcctcgacaacatcatcacagaactggacatgtccatctactcctggaacgaccgctccgactacggcgactcaatccccgactacatcctcaccctccaagccaaacgataccaagaactattcgacgccctcaaagaaaacaaggacatcgtctcagccgtagtcttctggggcatatccgacaaatactcctggctaaacggcttcccagtcaaacgaaccaacgcaccactccttttcgaccgcaacttcatgcccaaacccgccttctgggccatcgtcgacccctcccgcctcagagaa

SEQ ID NO: 58720 - RNA, 1161 nt, synthetic construct
  misc_feature 1..1161: note = derived and/or modified sequence opt11 from anti-influenza_Chain
  source 1..1161: mol_type = other RNA
atgaataaatttctcaacaaaaagtggtctctcatcctcaccatgggcggtatcttcctcatggccaccctctccctcatcttcgcaaccggcaagaaagccttcaacgaccaaacctccgcggaagacatcccctccctcgcagaagccttccgcgactatttccccatcggagccgcaatcgaacccggctacacaacaggacaaatcgcagaactctacaagaaacacgtcaacatgctcgtagcagaaaacgccatgaagcctgcatccctccaacccaccgaaggcaacttccaatgggccgacgccgaccgcatcgtccaattcgccaaagaaaacggcatggaactgcgcttccacaccctagtctggcacaaccaaacacctacaggattctcacttgacaaagaaggaaaacccatggtcgaagagaccgacccccagaaaagagaagaaaacaggaaactactcctgcaaagactagagaactacatccgcgcagtcgtcctccgctacaaagacgacatcaaatcctgggacgtcgtcaacgaagtcatcgaacctaacgaccccggcggcatgagaaacagcccctggtaccaaatcaccggaacagaatacatcgaagtcgccttccgagcaacccgcgaagccggcggatccgacattaaactctacatcaacgactacaacaccgacgaccccgtcaaacgcgacatcctatacgaacttgtcaaaaacctactcgaaaaaggagtcccaatcgacggagtcggccatcaaacccacatcgacatatacaacccacccgtcgaacgcatcatcgaatccatcaagaaattcgccggcctcggcctagacaacatcatcaccgaactcgacatgtcaatctacagctggaacgaccgatcagactacggagactccatccccgactacattctgactctacaagcaaaacgctaccaagaactattcgacgcgctaaaagaaaacaaagacatagtcagcgccgtcgtcttctggggcatatccgacaaatacagctggctaaacggcttccccgtcaaacgcacaaacgcacccctcctcttcgaccgcaacttcatgcccaagcccgccttttgggccatcgtcgacccatcccggctccgcgaa

SEQ ID NO: 58721 - RNA, 1221 nt, synthetic construct
  misc_feature 1..1221: note = derived and/or modified sequence opt11 from anti-influenza_Chain
  source 1..1221: mol_type = other RNA
atgcgtaacgtcgtcagaaaaccactaaccatcggcctcgcactcaccctcctactcccaatgggcatgacagccacgtcagccaaaaacgccgacagctacgcaaagaaaccccacatctccgccctcaacgcaccccaactagaccaacgctacaaaaacgagttcaccataggcgcagccgtagaaccgtaccaactacaaaacgaaaaagacgtccaaatgcttaaacgccacttcaactcgatcgtagccgaaaacgtcatgaaacccatcagcatacaacccgaagaaggcaaattcaacttcgaacaagccgaccgtatagtcaaattcgcaaaagccaacggcatggacatacgattccacaccctagtatggcattcccaagtcccgcaatggttcttcctagacaaagaaggtaagcccatggtcaacgaaacagacccagtcaaacgcgaacaaaacaaacagctcctcctaaagcgcctcgaaacacacataaaaaccatcgtagaacgatacaaagacgacatcaaatactgggacgtcgtcaacgaagtcgtaggcgacgacggaaaactgcgaaactccccatggtaccaaatcgcaggcatcgactacatcaaagtagcattccaagccgcgcgcaaatacggcggagacaacataaaactctacatgaacgactacaacacagaagttgaacccaaacgcaccgctctctacaacctcgtaaaacaactaaaagaagagggcgtaccaatcgacggaataggccaccaatcacacatccaaatcggctggccctccgaagccgaaatcgagaaaaccattaacatgttcgctgccctcggcctcgacaaccaaatcacagaactcgacgtctcaatgtacggctggccaccccgcgcataccccacctacgacgccatccccaaacaaaagttcctcgaccaagccgcacgctacgaccgactattcaaactctacgaaaaactctcggacaaaatcagcaacgtcaccttttggggaatcgccgacaaccacacctggctcgacagccgcgccgacgtctactacgacgccaacggcaacgtcgtagtagacccaaacgcgccatacgccaaagtcgaaaaaggcaaaggcaaagacgcaccattcgtcttcggccccgactacaaagtaaaaccagcgtactgggccatcatcgaccacaaa

SEQ ID NO: 58722 - RNA, 1221 nt, synthetic construct
  misc_feature 1..1221: note = derived and/or modified sequence opt11 from anti-influenza_Chain
  source 1..1221: mol_type = other RNA
atgcgaaacgtcgtacgcaagccgctaaccatcggcctcgcgctaacgctactcctaccaatgggcatgacagccacctctgcgaaaaacgccgacagctacgccaagaaaccgcacatctccgcactaaacgccccacaactagaccagcgctacaaaaacgagttcaccatcggagcagccgtggaaccctaccaactacaaaacgaaaaagacgtccaaatgctcaagcgccacttcaactccatagtcgcagaaaacgtaatgaagcccatcagcatccaaccggaagaaggcaaattcaacttcgaacaagcagatcgaatcgtcaaattcgcaaaagcaaacggcatggacatacgcttccacaccctagtctggcacagccaagtcccccaatggttcttcctcgacaaagaaggaaaacccatggtcaacgaaacagaccccgtcaagcgcgaacaaaacaaacaactcctactcaaacgcctcgaaacacacatcaaaaccatcgtcgaaagatacaaagacgacatcaaatattgggacgtcgtcaacgaagtagtcggagacgacggcaaacttcgcaacagcccctggtaccaaatagccggaatcgactacatcaaagtagccttccaagcagcccgcaagtacggaggcgacaacataaaactctacatgaacgactacaacaccgaagtcgaaccaaagcgcacagcactctacaacctcgtcaaacaactcaaagaagaaggcgtccccatcgacggaatcggccaccaaagccacatacaaatcggctggccgagcgaagccgaaatcgagaaaacaatcaacatgttcgccgcactaggcctcgacaaccagatcaccgaactagacgtctcaatgtacggctggcccccaagggcctacccaacctatgacgccataccaaaacaaaagttcctggaccaagccgcacgctacgaccgtctcttcaaactatatgaaaaactgagcgacaaaatatccaacgtaacattctggggcatcgccgacaaccacacctggctcgactcccgcgcagacgtatactacgacgccaacggcaacgtcgtcgtagaccccaacgccccctacgccaaggtcgaaaaaggaaaaggcaaggacgccccattcgtcttcggcccagactacaaagtcaaacccgcatactgggccataatcgaccacaaa

SEQ ID NO: 58723 - RNA, 1233 nt, synthetic construct
  misc_feature 1..1233: note = derived and/or modified sequence opt11 from anti-influenza_Chain
  source 1..1233: mol_type = other RNA
ctctcccgcatcaaccacttcgaaaaaatacaaataataccaaaatcatcctggagcgaccacgaagcctcatccggagtatccagcgcctgcccataccaaggcaccccctccttcttccgtaacgtagtctggctaatcaaaaaaaacaacacatacccaacaatcaaacgcagctataacaacaccaaccaagaagacctcctaatcctctggggcatccaccactccaacgacgccgccgaacaaacgaaactgtaccaaaacccaaccacatacatatccgtcggcacatccactctcaaccaacgcctcgtccctaaaatcgcaacgcgctccaaagtcaacggccaaaacggccgcatggactttttctggaccatccttaaacccaacgacgcaataaacttcgaatccaacggcaacttcatcgcaccagaatacgcctacaaaatcgtcaaaaaaggctacatccccgaagccccccgcgacggtcaggcatacgtccgaaaagacggtgaatgggtcctcctctccacatttctacgatccgacaaaacccacacctgccccccctgcccagccccggagcttctaggcggcccctccgtcttcttgttcccccccaaaccaaaagacaccctaatgatatcccgcacacccgaagtcacatgcgtcgtcgtcgacgtaagccacgaagaccccgaagtaaaattcaactggtacgtcgacggcgtagaagtccacaacgccaaaaccaaaccccgcgaagaacaatacaactccacctaccgcgtcgtttcagtcttaaccgtcctccaccaagactggcttaacggcaaagaatacaaatgcaaagtatcaaacaaagccctgcccgcccccatcgagaaaacaatctccaaagccaagggccaaccacgcgaaccccaagtctacacactcccaccctcacgcgaagaaatgaccaaaaaccaagtaagtcttacctgccttgtcaaaggcttctacccctccgacatcgccgttgaatgggaaagcaacggccaacccgagaacaactacaaaaccacgccccccgtactcgactcagacggatccttcttcctctactctaaactcaccgtcgacaaatcccgctggcaacaaggtaacgttttctcatgctcagtcatgcacgaagccctgcacaaccattacacccagaaatccttatccctatcccccggcaaa

SEQ ID NO: 58724 - RNA, 1233 nt, synthetic construct
  misc_feature 1..1233: note = derived and/or modified sequence opt11 from anti-influenza_Chain
  source 1..1233: mol_type = other RNA
ctctcacgcatcaaccacttcgagaaaatacaaataatccccaaatctagctggtccgaccacgaagcctcatccggcgtatcctccgcctgcccctaccaaggtaccccctcattcttccgcaacgtcgtctggcttatcaaaaagaacaacacctaccccaccatcaaaagatcctacaacaacaccaaccaagaagacctgctcatactctggggcatacaccactccaacgacgccgccgaacaaaccaaactataccaaaaccccaccacctacataagcgtcggaacaagcacactaaaccaacgcctagtccccaaaatcgccacccgctcaaaagtcaacggacagaacggccgcatggacttcttctggacaatcctcaaacccaacgacgcgatcaacttcgaatccaacggcaacttcatcgcaccagaatacgcttacaaaatcgtcaagaaaggctacatccccgaagccccacgcgacggccaggcctatgtccgaaaagacggcgaatgggtcctcctctcaaccttcctccgatccgacaaaacccacacatgcccaccctgccccgcccccgaactacttggcggcccaagcgtctttctcttcccacccaaacccaaagacaccctaatgatttcacgaacccccgaagtaacctgcgtcgtcgtcgacgtcagccacgaagaccccgaagtaaaattcaactggtacgtagacggcgtcgaagttcacaacgccaaaaccaaaccccgggaagaacaatacaactcgacctacagagtagtctccgtcctaaccgtcctccatcaagactggctaaacggaaaagaatacaaatgcaaagtttcaaataaagccctccccgcccccatcgagaaaacaatctcaaaagccaaaggacagccgcgcgaaccacaagtctacaccctcccaccctcccgtgaagaaatgaccaaaaaccaagtctccctcacatgcctcgtcaaaggcttctacccatccgacatcgccgtcgaatgggaatcaaacggccaacccgaaaacaactacaaaaccactccacccgtactcgactcagacggctcctttttcctatactccaaattaaccgtcgacaaatcacgatggcaacaaggcaacgtcttctcctgctccgtcatgcacgaagccctgcacaaccactacacccagaaaagcctctcactctcccccggcaaa

SEQ ID NO: 58725 - RNA, 1293 nt, synthetic construct
  misc_feature 1..1293: note = derived and/or modified sequence opt11 from anti-influenza_Chain
  source 1..1293: mol_type = other RNA
atggacgaccacgcagaaaaattcctctggggcgtagccaccagcgcctaccaaatcgaaggcgccacccaagaagacggccgaggaccatccatatgggacgccttcgcaagacgacccggcgccatcagagacggctccacaggcgaacctgcctgcgaccactacagacgctacgaagaagacatcgcactgatgcaatcacttggagtcagagcctaccgcttctccgtcgcctggcccagaatcctgcccgaaggccgaggccgtattaacccaaaaggcctcgccttctacgaccgactcgtagaccgcctgctagcgagcggtatcacacccttccttaccctctaccactgggacctccccctcgccctagaagaacgcggaggctggcgatcccgtgaaaccgccttcgccttcgctgaatacgcagaagccgtagccagagccctagccgaccgcgtacccttctttgccactctcaacgaaccatggtgctcagccttcctcggccactggaccggcgaacacgcaccgggactacgcaacctagaagccgccctcagagccgcccaccacctacttctcggccacggtctcgcagtcgaagcactccgggccgccggcgcacgacgagtcggcatagtcctaaacttcgctcccgcctacggcgaagacccagaagcagtagacgtagcagacaggtaccacaaccgctacttcctcgaccccatactcggcaaaggctaccccgaatcacctttccgagacccaccacccgtccccatcctctcacgagaccttgagctagttgcaagaccccttgacttcctcggcgtcaactactacgcccccgtccgcgtcgccccaggaaccggaaccctaccagtccgctacctcccacccgaaggccccgccacagccatgggctgggaagtgtaccccgaaggcctccaccacctactaaaacgactcggccgcgaagtcccctggccactctacgtaaccgaaaacggcgccgcctaccctgacctttggacaggagaagccgtagtcgaagacccagaacgggtcgcctacctcgaagcccacgttgaagccgccctacgagcccgagaagaaggcgtagacctccgcggatacttcgtctggtccctaatggacaacttcgaatgggcattcggatacacccgccgcttcggactctactacgtcgacttcccctcccaacgccgcatacccaagcgctcagccctctggtaccgcgaacgaattgcccgagcacaaacc

SEQ ID NO: 58726 - RNA, 1293 nt, synthetic construct
  misc_feature 1..1293: note = derived and/or modified sequence opt11 from anti-influenza_Chain
  source 1..1293: mol_type = other RNA
atgacagaaaacgccgagaaattcctctggggcgtagccaccagcgcataccaaatcgaaggagccacacaagaagacggccgcggacccagcatatgggacgccttcgcccaacgacccggcgcaataagagacggctccaccggagaacccgcctgcgaccactacagacgatacgaagaagacatcgcactcatgcaatcactaggagtccgcgcataccgcttctcagtagcctggccacgcatcctacccgagggtcgaggcagaatcaaccccaaaggactagcattctacgaccgcctcgtcgaccgactactcgccagcggaatcacacccttccttaccctctaccactgggacctacccctggccctagaagaacgcggcggctggagatcgagagaaaccgcattcgcattcgcagaatacgcagaggccgtagcacgcgccctggccgaccgagtcccattcttcgcaacactaaacgaaccatggtgctcagccttcctcggccactggaccggcgaacacgccccaggattacgcaacctcgaggccgcactccgagccgcccaccacctcctcctaggccatggcctagcagtagaagcactgcgagcagcaggcgcaagacgagtaggaatagtcctcaacttcgcaccagcatacggagaggacccagaagcagtcgacgtcgcagacagataccacaaccgattcttcctagacccaatactaggaaaaggctacccagaaagccccttccgagacccacccccagtcccaatcctctcgagagacctcgagctagtagcccgccccctcgacttcctgggtgtcaactactacgcccccgtcagagtcgcacccggaaccggcaccctcccagtacgctacctcccaccagagggcccagccacggccatgggttgggaagtataccccgaagggctctaccacctcctaaaacgactaggcagagaagtaccctggcccctatacgtaaccgaaaacggagccgcatacccggacctatggacaggcgaagccgtggtcgaagaccccgaaagagtcgcatacctagaagcccacgtcgaagccgccctacgcgcaagagaagaaggagtcgacctccggggatatttcgtctggtcactcatggacaacttcgaatgggcattcggctacacccgccgattcggcctatactacgtagacttcccctcccaaagacgaatccccaaaagatcagccctctggtaccgcgaacgcatagcccgagcccaaaca

SEQ ID NO: 58727 - RNA, 1293 nt, synthetic construct
  misc_feature 1..1293: note = derived and/or modified sequence opt11 from anti-influenza_Chain
  source 1..1293: mol_type = other RNA
atggcagaaaacgccgaaaaattcctctggggcgtcgccacaagcgcctaccaaatcgaaggagcaacccaggaagacggtcgaggccccagcatctgggacacattcgcacgacgccccggcgccatcagggacggaagcactggagaaccagcatgcgaccactaccaccgatacgaagaagacatcgcactaatgcaatccctcggggtaggcgtctaccgcttctcagtcgcatggccacgaatactacccgaaggacgcggccgcataaaccccaaaggccttgccttctacgaccgtctagtcgacagactgctagcagccggcatcacacccttcctcacgctctaccactgggacctgcctcaagccctcgaagaccgcggcggctggagaagcagagaaacagcattcgccttcgctgaatatgccgaggccgtcgccagagccctcgcagacagagtaccattctttgccacactcaacgaaccctggtgctcagctttcctcggtcattggacaggcgaacacgccccaggcctaagaaacctcgaagccgctctccgcgccgcacaccacctcctcctcggacacggcctcgccgtcgaggccttacgcgccgccggcgccaaacgcgtcggcatagtcctcaacttcgcaccagtatacggcgaagacccagaagcagtagacgtagcggaccgttaccacaacagatacttcctcgaccccatcctcggccgcggctaccccgaatccccattccaagatcccccgcctactcccaacttatcccgcgacctcgaactcgtggcacgacccctagactttttaggagtaaactactacgccccagtccgcgtcgcccctggtaccggacccctccccgtacgctatctacccccagaaggcccagtcacagcgatgggctgggaagtgtaccccgaaggcctctaccacctactcaaaagacttggacgggaggtcccatggccactgtacatcaccgaaaacggagcagcataccccgacctatggaccggagaagccgtcgtcgaagacccagaacgcgtagcctatctggaagcccacgtagaagccgccctacgcgcccgcgaagaaggcgtcgacctccgaggctacttcgtatggtcactcatggacaacttcgaatgggcattcggatacacccgccggttcgggctctactacgtcgactttccctcacaacgacgaatcccaaaacgctccgcactatggtatcgagaacgaatagccagagcacaactc

SEQ ID NO: 58728 - RNA, 1293 nt, synthetic construct
  misc_feature 1..1293: note = derived and/or modified sequence opt11 from anti-influenza_Chain
  source 1..1293: mol_type = other RNA
atggacgaccacgcagaaaaattcctctggggagtagccaccagcgcgtaccaaatcgaaggcgccacccaagaagacggcagaggcccaagcatctgggacgcattcgcccggcgcccaggcgcaatcagagacggctccacaggagagcccgcatgcgaccactaccgacgatacgaagaagacatcgcactcatgcaatccctcggagtcagagcctaccgattcagcgtagcatggccacgaatcctgccggaaggacgcggcagaatcaaccccaaaggcctcgccttctacgaccgcctagtcgaccgactgctcgccagcggaatcacaccattcctcacactataccactgggacctacccctggccctagaagaacgaggtggctggcgatcacgcgaaacagcattcgcattcgccgaatacgcagaggccgtcgcacgcgccctagccgaccgcgtacccttctttgcaacattaaacgaaccttggtgcagcgccttcctcggccactggaccggggaacacgcccccggcctacgcaatctcgaggccgcactgagggccgcgcaccacctcctactcggccacggactcgcagtagaagccctccgagccgccggagcaagacgcgtcggcatagtcctaaacttcgcccccgcctatggcgaagacccagaagcagtcgacgtcgcagaccgctaccacaacagatacttcctagaccccatactgggaaaaggctacccggaatcacccttccgagacccaccacccgtccccatcctatcacgagatctggagctagtagcacgcccactcgactttcttggagtcaattactacgctccagtcagagtcgcccccggaacaggaacactgcccgtacgatacctcccgcccgaaggccccgcaacagccatgggctgggaagtctaccccgaaggactacaccacctcctaaaacgcctcggaagagaagtcccctggcccctctacgtcacagaaaacggcgccgcatatccagacctctggacaggagaagcagtcgtagaagaccccgaacgagtcgcctacctggaagcacacgtagaagcagcactacgagcccgcgaagaaggcgtcgacctacgcggctacttcgtatggtcactcatggacaacttcgaatgggcattcggctacacaagacgattcggcctctactacgtagacttcccctcacaacgacgcatacccaaacgatcagctctatggtacagagaaagaatagcccgggcccaaacc

SEQ ID NO: 58729 - RNA, 1293 nt, synthetic construct
  misc_feature 1..1293: note = derived and/or modified sequence opt11 from anti-influenza_Chain
  source 1..1293: mol_type = other RNA
atgacagaaaacgccgaaaaattcctctggggcgtcgccacctccgcataccaaatcgaaggcgcaacacaagaagacggccgcggcccctccatttgggacgccttcgcccaaagacctggagccatacgcgacggcagcaccggcgaaccagcatgcgaccactacagaagatacgaagaagacatagctctcatgcaatccctcggagtacgcgcataccgcttctccgtcgcctggccccgcatcctccccgaaggacggggacgcataaacccaaagggcctagccttctacgaccgcctagtagaccgcctcctcgcaagcggcatcacaccattcctaacgctctaccactgggacctaccactggcccttgaagaacgcggcggctggcgctcccgcgaaacagcattcgccttcgcagaatacgccgaagccgtagcacgagcacttgccgaccgagttccctttttcgccaccctcaacgaaccctggtgctcagcattcctcggacactggaccggagaacacgcccccggcctccgcaacctcgaagccgccctacgtgcagcccaccacctcctattaggacacggacttgccgtcgaagccctacgcgctgccggagcacgacgcgtcggtatcgtccttaacttcgctccagcctacggcgaagaccccgaagccgtagacgtcgccgaccgctaccacaaccgattcttcctcgaccccatactcgggaaaggatacccagaatcgcccttcagagatcccccacccgtacccatcctatcccgcgacctagagctcgtcgcccgccccctcgacttcctcggcgtcaactactacgcccccgtaagagtcgcacccggaaccggcaccctccccgtccgctatctcccacccgagggaccagccacggccatgggctgggaagtatacccagaaggactctaccacctactcaaacgcctcggtcgagaagtcccatggcccctctacgtcacagaaaacggcgccgcctatccagacctatggaccggcgaagcagtagtagaagaccccgagcgagttgcatacctagaggcacacgtagaagcagccctaagagcccgagaagaaggcgtcgacctacgaggctatttcgtctggtcactcatggacaacttcgaatgggccttcggctacacacgccgcttcggactttactacgtcgacttcccatcacaacgacgcatacccaaaagatcagccttatggtaccgagaacgcatagcccgcgcccagaca

SEQ ID NO: 58730 - RNA, 1293 nt, synthetic construct
  misc_feature 1..1293: note = derived and/or modified sequence opt11 from anti-influenza_Chain
  source 1..1293: mol_type = other RNA
atggcggaaaacgccgaaaaattcctgtggggagtcgccacatccgcataccaaatcgaaggagcaacacaagaagacggccgcggccccagcatctgggacacctttgcacgccgccccggcgcaatccgcgacggctccaccggcgaaccagcatgcgaccactaccaccgctacgaagaagacatcgcactcatgcaatccctcggcgtcggagtctaccgattctccgtagcatggccccgaatcctacccgaaggaagaggccgaatcaaccccaaaggacttgccttctacgaccgccttgttgatcgcctactcgccgcaggaataacccctttcctcaccctataccactgggacttaccccaagcactggaagaccgcggcggctggcgcagccgcgaaaccgccttcgccttcgctgaatacgccgaagcagtcgcccgagccctagcagacagagtaccattcttcgccaccctcaacgagccctggtgctcagccttccttggacactggaccggagaacacgcacccggcctccgaaacctcgaggccgcactaagggccgcccaccacctactcctaggccatggcctcgccgtcgaagccctccgagcagccggagcaaaacgcgtcggaatcgtcctaaacttcgcccccgtatacggcgaagaccctgaagcagtcgacgtcgccgacaggtaccacaaccgctacttcctcgacccaatactaggccgaggataccccgaatcccccttccaagatccacctcccacccccaacctctcccgcgacctcgaacttgtagctcggcccctcgacttcctaggcgtcaactactacgccccagtcagagtcgcccccggcacaggaccactcccagtccgatacctcccacccgaaggccccgtaacggccatgggctgggaagtctacccagaaggcctctaccacctcctaaaacgccttggccgcgaagtcccttggcccctctacatcaccgaaaacggagccgcatacccagacctctggaccggcgaagccgtcgttgaagaccccgaaagagtcgcctacctcgaagcacacgtagaagccgcattacgcgcccgcgaagaaggagtcgacctccggggctacttcgtctggagcctaatggacaacttcgaatgggccttcggatacacacgacgcttcggcctctactatgtagacttcccctcccaacgcagaataccaaaacgatctgccctatggtaccgcgaacgaatcgcccgcgcacaactc

SEQ ID NO: 58731 - RNA, 1296 nt, synthetic construct
  misc_feature 1..1296: note = derived and/or modified sequence opt11 from anti-influenza_Chain
  source 1..1296: mol_type = other RNA
atgttcaagcccaactaccacttcttccccataaccggctggatgaacgatcccaacggactgatcttctggaaaggcaagtaccacatgttctaccaatacaaccccagaaagccagaatggggcaacatctgctggggacacgccgtctcagacgacctcgtccactggcgccacctcccagtagcactatatcccgacgacgagacccacggcgtcttctcgggctcagcagtggaaaaagacggaaaaatgttcctcgtatatacctactaccgagacccaacccacaacaaaggcgaaaaagagacccagtgcgtggccatgagcgaaaacggactcgacttcgtaaaatacgacggaaacccagtcatcagcaaacccccagaagagggcacacacgcattccgggacccaaaagtaaacaggagcaacggcgagtggcgaatggtcctcggaagcggaaaagacgaaaagatcggacgcgtgctcctatacacgagcgacgacctattccactggaaatacgaaggtgtcatcttcgaagacgaaacaaccaaagaaatagaatgcccagacctagtacgaatcggcgaaaaagacatactaatctacagcataacctcaaccaacagcgtgctattcagcatgggcgaactcaaagaaggaaaactaaacgtagaaaaacgaggactcctagaccacggcacggacttctacgcagcacaaaccttcttcgggaccgaccgcgtagtcgtcatcggatggctacaatcgtggctccgaacgggcctgtacccgacaaagcgcgaaggctggaacggggtcatgagcctacccagggaactatacgtcgaaaacaacgaactcaaagtcaagcccgtagacgaactcctagccctacgcaagcgcaaagtcttcgaaacagccaaaagcgggaccttcctcttagacgtcaaagaaaactcatacgaaatcgtgtgcgagttctcaggcgaaattgaactcaggatgggcaacgaaagcgaagaagtagtcataaccaaatccagagacgaactcatagtcgacaccacacgtagcggcgtatccggaggcgaagtccggaaatcaaccgtagaagacgaagcaaccaaccgcatccgcgcgttcctagactcgtgcagcgtcgagttcttcttcaacgactccatcgcattctcattccgcatccaccccgagaacgtatacaacatcctgagtgtcaaatccaaccaggtcaaacttgaagtattcgaactcgaaaacatctggctc

SEQ ID NO: 58732 - RNA, 1296 nt, synthetic construct
  misc_feature 1..1296: note = derived and/or modified sequence opt11 from anti-influenza_Chain
  source 1..1296: mol_type = other RNA
atgttcaaacccaactaccacttcttccccatcaccggatggatgaacgaccccaacggactgatattctggaagggaaagtaccatatgttctaccagtacaaccccaggaaaccggaatggggaaacatatgctgggggcacgcggtctccgacgacctcgtgcactggcgacacctcccggtcgcgctataccccgacgacgaaacccatggcgtgttctcaggctcggccgtagaaaaggacggaaaaatgttcctagtctacacctactacagagacccaacccacaacaagggcgaaaaagagacccagtgcgtagcaatgagcgaaaacgggctcgacttcgtgaaatacgacggaaacccggtaataagtaagccgcctgaagagggcacccacgcattcagagacccgaaagtaaacagaagcaacggcgaatggaggatggttctcggaagcgggaaagacgagaagatcggacgcgtgctactgtacaccagtgatgacctgttccactggaagtacgaaggcgtgatcttcgaagacgaaacgaccaaagagatagaatgtcccgacctagtacgaataggcgagaaagacatcctaatctacagcatcacctcaaccaacagcgtcctcttcagcatgggcgagctcaaagaagggaaactgaacgtggaaaaacgagggctcctagaccacggaacagacttctacgcggcccagaccttcttcggcacagaccgcgtggtggtgatcgggtggctacaatcgtggctccgcactggcctgtacccgaccaagcgcgaaggctggaacggggtcatgagcttgcccagagaactatacgtggaaaacaacgagctgaaggtcaaacccgtggacgagctcttagcactgcgcaagcgcaaggtattcgaaacagcaaagagcgggaccttcctcctcgacgttaaagaaaactcgtacgagatcgtatgtgagttctcaggcgaaatagagctccgaatggggaacgagagcgaggaagtggtcatcacaaaaagcagggacgaactaatagtcgacaccacgcgctcgggcgtaagcggaggcgaagtaagaaaatccaccgtagaagacgaagcaaccaaccgcatccgcgcattcctcgactcctgctcagtcgagttcttcttcaacgacagcatagcattctcattcaggatacaccctgagaacgtgtacaacatcctaagcgtgaaatcaaaccaagtaaaattagaagtcttcgaactagaaaatatctggctc

SEQ ID NO: 58733 - RNA, 1323 nt, synthetic construct
  misc_feature 1..1323: note = derived and/or modified sequence opt11 from anti-influenza_Chain
  source 1..1323: mol_type = other RNA
gaagtcaaactcgttgaatccggaggcggcctcgttcaacccggaggcagcctccgcctaagctgcgccacctccggcttcacattctccgactactacatgtcctgggtacgccaatcccccggaaaagccctcgaatggttaggattcacccgctcccgagtcctcggctacaccacagactactccgcctcagttaaaggccgcttcaccatctcccgcgacaacagccaaagcatcctatacctacaaatgaactccctgcgcggagaagacagcgccacatactactgcgcccgagaccgacctatggactactggggccaaggcacatccgtcaccgtaagctcagccaaaaccaccccaccctccgtctaccccctagccccaggctcagccgcccaaactaactccatggtcaccctcggctgcctcgtcaaaggatacttcccagaaccggtcactgtcacatggaactcaggctctctcagctccggcgtccacaccttcccagccgtcctacaatccgacctatacaccctatccagctcagtcacggtaccttcttcaacctggccatccgaaaccgttacctgcaacgtcgctcacccagcgtccagcactaaggtcgacaagaaaatagtcccccgcgactgcggttgcaaaccctgcatctgcactgtccccgaggtctcaagcgtattcatcttccctcccaaacccaaagacgtcctaaccattactctaacgcccaaagtaacctgcgtcgtcgtcgacatctcaaaagacgacccagaagtccagttttcatggttcgttgacgacgtagaagtccacaccgcccaaacccaaccacgcgaagaacaattcaactccaccttccgttccgtctccgaactcccaatcatgcaccaagactggctaaacggcaaagaatttaaatgccgtgtaaactcagccgcattccccgccccgatcgagaaaacaatctccaaaaccaaaggccgacctaaagcgccccaagtctacaccatacccccacccaaagaacaaatggccaaagacaaagtctcacttacctgcatgataacagacttctttcccgaagacataaccgtcgaatggcaatggaacggccaacccgccgaaaactacaaaaacacccaaccaataatggacaccgacggtagttacttcgtatactccaaactcaacgtacaaaaatccaactgggaagccggcaacacctttacctgctcagtactccacgaaggactccataaccaccacaccgaaaaatccctctcacactccccaggaaaa

SEQ ID NO: 58734 - RNA, 1323 nt, synthetic construct
  misc_feature 1..1323: note = derived and/or modified sequence opt11 from anti-influenza_Chain
  source 1..1323: mol_type = other RNA
gaagtcaaactcgtcgaatccggcggcggtctcgtccaacccggaggctcactccgcctctcatgcgccacctctggcttcaccttcagcgactactacatgtcctgggttcgccaatcccccggcaaagccctcgaatggcttggcttcacccgctccagagtactcggctacaccactgactactccgcctccgtcaaaggacgattcacaatctccagagacaactcacaatcaatcctctacctccagatgaactcccttagaggcgaagactccgccacatactactgcgcccgcgaccgtcccatggactactggggccaaggcacctccgtcaccgtctcctcagccaaaacaaccccaccctcagtctaccccctcgcccccggatcagccgcacaaaccaactccatggtgacccttggatgcctcgtcaaaggatacttccccgaacccgtcacagtcacctggaactccggctccctctcatccggcgtccacaccttcccagccgtcctccaatcagacctctacaccctatcctcctcagtaaccgtcccatccagcacctggccctcagaaaccgtcacatgtaacgtcgcccacccagcctctagcacaaaagtagacaagaaaatcgtcccccgcgactgcggttgcaaaccttgcatttgcacagtccccgaagtatcctcagtcttcatcttcccacccaaacccaaagacgttttaacaataacactcacccccaaagtcacctgtgtagtcgtcgatatctccaaagacgaccccgaagtccaattctcctggttcgtggacgacgtcgaagtccacaccgcccaaacccaaccccgagaagaacaattcaactccaccttccgttccgtttccgaactacccatcatgcaccaagactggctcaacggcaaagagttcaaatgccgcgtcaactcagccgccttccccgccccaatcgagaaaaccatatcaaaaacaaaaggccgacccaaagcaccccaagtttatactataccaccacccaaggaacaaatggccaaagacaaagtctcactcacatgcatgatcactgacttcttccccgaagacatcacagtagaatggcaatggaacggccaacctgccgaaaactacaaaaacactcaacccatcatggacacagacggatcctatttcgtctactccaaactcaacgtccaaaaatccaactgggaagccggcaacacattcacatgctcagtactacacgagggcctccacaaccaccacaccgaaaaatccctatcacactctcccggcaaa

SEQ ID NO: 58735 - RNA, 1329 nt, synthetic construct
  misc_feature 1..1329: note = derived and/or modified sequence opt11 from anti-influenza_Chain
  source 1..1329: mol_type = other RNA
gaagtccaactacaacaatcaggacccgaactcgtcaaaccaggcgcctcagtaaaaatgtcctgcaaagcatccggctacaccttcacctcctacgtcatgcactgggttaaacaaaaacccggccaaggactcgaatggatcggctacatcaacccctacaatgacggcacccgatacaatgaaaaattccgagtaaaagccaccctcacctcagacaaaagctcctcaaccgcctacatggaactctctagcctaacctcagaagactccgccgtctactactgcgcccgccgcggcctcatcaccacccccaccctcgactactggggccaaggcacaaccctcaccgtctcctccgcaaaaaccacacccccatccgtataccccctagcccccggctcagcagcccaaaccaactccatggtgaccctcggctgcctagtcaagggatacttccccgaacccgttaccgtaacatggaactccggctcactaagctcaggcgttcacaccttccccgccgtactccaaagcgacctctacaccctatcaagctccgtcaccgttccctcctccacctggccaagcgaaaccgtaacctgcaacgtcgcccaccccgcctcatcaacaaaagtcgacaagaaaatcgtcccccgagactgtggatgcaaaccctgcatctgcacagttcccgaagtctcctcagttttcatcttcccacccaaaccaaaagacgttctcaccataaccctaacccccaaagtaacctgcgtcgttgttgacatctccaaagatgaccccgaagtccaattcagctgggtcgacgacgtcgaagtacacaccgcccaaacccaaccccgcgaagaacaattcaactctaccttccgatccgtctccgaactacccataatgcaccaagactggctcaacggcaaagagttcaaatgccgcgtcaactccgccgcattcccagccccaatagaaaagaccatctctaaaaccaagggacgccccaaggccccacaagtctacacgatacccccacccaaagaacaaatggccaaagacaaagtctccctaacctgcatgatcaccgacttcttccccgaagacataaccgtcgaatggcaatggaacggccaacccgccgaaaactacaaaaacacacaacccatcatggacaccgacggcagctacttcgtctactccaaactaaacgtccaaaaatccaactgggaagcgggcaacacattcacatgctccgtactacacgaaggcctccacaaccaccacaccgaaaaatccctctcacactcccccggaaaa

SEQ ID NO: 58736 - RNA, 1329 nt, synthetic construct
  misc_feature 1..1329: note = derived and/or modified sequence opt11 from anti-influenza_Chain
  source 1..1329: mol_type = other RNA
gaagtacaactccaacaatcaggaccagaactcgtcaaacccggcgcatccgtcaaaatgtcctgcaaagcctcaggatacaccttcacatcctacgtcatgcactgggtcaaacaaaaacccggccaaggactagaatggataggatacataaacccctacaacgacggcacacgctacaacgaaaaattccgcgtcaaagcgacactaacctccgacaagtcctcatccaccgcctacatggaactctcctccctaacctctgaagatagcgccgtatactactgcgcccggcgcggccttataaccacacccaccctcgactactggggccaaggcacaacgctaaccgtctcctccgccaaaacaacaccaccctccgtctaccccctcgcccccggcagcgccgcccaaaccaactccatggtcaccctcggctgcctcgttaaaggatacttccccgaaccagtcacagtcacctggaacagcggcagcctctccagcggcgtccacaccttccccgctgttctccaatccgacctctataccctctcctcaagcgtaaccgtcccctcatccacctggccctcagaaacagtcacatgcaacgtagctcacccagcaagctccaccaaagtagataagaaaatagtaccacgcgactgcggttgcaaaccatgcatctgcaccgtccccgaagtgtcctccgtattcatcttcccacccaaacccaaagacgttctcaccatcacactcacccccaaagtcacttgcgtagtcgtagatatctccaaagacgaccccgaagtccaattctcatgggtcgacgacgtcgaagtacacaccgcacaaacccaaccccgagaagaacaattcaacagcaccttccgctccgtctccgaactccccatcatgcaccaagactggctcaacggcaaagagttcaaatgccgggtcaactcagccgccttccccgctccaatcgaaaagaccatctccaaaaccaaaggaagaccaaaagcaccccaagtatacaccatcccacccccaaaagaacaaatggccaaagacaaagtatcactcacatgcatgatcaccgacttcttccccgaagacatcaccgtcgaatggcaatggaacggccaaccagccgaaaactacaaaaacacccaaccaatcatggacaccgacggatcctacttcgtctactccaaactaaacgtccaaaaatccaactgggaagccggcaacacctttacctgctccgtactccacgaaggtctccacaaccaccacacagaaaaatccctatcccactcacccggaaaa

SEQ ID NO: 58737 - RNA, 1332 nt, synthetic construct
  misc_feature 1..1332: note = derived and/or modified sequence opt11 from anti-influenza_Chain
  source 1..1332: mol_type = other RNA
aacgtaccagaatggtcctacatcgtagaaaaagccaatccagctaatgacctctgctaccccggcaatttcaacgactacgaggaactaaaacacctattgtcccgcatcaaccacttcgagaaaatccaaataatccccaaatcctcctggtcggaccacgaagcctcctccggcgtcagctccgcctgcccctaccaaggcaccccctcattcttccgcaacgtagtctggctcatcaagaaaaacaacacctaccccaccatcaaacgctcctacaacaacaccaaccaagaagatctactcatcctctggggcatccaccactcaaacgacgccgccgaacaaaccaaactctaccaaaacccaaccacctacatatccgtcggaacctcaaccctaaaccaacgcctcgtacccaaaatcgccacacggagcaaagtcaacggccaaaacgggcgcatggatttcttctggaccatcctcaaacccaacgacgccatcaactttgaatccaacggcaacttcatagcccccgagtacgcctataaaatagtcaagaaaggatacatcccagaagccccacgcgacggccaagcctacgtccgcaaagacggcgaatgggtcctgctctcaaccttcctccgctcagacaaaacccacacttgccctccctgccccgcccccgaactcctcgggggcccctccgtcttcctatttccacccaaacccaaagacacccttatgatctcccgcacccccgaagtaacctgcgtcgtcgtagacgtaagccacgaagaccccgaagtaaaatttaactggtacgtcgacggcgtcgaggttcacaacgcaaaaaccaaaccccgagaagaacaatacaacagcacctaccgcgtagtctcagtactcaccgtcctacaccaagactggctcaacggaaaagaatacaaatgcaaagtctccaacaaagcactccccgccccaatcgagaagaccatctccaaagcaaaaggacaaccacgcgaaccccaagtttacaccctccctccctcccgcgaagaaatgaccaaaaaccaagtctcactgacctgcctcgttaaaggattctacccctccgacatcgccgtcgaatgggaatccaacggccaacccgaaaacaactacaaaaccacaccacccgtcctcgactccgacggctcctttttcctctactcaaaactcaccgtagacaaatcacgctggcaacaaggaaacgttttctcctgctccgtcatgcacgaggccctacacaaccactacacccaaaaatccctctccttatcacccggcaaa

SEQ ID NO: 58738 - RNA, 1332 nt, synthetic construct
  misc_feature 1..1332: note = derived and/or modified sequence opt11 from anti-influenza_Chain
  source 1..1332: mol_type = other RNA
aacgtcccagaatggtcatatatcgtcgaaaaagccaaccctgcaaacgacctctgctacccaggcaactttaatgactacgaagaactcaaacacctcctctcacgaattaaccacttcgagaaaatccaaatcatcccaaagtcctcctggagcgaccacgaagcatcctccggcgtctcctcggcctgcccataccaaggcacaccctcattcttccgaaacgtagtatggctcatcaagaaaaataacacataccccactatcaaacggagctacaacaacaccaaccaagaagaccttctcatcctctggggtatccaccactccaacgatgccgccgaacaaacaaaactctaccaaaatcccaccacctacatctccgtcggaacttccacactcaaccaacgactcgtacctaagatcgctacccgatccaaagtcaacggacaaaacggacgcatggacttcttctggacaattcttaaacctaacgacgccatcaatttcgaatccaacggcaacttcatcgcccccgaatacgcctacaaaatcgtaaagaaaggctacatacccgaagcaccccgcgacggccaagcctacgtccgcaaagacggcgaatgggtccttctctccacattcctacgttccgacaaaacccacacatgcccaccctgccccgcccctgaactactcgggggcccttcagtattcctattcccacccaaacccaaagacacactaatgatatcccgcacccccgaagtaacctgcgtcgtcgtcgacgtcagccacgaagaccccgaagtcaaattcaactggtacgtcgacggcgttgaagtacacaacgccaaaaccaaaccccgcgaagaacaatataacagcacctaccgcgtcgtctcagtattaactgtcctccatcaagactggctcaacggcaaagaatacaaatgcaaagtctcaaacaaagccctaccagcaccaatcgagaaaaccatctccaaagccaaaggccagccccgcgaaccacaagtatacacgctcccacccagccgcgaagaaatgaccaaaaaccaagtttcactgacatgcctcgtcaaaggcttctacccctcagacatcgccgtcgaatgggaatcaaacggccaacccgaaaacaactacaagaccaccccacccgtcctcgactccgatggcagcttcttcctctactcaaaactaacagtagacaaatccagatggcaacaaggcaacgtcttctcttgctccgtaatgcacgaagcactgcacaaccactacactcagaaaagcctatccctctcccccggaaaa

SEQ ID NO: 58739 - RNA, 1341 nt, synthetic construct
  misc_feature 1..1341: note = derived and/or modified sequence opt11 from anti-influenza_Chain
  source 1..1341: mol_type = other RNA
caagtccaactacaagaaagcggacccggacttgtcaaacccagtgaaaccctatcactaacctgcaccgtctccggcggactcataggcaccggttcatactactggggatggattcgccaaacccccggaaaaggcatggaatggatcggctccatctcctactccggctcaacctactaccacccctccctcaaatcccgcgtaaccataagcgacgacacatccaaaaatcaactgttcctaaaacttagatccgtcaccgcagcagacaccgcccaatactactgcgcgcgctacaactggggcatccgatacttcgacttctggggtcgaggcaccctagtcaccgtatccagcgcatccaccaaaggccccagcgtgttccccctcgccccctgctcccggagcacttccgaatccaccgccgcactcggctgcctagtaaaagactacttccccgaacccgtcaccgtctcatggaactcaggcgccctcacctccggcgtacacactttcccagccgtccttcagtcctcaggcctatactcactctcatccgtagtcacagtcccctccagcagcctcggcaccaaaacatatacctgcaacgtagaccacaaaccctccaacacaaaagtcgacaaaaccagagaatcaaaatacggcccaccctgcccctcttgccccgcacccgagttcctcggcggtccctccgtcttcctctttcccccaaaacccaaagacaccctcatgatctcccgcacccccgaagttacctgcgtcgtcgtcgacgtctctcaagaagaccccgaagtacaattcaactggtacgtcgacggtgttgaagtccacaacgcaaaaacaaaaccgagagaagaacaattcaactcaacctaccgcgtcgtctccgtcctaacagttctccaccaagattggctcaacggtaaagaatacaaatgtaaagtatcaaacaaaggactcccctcctctatagaaaagaccatatcaaaagctaaaggccagcccagagaaccccaagtgtacacactacctcccgcccaagaagaaatgaccaaaaaccaagtctccctaacctgcctagtcaaaggcttctacccctccgacatagcagtcgaatgggaaagcaacggccagcccgaaaacaactacaaaaccaccccgcccgtactcgactcagacggctcctttttcctctactcgcgcctcaccgtcgacaaatctcgctggcaagaaggcaacgtcttctcctgctccgtaatgcacgaagccctccacaaccactacacccaaaaatcgctatcactctctctcgggaaa

SEQ ID NO: 58740 - RNA, 1341 nt, synthetic construct
  misc_feature 1..1341: note = derived and/or modified sequence opt11 from anti-influenza_Chain
  source 1..1341: mol_type = other RNA
caagtccaactccaagaatcaggcccaggcctcgtcaaaccctccgaaaccctctccctcacctgtaccgtctcaggcggactgatcggcaccggatcctactactggggctggatccgacaaacccccggcaaaggaatggaatggattggctccatctcctactccggctccacctattaccacccctccctaaaatcacgtgtcactatctcagacgacacctccaaaaaccaattattcctcaaactacgctcagtcaccgccgccgataccgcccaatactactgcgcccgctacaactggggcatccgctatttcgacttctggggccgtggaaccctcgtcaccgtatcctcagcatccaccaaaggcccctcagtcttccccctcgcaccctgctctagatcaacatccgaatccacagccgccctcggatgcctagtaaaagactatttcccagaacctgtcaccgtctcctggaatagcggcgcactcacctccggcgttcacaccttccccgcagtcctccagtcctccggcctgtattccctctcctccgtcgtcaccgtaccatcctcctccctaggcaccaaaacatatacctgcaacgtcgaccacaaaccctccaacaccaaagtagacaaaacacgagaatccaaatacggcccaccctgcccctcctgccccgccccagagttcctcggcggcccctccgttttcctcttcccacccaaacccaaagacaccctcatgatatcccgcacaccagaagtcacatgcgttgtcgtcgacgtatcccaagaagacccagaagttcaatttaactggtacgtcgacggagtcgaagtccacaatgcaaaaacaaaaccccgagaagaacaattcaactccacatacagagtagtctccgtcctgaccgtcctccatcaagactggctcaacggaaaagaatacaaatgcaaagtctccaacaaaggactcccctcatccatcgaaaagaccatctccaaagccaaaggccaaccacgagaaccccaagtatacacactcccgcccgcgcaagaagaaatgaccaaaaaccaagtctccctaacttgcctcgtcaaaggcttctacccctcagacatagccgttgaatgggaatccaacggtcaacccgaaaacaactacaaaaccaccccaccagtcctcgactccgacggctcctttttcctctactcgcgactcaccgtcgataaatcccgctggcaagaaggcaacgtattctcctgctccgtcatgcacgaagccctccacaaccactacacccaaaaatccctctccctctcactcggcaaa

SEQ ID NO: 58741 - RNA, 1344 nt, synthetic construct
  misc_feature 1..1344: note = derived and/or modified sequence opt11 from anti-influenza_Chain
  source 1..1344: mol_type = other RNA
gaagtccaactccaagaatccggccccggcctcgtcaaaccctcccaaactctaagcctaacctgcaacgtatccggcggatcaatcaccggcgactacaaatggtcctggatccgccaaccccctggcaaaggactagaatggatcggccacatccactccaccggcacaacatactacaacccctccctacgctcccgcatcacaatatcaatggacacatccaaaaacaacctctccctccgcctcacctcagtcaccgccgccgacacagctgtctactactgcgcttcccacacactcaccagcggacactaccctcgcgacttcgacttctggggccaaggcaccctcgtcaccgtctcctccgccagcaccaaaggcccatccgtcttcccccttgccccatgttctcgctcaacctccgaatccaccgccgcactcggctgccttgtaaaagactacttcccagaacccgtcaccgtctcatggaactccggagcactgacctcaggcgtccacacattccccgcagtactccaatccagcggcctctacagcctttcctccgtcgtcaccgtcaccagctccaacttcggtacccaaacctacacttgcaacgtagaccacaaaccctccaataccaaagtagacaaaacagtagaacgtaaatgctgcgtcgaatgccctccctgccccgccccacccgtcgccggccccagcgtcttcctatttccacccaaacccaaagacaccctcatgatctccagaacgcccgaagttacctgcgtagtcgtcgacgtatcccacgaagaccccgaagtccaattcaactggtacgtcgacggcatggaagtccacaacgccaaaaccaaaccccgcgaagaacaattcaactccaccttccgcgtagtaagcgtcctaaccgttgtccaccaagattggctcaacggcaaagaatacaaatgcaaggtctcaaacaaagggctacctgcccccatcgagaaaacaataagcaaaaccaaaggccaaccccgcgaaccccaagtctacactctaccaccttcccgcgaagaaatgaccaaaaaccaagtatccctcacttgcctggtaaaaggtttctaccccagcgacatcgcagtcgaatgggaatctaacggacaacccgaaaacaattacaagaccaccccacccatgctagactccgatggctccttcttcctatactcaaaactcaccgtcgacaaatcacgctggcaacaaggcaacgtcttctcctgctccgtcatgcacgaagccctacacaaccactacacccaaaagtctctatcactctccggcaaa

SEQ ID NO: 58742 - RNA, 1350 nt, synthetic construct
  misc_feature 1..1350: note = derived and/or modified sequence opt11 from anti-influenza_Chain
  source 1..1350: mol_type = other RNA
caagtccaactgcaacaatcaggcgccgaagttaagaaacccggctcctccgtcaaagtctcctgcaaagtatcaggcgtcatattctccggctcagccatctcctgggtacgccaagcccccggccaaggactcgaatggatgggaggcatcagccccctcttcggaactacaaactacgcccaaaaattccaaggccgcgtcaccataaccgccgaccaatccaccaacaccacatatatggaagtcaattccctccgctacgaagacacagccgtctacttctgcgcccgaggccccaaatactactcagaatacatggacgtctggggcaaaggcaccaccgtcacagtctcatcagcatcaacaaaaggcccctccgtattccccctcgcccccagctccaaatccacatctggcggcaccgccgcactcggctgcctcgtcaaagactacttcccagaacccgtcaccgtatcctggaactcaggcgcacttaccagcggagtccacacgttccccgcagtcctccaatcctccggactctactccttaagctccgtagtcaccgtcccctcttcctccctcggcacacaaacctacatctgtaacgtaaaccacaaaccatcaaacaccaaagtcgacaaacgagtcgaaccaaaatcctgcgacaaaacccacacatgccctccctgccccgcacccgaactcttaggcggtccctcagtcttcctattcccacccaaacccaaagacacacttatgatctcacgcacccccgaggtcacgtgcgtagttgtcgacgtatcccacgaggaccccgaagtcaaattcaactggtacgttgacggagtcgaagtacacaatgccaaaaccaaacccagagaagaacagtacaactccacctaccgcgtagtatccgtcctcacagtactccatcaagactggctcaacggcaaagagtacaaatgcaaagtctcaaacaaagcactccccgcccccatcgagaaaaccatttccaaagccaaaggccaaccccgagaaccccaagtctacaccctaccaccatctcgagaagaaatgaccaaaaaccaagtttcactcacatgcctagtaaaaggcttctacccctccgacatagcagtcgaatgggaaagcaacggccaacccgaaaacaactacaaaaccacaccacccgtactcgactccgacggctcattcttcctctactccaaactcacagtcgacaaatcacgatggcaacaaggcaacgtattctcctgctccgtaatgcacgaagccctccacaaccattacacacaaaaatccctctccctctcacccggcaaa

SEQ ID NO: 58743 - RNA, 1350 nt, synthetic construct
  misc_feature 1..1350: note = derived and/or modified sequence opt11 from anti-influenza_Chain
  source 1..1350: mol_type = other RNA
caagtacagcttgttcaatcaggagccgaagtcaagaaacccggcagctcagtaaaagtctcatgcaaagcctcaggcggcacattctcctcatacgccatctcatgggtccgccaagcccccggccaaggcctcgaatggatgggcggaatcatgggcatgttcggaaccaccaactacgcccaaaaatttcaaggacgcgtcaccatcactgcagacgaatttacatccgcggcatacatggaacttcgctcactacgatccgaagataccgcagtctactactgcgcccgctcctccggatactatccagaatacttccaagactggggccaaggcaccctagtcactgtctcatctgcctccaccaaaggaccctccgtcttcccactagcccccagctcaaaatctacgtcaggcggcacagccgcactaggctgcctcgtcaaagactactttcccgaacccgtcaccgtatcatggaactccggcgccctaacctccggagtccacaccttccccgccgttctccaatcgtccggcctttacagcctatcctccgtcgtcaccgtcccatcctcctcactcggcacccaaacctacatatgcaatgtaaatcacaaaccctccaacaccaaagttgacaaacgagtcgaaccaaaatcatgcgataaaacccacacttgcccaccctgccccgcccccgaactactcggcggcccctccgtcttcctcttcccacccaaacccaaagacaccctcatgatatcacggacccccgaagtcacatgcgtcgtcgtcgacgtatcccacgaagaccccgaagtaaagttcaactggtacgtcgacggcgtcgaagtacacaacgcaaaaaccaagccacgcgaggaacaatacaactccacctacagagtcgtctccgtccttaccgtcctacaccaagattggcttaacggaaaagaatacaaatgcaaagtatccaacaaagccctccccgcacccatcgagaaaacaatctccaaagcaaaaggccaaccacgagaaccccaagtctacaccctcccaccatcacgcgaagaaatgaccaaaaatcaagtctccctgacctgcctcgtcaaaggcttctacccatccgacatcgccgtcgaatgggaatcaaacggccagcccgaaaacaattacaaaacaacacctcccgtcctcgactccgacggatccttcttcctctacagcaaactcaccgtcgacaaatcccgatggcaacagggcaacgtcttctcatgctccgtaatgcacgaagcactccacaatcactacacccaaaaatccctatcactctcccccggcaaa

SEQ ID NO: 58744 - RNA, 1350 nt, synthetic construct
  misc_feature 1..1350: note = derived and/or modified sequence opt11 from anti-influenza_Chain
  source 1..1350: mol_type = other RNA
gaagtacagctagtcgaatccggcgccgaagtaaagaaacccggtagctcagtcaaagtctcctgcaaagcatcagggggcaccttctcatcatacggcatttcctgggtacgccaagcccccggccaaggcctcgaatggatgggcgacattatcggcatgttcggatccaccaactacgcccaaaacttccagggccgactcaccatcaccgccgacgaatcaacctcaaccgcctacatggaactttcctccctccgctcagaagacacagcagtctactactgcgcccgcagtagcggctactaccccgcatacctaccccactggggccagggcaccctagtcacagtctcctccgcctccacaaaaggaccatccgtcttccccctcgcaccctcctcaaaatcaaccagcggcggcaccgccgccctaggctgcctcgttaaagactatttccccgaaccagtaaccgtctcatggaactccggagccctcacctccggcgtccacaccttccccgccgtcctacaatcctccggactatactcactctcgtcagtagtcacagtccctagctcatccctcggaacccaaacctacatctgcaacgtcaatcacaaaccctccaacaccaaagtcgacaaacgcgtcgaaccaaaatcctgcgacaaaacccacacatgccctccctgccccgcccccgaactgctgggaggcccaagcgtattcctattcccacccaaacccaaagacaccctcatgatctcccgcacacccgaagtcacatgcgtagttgtagacgtttctcacgaagaccccgaagttaaattcaactggtacgtcgacggcgtcgaagtccacaacgccaaaaccaaacccagagaagaacagtacaacagcacctacagagtcgtctccgtcctaaccgtcctccaccaagactggctcaacggcaaagaatacaaatgcaaagtttccaataaagcccttcccgcccccatcgagaaaaccatctccaaagccaaaggacaaccccgtgaaccccaagtctataccctcccaccctcccgcgaagaaatgaccaaaaaccaagtctcactaacctgcctcgtcaaaggcttctaccccagcgacatagccgtcgaatgggaatccaacggacaacccgaaaacaactacaaaaccacaccacccgtcctcgactccgacggatctttctttctttactcaaaactcacagtcgacaaatcccgctggcaacaaggcaacgtcttctcatgctcagtcatgcacgaagccctacacaaccactacacacaaaaatctctatccctcagccccggaaaa

SEQ ID NO: 58745 - RNA, 1350 nt, synthetic construct
  misc_feature 1..1350: note = derived and/or modified sequence opt11 from anti-influenza_Chain
  source 1..1350: mol_type = other RNA
gaagtccagctagtcgaatcaggcgctgaagtaaagaaacccgggtcttccgtaaaagtctcatgcaaagcctccggcggcaccttctcctcctacgccatatcttgggtccgccaagcccccggccaagggctagaatggatgggcggcatcataggcatgttcggaacagccaactacgcccaaaaattccaaggccgcgtcaccataaccgccgacgagttcacctccacagcctacatggaactctcctccctccgctccgaagacacagccgtctactattgcgcccgaggcaactactactatgaaagctccctagactactggggacaaggaacactcgtaaccgtctcctctgcctcaaccaaaggcccctccgtcttcccactagcaccaagctccaaatccacctcaggcggcacagctgcactcggctgcctagtaaaggactacttccccgaacccgtaaccgtctcctggaactcaggagccctcacctccggcgtccacacctttcctgccgtcctccaatcttccggcctctactcgctttcctccgtagtcaccgtcccctccagctccctgggcacccaaacctacatctgcaacgtcaaccacaaaccatccaacacaaaagtggacaaacgcgtcgagcccaagtcatgcgacaaaacccatacctgcccaccctgccccgcacccgaactcctgggaggaccctccgtcttcctcttcccacccaaacccaaagacacactcatgatatcccgcactcccgaagtcacttgcgtagtagtcgacgtatcccacgaagaccccgaagtcaaattcaactggtacgtcgacggcgttgaggttcacaacgccaaaaccaaaccccgcgaagaacaatacaactccacataccgcgtcgtttctgttcttaccgtcctacaccaagactggctgaacggaaaagaatacaaatgcaaagtatcaaacaaggccctccccgcacccatcgagaaaaccatctctaaagccaaaggccaaccccgcgaaccccaagtatacacactcccaccctcacgcgaagaaatgaccaaaaatcaagtatcactcacatgcctcgtcaaaggattctacccctcagacatcgccgtcgaatgggaatcaaacggccaacctgaaaacaactacaaaacaacacctccagtcctagattcggatggctcatttttcctatattccaaactcaccgttgacaaatcccgctggcaacaaggcaacgtcttctcctgctcagtcatgcacgaagccctccacaatcactacacccagaaatcactatcactctcccccggcaaa

SEQ ID NO: 58746 - RNA, 1350 nt, synthetic construct
  misc_feature 1..1350: note = derived and/or modified sequence opt11 from anti-influenza_Chain
  source 1..1350: mol_type = other RNA
gaagtccaactcgtccaatcaggagccgaagtcaagaaacccggttcctccatgaaagtctcatgtaaagcctccggctcaatcttctccaactacggaatatcctgggtacgccaagcccccggccaaggactcgaatggatgggaggcatcatccccatcttcggagccgccaactacgcccaaaaattccaaggccgcgtcacaatcaccgccgacgaaagcacctccaccgtatacatggaagtccgctccctccgcagcgaagacaccgccgtttactactgcgcccgccgccaacagctctacaaaggatactaccaccactggggccaaggcaccctcgtcacagtcagctccgcatcaaccaaaggcccctccgtcttccccctcgcaccctcatccaaatccacctccggcggaaccgcagccctcggctgcctcgtcaaagactacttccccgaacccgtcaccgtcagctggaactccggcgctctcacctccggcgtccacacgttccccgccgtcctccagtcctcgggactctactccctatcctccgtagttaccgtcccctcctcttcactaggcacgcaaacctatatctgcaatgtaaaccacaaaccttccaacactaaagtcgacaagaaagtcgaaccaaaatcttgcgacaaaacacacacatgcccaccgtgccccgcccctgaactactcggcggaccctcagtattcctattcccacccaaacccaaagacaccctaatgatatcccgcacccccgaagtaacctgcgtcgtagtcgacgtctcccacgaagaccccgaagttaaattcaactggtacgtcgacggcgtcgaagtccacaacgcgaaaaccaaaccccgcgaagaacaatacaattcaacctaccgcgtagtcagcgtccttaccgtcctccaccaagactggctaaacggcaaagaatacaaatgcaaagtatccaacaaagcactacccgcccctatcgagaaaaccatctccaaagccaaaggccagccccgcgaaccccaagtatacacccttcccccgtcccgcgaagaaatgaccaaaaaccaggttagcctcacatgcctcgtcaaaggattctacccatcagacatcgccgtcgaatgggaatccaacggccaacccgaaaacaactacaaaaccacccctcccgtactcgactccgacggcagcttcttcctatactccaaactaactgtcgataaatcacgctggcaacaaggcaacgtcttctcgtgctcagtaatgcacgaagcactccacaaccactacacacaaaaatcactcagccttagccccggcaaa

SEQ ID NO: 58747 - RNA, 1350 nt, synthetic construct
  misc_feature 1..1350: note = derived and/or modified sequence opt11 from anti-influenza_Chain
  source 1..1350: mol_type = other RNA
caggtccaactcgtccaatcaggcgctggcgtcaaaaaacccggatccagcatgaaagtctcatgcaaagcctccggctccatattctccaactacggcataagctgggtccgccaagcacccggccaaggcctcgaatggatgggaggcatcatacccatcttcggtgccgcaaactacgcccaaaaattccaaggtcgcgtcaccataaccgccgacgaatccacctccacagtatacatggaagtccgctccctacgcagcgaagacacagccgtgtactactgtgccaggcgccaacaactctacaaaggctactaccaccactggggccaaggcacacttgtcaccgtatcctccgccagcaccaaaggtccctccgtcttccctctcgccccctcctccaaatccacatctggaggcaccgccgcactaggatgccttgtcaaagactacttccccgagccagtcaccgtcagctggaactcaggcgcactaacatccggcgtccacaccttcccagctgtcctacaatcatccggcctctactccctctcctccgtagtcaccgtcccctcctcctccctcggcacccagacctacatctgcaacgtaaaccacaaaccgtccaacacaaaagtcgacaaaaaagtcgaacccaaatcatgcgacaaaacccacacctgccccccctgcccagcccccgaactcctcggcggaccctccgtattcctcttcccccccaaaccaaaagacacactcatgatcagccgaacccccgaagtaacctgcgtcgtcgtcgacgtctcccacgaagacccagaagtcaaattcaactggtacgtcgacggagtggaagtacacaacgccaaaacaaaaccacgcgaagaacaatacaactctacctaccgcgtagtctccgtactcaccgtactccatcaagattggttaaacggcaaagaatacaaatgcaaagtctctaataaagccctacccgctcccatagaaaaaactatatccaaagccaaaggccaaccccgagaacctcaagtatacacactccccccctcccgagaagaaatgacaaaaaaccaagtctccctaacctgtctcgtcaaaggcttctacccctccgacatcgccgtcgaatgggaatccaacggccaacccgaaaacaactacaaaaccaccccccccgtccttgactccgacggctcattcttcctctactccaaactcaccgtcgacaaatcccgctggcaacaaggaaacgtattctcttgctcagtcatgcacgaagctctccacaaccactacacccaaaaatcactttctctctcccccggaaaa

SEQ ID NO: 58748 - RNA, 1350 nt, synthetic construct
  misc_feature 1..1350: note = derived and/or modified sequence opt11 from anti-influenza_Chain
  source 1..1350: mol_type = other RNA
caagtccaactcgtccaatccggcgccgaagtccgcaaacccggctccagcgtcaaggtctcctgcaaagtcagcggcggaatcatacgaaaatacgccatcaactgggtccgccaagcccccggacagggcctcgaatggatgggtggcataatcgccatcttcaacaccgccaactacgcacaaaaattccaaggccgcgtcaccatcaccgcagacgaatccacctccaccgtctacatggaactaagctccctcaggtcagaagacactgcactatactactgcgccagaggaatgaattactactcagactattttgactactggggccaaggatccctcgtcacagtctcccccgcctccaccaagggccccagcgtattccccctcgccccctcatcaaaatcaacctccggcggcaccgccgccctaggatgcctcgtaaaagactacttccccgaacccgtcacagtctcatggaactcaggcgccctcacctcaggcgtacacacattccccgcagtactacaatcctccgggctctacagcctctcctcagtagtcacagtcccctcctcatcactcggcacccaaacatacatatgcaatgtaaaccacaaaccctccaacaccaaagtcgacaaaaaggtcgaacccaaatcctgtgacaaaacccacacatgcccaccctgccccgcccccgaactactcggaggccctagcgtcttcctattcccacccaaacccaaagacaccctcatgatatcccgcacccccgaagtcacttgtgtcgtcgtcgatgtctcacacgaagaccccgaagtcaaattcaactggtacgttgacggagtcgaagtccacaacgccaaaacaaaaccccgcgaagaacaatacaacagcacctaccgagtcgtctctgtcctcaccgtcctccaccaagattggctcaacggaaaagaatacaaatgcaaagtcagcaacaaagcactccccgcccccatcgagaaaacaatatccaaagccaaaggccaaccacgagaaccccaagtctacaccctaccaccctccagagacgaactaaccaaaaaccaagtatcacttacctgcctcgtcaaaggcttctacccctccgatatagctgtcgaatgggaatcgaacggccaacccgaaaacaattacaaaaccaccccaccggtacttgacagcgacggctcatttttcctctactccaaactcaccgtcgacaaaagccgctggcaacaaggcaacgtattcagctgcagcgtaatgcacgaagccctacacaaccattacacccaaaaatcactatccctctcccccggaaag

SEQ ID NO: 58749 - RNA, 1350 nt, synthetic construct
  misc_feature 1..1350: note = derived and/or modified sequence opt11 from anti-influenza_Chain
  source 1..1350: mol_type = other RNA
caagtccaactcgtacaatccggcgccgaagtccgtaaacccggatcctcagtaaaagtcagctgcaaagtctccggcggcatcatccgcaaatacgcaatcaactgggtacgacaagcccccggccaaggcctagaatggatgggcggcataatcgctatcttcaacaccgcaaactacgcccaaaagttccaaggccgcgtcacaataaccgctgacgaatccacctcaactgtctacatggaactcagctccctccgatccgaagacactgcactttactactgcgcccgcggcatgaactactacagcgactacttcgactactggggccaaggatcactcgtaaccgtctcccccgcttcaaccaaaggaccctcagtcttccccctagccccatcctccaaaagcacatcaggcggcacagcggcccttggctgcctcgtaaaagactacttccccgaaccagtaacagtatcctggaactccggcgcactcacatcaggagtccacaccttccccgcagtcctccaatcctccggactctactctctctcctccgtcgtaaccgtcccttcctcttccctcggcacccaaacctacatctgcaacgtcaaccacaaaccaagcaacacgaaggtcgacaagaaagtcgaacccaaatcgtgcgacaaaacccacacctgtcccccatgccccgcccccgaattactcggcggcccctcagtcttcctattcccacccaaacccaaagacaccctcatgatctcccgcacacccgaagtaacatgcgtcgtcgtcgacgtatcccacgaagaccccgaagtcaaattcaactggtatgtcgacggagtcgaagtgcacaacgccaaaacaaaaccccgtgaagaacaatacaactcaacctaccgcgtcgtctccgttctcactgtcctacaccaagactggctaaacggcaaggaatacaaatgcaaggtctcaaacaaagcactccccgcccccatcgagaaaaccatatcaaaagccaaaggccaacccagagaaccccaagtctacacactcccaccctcacgagacgaattaaccaaaaaccaggtctccctcacatgcctagtcaaaggcttctatccctccgacatagccgtcgaatgggaatccaacggccaacccgaaaataactataaaacaacaccacccgtcctagactccgatggcagtttcttcctctactccaaactcaccgtcgacaaatcacgctggcaacaaggaaacgtcttctcatgctccgtcatgcacgaagccctacacaaccactacacacaaaaatcactcagcctctcccccggaaaa

SEQ ID NO: 58750 - RNA, 1350 nt, synthetic construct
  misc_feature 1..1350: note = derived and/or modified sequence opt11 from anti-influenza_Chain
  source 1..1350: mol_type = other RNA
gaagttcaacttgtacaatccggcgcagaagtaaagaaacccggatcctccatgaaagtaagctgcaaagcatccggttccatcttctccaactacggaatctcctgggtccgccaagcccccggccaaggcctcgaatggatgggcggcataatccccatcttcggagcagccaactacgcacaaaaattccaaggccgcgtcacaataaccgccgacgaatccacctccacagtctacatggaagtccgctccctccgctccgaggacaccgcagtctattactgcgcacgccgacaacagctctacaaaggctactaccaccactggggtcaaggtaccctcgtaacagtctcctccgcatcaaccaaaggaccatctgtcttcccactagcaccatccagcaaatccacctcaggaggcacagccgccctcggctgcctcgtcaaagactactttcccgaacctgtcacagtctcctggaactccggagccctaacttccggagtccacactttccccgccgtcttacaatcatccggactatactccctatcatcagtcgtcacagtgccctcctcatccctcggcactcagacttacatctgtaacgtcaaccacaaaccctccaacaccaaagtcgacaagaaagtcgaacccaaatcatgcgacaaaacacacacatgcccaccctgcccagcacccgaacttctaggcggcccatccgtcttcctcttccctccaaaacccaaagacaccctaatgatctcacgaaccccagaagtaacctgcgtcgtcgtggacgtcagccacgaagaccccgaagtcaaattcaactggtacgtggacggagtagaagttcacaacgccaaaaccaagcccagagaagaacaatacaactcaacctaccgcgtagtctccgtcctaaccgtcctccaccaagactggctcaacggtaaagaatacaaatgcaaagtctccaataaagccctccccgctcccattgagaaaaccatctccaaagccaaaggccaaccccgcgaaccacaagtatacaccctcccaccttcccgcgaagaaatgactaaaaaccaagtctccctcacatgcctagtcaaaggcttctacccctccgatatagcagttgaatgggaatctaacggtcaaccagaaaacaactacaaaacaaccccaccagtcctcgattcagacggatccttcttcctctactcaaagctcaccgtagacaaatcccgctggcaacaaggcaacgtcttctcatgctccgtcatgcacgaagccctccacaaccactacacacaaaaatccctctccctctcccccggcaaa

SEQ ID NO: 58751 - RNA, 1350 nt, synthetic construct
  misc_feature 1..1350: note = derived and/or modified sequence opt11 from anti-influenza_Chain
  source 1..1350: mol_type = other RNA
caagtccaactcgtccaatcaggcgccggagtcaagaaacccggctcctcaatgaaagtatcctgcaaggcttctggctcaatcttctccaactacggcatcagctgggttcgacaagcccccggccaaggccttgaatggatgggcggcatcatcccgatcttcggcgcagccaactacgcccaaaaattccagggccgcgtcaccatcaccgcagacgaatccacttccaccgtatacatggaagtccgctccctccgctccgaagacaccgccgtctactactgcgcccgtcgccaacagctatacaaaggctactaccaccactggggacaaggcaccctagtaaccgtttccagtgcctctaccaaaggcccctcagtgttccccctcgcccccagctctaaatccacatctggcggcacagccgcactcggatgcctcgtcaaagactacttccccgaacccgtgaccgtcagttggaactccggcgccctcacctccggcgtacacaccttcccagccgtcctccaatcgtccggactctactcactaagctcagtagtcaccgtcccctcctcctcactcggaacccaaacctacatctgcaatgtcaaccacaaacccagcaacaccaaagtcgacaagaaagtcgaaccaaaatcctgcgacaaaacccacacctgtcccccatgccccgcccccgaacttctcggcggtccctccgtcttcctgttcccacccaaacccaaagacaccctaatgatctcacgcacacccgaagtaacctgcgtcgtcgtcgacgtatcccacgaagaccccgaagtcaaattcaactggtacgtcgacggcgtggaagttcacaacgcgaaaacaaaacccagagaagaacaatacaactccacctatcgcgtagtctccgtcctcaccgtactccaccaggactggctaaacggcaaagagtacaaatgcaaagtctcaaacaaagccctgccagccccaatcgagaaaaccatatccaaagccaaaggccaacccagagaaccacaagtatacacactcccaccctcccgcgaagaaatgaccaaaaatcaagtctccctgacatgcctcgtaaaaggcttctacccctccgatatagccgtcgaatgggaaagcaacggccaacccgaaaacaactacaaaactacaccacccgtacttgactctgacggatccttcttcctatattcaaaactcaccgtcgacaaatcacgatggcaacaaggaaacgtcttctcctgctccgtcatgcacgaagccctccacaaccactacacacaaaaatccttatccctatcccccggcaaa

SEQ ID NO: 58752 - RNA, 1350 nt, synthetic construct
  misc_feature 1..1350: note = derived and/or modified sequence opt11 from anti-influenza_Chain
  source 1..1350: mol_type = other RNA
caagtacaactccaacaatctggagcagaagtcaagaaacccggaagctcagtcaaagtctcctgcaaagtctccggagtcatattctccggctccgccatctcatgggtccgccaagccccaggccagggcctagaatggatgggcggaatatcaccactcttcggcaccaccaactatgcccaaaaattccaaggacgagtcaccattaccgccgaccaatccaccaacaccacctacatggaagttaactccctacggtacgaagacaccgccgtatatttctgcgcccgcgggcccaaatactactccgaatacatggacgtctggggcaaaggcactaccgtaacagtctcctccgcatcaaccaaaggcccctcagtcttcccccttgcaccctcctcaaaatccacatcaggcggaaccgcagccctaggatgcctcgtcaaagactacttcccagaacccgtcacagtatcctggaactctggagcccttacctcaggcgtccacaccttccccgcagtcctccaatccagcggactatacagcctaagctcggtcgtcaccgtgccatcaagctccctaggcactcaaacctacatctgcaacgtgaaccacaaaccctcaaacacaaaagtcgacaaaagagttgagcccaaatcatgcgacaaaacccacacatgtcccccatgccccgcccctgaactcctcggcggtccctcagtcttcctcttcccacccaaacccaaagacaccctcatgatctcacgcacacccgaagtcacttgcgtcgtcgtcgacgtctcccacgaagaccccgaggttaaattcaactggtacgtcgacggagtcgaagtccacaatgccaaaaccaaaccccgtgaagaacaatacaactccacctaccgcgtagtctccgtccttaccgtcctacaccaagactggctaaacggaaaagagtacaaatgcaaagtctcaaacaaagcccttccagcacccatagagaaaaccatatcaaaagctaaaggccaaccacgcgaaccccaagtatacacactgccaccctcacgcgaagaaatgaccaaaaaccaagtatcactcacatgcttagtcaaaggtttctaccccagcgacatagccgtcgaatgggaaagcaacggacagcccgagaacaactacaaaacaacacccccagtccttgactccgatggcagctttttcctctactctaaactcaccgtcgacaaatcccgatggcaacaaggaaacgtcttctcctgctccgtcatgcacgaagcgctacacaaccactatacccaaaaatccctctccctctctcccggcaaa

SEQ ID NO: 58753 - RNA, 1350 nt, synthetic construct
  misc_feature 1..1350: note = derived and/or modified sequence opt11 from anti-influenza_Chain
  source 1..1350: mol_type = other RNA
caagtgcaactcgtacaatcaggcgcagaagtaaagaaacccggctcctcagtcaaagtaagctgcaaggcctccggcggcaccttctcctcctacgcgatctcatgggtccgccaagcacccggccaaggactcgaatggatgggcggcattatgggcatgttcggcactaccaactacgcacagaaattccaaggacgcgtgacaatcaccgccgacgagttcacatccgccgcctacatggaactccgctccctccgatccgaagacaccgccgtatactactgcgcccggtcatccggctactacccagaatacttccaagactggggccaaggcaccctcgtaaccgtttcctcggcctcaaccaaaggaccatccgtctttcccctagcaccatcatccaaatccacctccggcggcaccgcagccctaggctgcctcgtcaaagattacttccccgaaccagtcaccgtatcctggaactccggcgccctaacctcgggagtccacaccttcccagccgtcctccaatcctccggcctctactccctctcatccgtcgtaaccgtcccctctagctccctaggaacacaaacatacatctgcaacgtaaaccacaagccctctaacaccaaagtcgacaaacgcgtcgaacccaaatcctgcgacaaaactcacacatgcccaccctgccccgcccccgaactccttggcggcccctccgtatttctattccctcccaaacccaaagacaccctcatgatatcccgtaccccagaagtgacctgcgtcgtcgtcgacgtctcacacgaagaccctgaagtcaaattcaactggtacgtcgacggcgtcgaggtccacaacgctaaaacaaaaccacgcgaggaacaatacaactccacataccgcgtcgtctccgtcctcactgtcctccaccaagactggctaaacggcaaagaatacaagtgcaaagtcagcaacaaagccctccccgcaccgatcgagaaaaccatctctaaagccaaaggtcaaccacgtgaaccccaagtatatactctgccaccatcacgcgaagaaatgaccaaaaaccaagtctcccttacctgcctcgtaaaaggcttctaccccagcgacatcgccgtcgaatgggaaagcaacggccaacccgaaaacaactacaaaaccaccccacctgtcctcgacagcgacggttccttcttcctctattccaaactcacagtcgacaaatcccgatggcaacaaggcaacgtcttctcatgctccgtcatgcacgaagccctccacaaccactacacccaaaaatcactctcactctcgcccggcaaa

SEQ ID NO: 58754 - RNA, 1350 nt, synthetic construct
  misc_feature 1..1350: note = derived and/or modified sequence opt11 from anti-influenza_Chain
  source 1..1350: mol_type = other RNA
gaagtccaactcgtcgaatcaggcgccgaagtcaagaaaccaggctcctccgtcaaagtatcatgcaaagccagcggaggcaccttctcttcatacggaatctcatgggtccgccaagcccccggacaaggcctagaatggatgggcgacatcatcggcatgttcggctccaccaactacgctcaaaacttccaaggacgcctgaccataacagcagacgaatccacctccaccgcttacatggaactcagctctctccgttcagaggacaccgccgtctactactgcgcacgctcctccggatactaccccgcctacctcccccactggggccaaggaaccctcgtaaccgtctcatccgcatcaacaaaaggaccctcagtatttccattagccccatcctccaaatccacctccggcggcacagcagcactaggatgcctcgtcaaagactacttccccgaacccgtcactgtctcatggaactccggagccctcaccagcggcgtccacaccttccccgccgtcctacaatcctccggtctctactccctctccagcgtcgtaaccgtaccctcctcctcactcggcacccaaacatacatctgcaacgtcaaccacaaaccctcaaacacaaaagtcgataaacgcgtcgaacccaaatcctgcgacaaaacccacacatgcccaccctgccccgcccccgaactccttggcggtccatcagtcttcctcttcccacccaaacccaaagacaccctcatgatatcaagaacacccgaagtaacctgcgtcgtcgtcgacgtctcccacgaagaccccgaagtgaaattcaactggtacgtcgacggagtagaagtccacaacgccaaaacaaaaccccgtgaagaacaatacaactccacataccgtgtagtctccgtcctaaccgtcctccaccaagactggcttaatggcaaagaatacaaatgtaaagtctccaacaaagccctccccgcccccatagagaaaacaatatccaaagcaaaaggccagccccgcgaaccccaagtctatactctaccaccctctcgcgaagaaatgaccaagaaccaagtctcccttacttgcctcgtcaaaggcttctacccctcagacatcgcagtagaatgggaatcaaacggacaacccgaaaacaactacaagaccacaccccctgtcctagactccgacggatctttcttcctatactctaaactcaccgtcgacaaatcccgatggcaacaaggcaacgtattctcctgctcggtcatgcacgaagctctccacaaccactacacccaaaaatcactgtccctaagccccggcaaa

SEQ ID NO: 58755 - RNA, 1350 nt, synthetic construct
  misc_feature 1..1350: note = derived and/or modified sequence opt11 from anti-influenza_Chain
  source 1..1350: mol_type = other RNA
gaagtacaactcgtcgaatccggagcagaagtcaagaaacccggctcctccgtcaaagtatcatgcaaggcttccggaggcaccttctcctcatacgcaatctcctgggtacgccaagcacccggccaaggccttgaatggatgggaggcataatcggcatgttcggcaccgcaaactacgcccaaaaattccaaggacgcgtcaccatcacagcggacgagttcacaagcaccgcatacatggaattaagctcactacgatcagaagacaccgccgtctactactgcgcacgcggcaattactactacgaatcctcactcgactactggggtcaaggaaccctcgtaacagtaagcagcgcaagcacaaaaggccctagcgtcttccccctcgccccctcctccaaatctacctctggtggcacagccgcactaggctgccttgtcaaagactactttccagaacccgtaacagtctcatggaacagcggcgctctcacctccggcgtccacacctttcccgccgtcctccaatcctcaggcctctactcactatcctcagtcgtcacagtaccgtcctcctccctaggcacccaaacctacatatgcaacgtcaaccacaaaccctccaataccaaagtagacaaacgcgttgaaccaaaatcctgtgacaaaacccacacgtgccctccctgccccgcccccgaactactcggcggaccctccgtcttcctcttcccacccaaacccaaagacaccctaatgatctcaagaacccccgaagtcacatgcgtcgtagtcgacgtctcccacgaagaccccgaagtcaaattcaactggtacgtagacggagtcgaagtccacaacgccaaaaccaaaccccgggaagaacaatacaactccacctaccgcgtagtctccgtcctcacagtactccaccaagactggctcaacggaaaagaatacaaatgcaaagtcagcaacaaagcactccccgcccccatcgaaaagaccatctccaaagccaaaggccaaccccgcgaaccccaagtatacacactacctccctcccgagaagaaatgaccaaaaaccaagtatccttaacctgccttgtaaaagggttctacccctccgacatcgccgtcgaatgggaatccaacggccaacccgaaaacaactacaaaacgaccccacccgtactcgactcagacgggtcattcttcctttactcaaaacttacagtcgacaaaagccgctggcagcaaggcaacgtcttctcatgctcagtcatgcacgaagccttgcacaaccactacacccaaaaatccctatccctctcccccggcaaa

SEQ ID NO: 58756 - RNA, 1353 nt, synthetic construct
  misc_feature 1..1353: note = derived and/or modified sequence opt11 from anti-influenza_Chain
  source 1..1353: mol_type = other RNA
gaagtccaactcgtagaatccggcgccgaagtcaaaaagcccggaagctccgtaaaagtctcctgcaaagcaagcggcgggcccttccgatcctacgcaatcagttgggtccgccaagcccccggacaaggccccgaatggatgggcggcatcatccccatattcggaaccaccaaatacgccccaaagttccaagggcgcgtaacaatcacagcagacgacttcgccggcaccgtctacatggaactatcttcactacgatctgaagacacagcaatgtactactgcgccaaacacatgggctaccaagtccgcgaaacaatggacgtctggggcaaaggcaccacagtcaccgtatcctcagcatcaaccaaaggcccctcagtcttccccctggcgccctcctcaaaatcaaccagcggtggaaccgccgccctaggctgcctcgtcaaagattacttcccagagcccgttaccgtgagctggaactccggcgcactcacctcaggagtacacaccttccccgccgtcctccaatcctcaggcctctactccctatcctccgtcgtaaccgtaccctcatcatcactcggcacccaaacctacatctgcaacgtcaaccacaaacccagtaataccaaagtagacaaacgagtagaaccgaaaagctgcgacaaaacccatacctgcccaccctgccccgcccccgagctcctagggggcccctcggtattcctcttcccacccaaaccaaaggacaccctcatgatatcccggaccccagaagtaacctgcgttgtcgtcgacgtctcccacgaagatcccgaagtcaaattcaactggtacgtcgacggcgtcgaagtacacaatgccaaaaccaaaccacgagaagaacaatacaactccacctaccgcgtcgtttccgtactaaccgtactccaccaagactggctcaacggcaaagaatacaaatgcaaagtctccaacaaagcactccccgcacccatagagaaaacaatatcaaaagctaaaggacaaccgcgagaaccccaagtatacaccctcccaccctcccgcgaagaaatgaccaaaaaccaagtatccctaacatgcctcgtcaaaggcttctaccccagcgacatcgccgtagagtgggaatcaaacggccaacccgaaaacaactacaaaacaacaccacccgtcctcgattccgacggttccttcttcctctacagcaaactcacagtcgacaaatccagatggcaacaaggtaacgtattctcttgctccgtcatgcacgaagccctacacaaccactacacccaaaaatcactctccctctctcccggaaaa

SEQ ID NO: 58757 - RNA, 1353 nt, synthetic construct
  misc_feature 1..1353: note = derived and/or modified sequence opt11 from anti-influenza_Chain
  source 1..1353: mol_type = other RNA
caagtccaactcgtccaatccggcgccgaagtcaagaaacccggctcctccgtaaaagtctcatgcaaagcatccggaggccccttccgatcctacgcgatctcctgggtacgccaggcacccggacaaggccccgaatggatgggcggcataatccccatcttcggaaccaccaaatacgccccaaaattccaaggacgagtcaccatcaccgccgacgacttcgccggcaccgtctacatggaactttcctcactccgcagcgaagacaccgccatgtactactgcgccaaacacatgggctaccaagtccgcgaaaccatggacgtctggggcaaaggaaccaccgtcaccgtctcctctgcctccaccaaaggcccctcagtcttccccctcgccccctctagtaaatcaacctccggaggaaccgccgcactaggctgcctagtaaaagactacttcccagaacccgtaaccgtatcctggaactccggcgctctaacatccggcgtacacactttcccagccgtactccaatcatccggcctctacagcctatcatccgtcgtaaccgtaccctcctcctcactcggcacacaaacatacatctgcaatgtcaaccacaaaccctccaacaccaaagtcgacaagcgtgtcgaacccaaatcctgcgacaaaacccacacatgcccaccctgccccgcccccgaactactcggaggaccctccgtcttcctcttcccacccaaacccaaagacacccttatgatctcccggacacccgaagtaacctgcgtagtcgtcgacgtctcccacgaagaccccgaagtcaaattcaactggtacgttgacggcgtcgaagtccacaacgccaaaaccaaaccccgcgaagaacaatacaactctacctaccgcgtcgtctccgtcctaacagtactccaccaagactggctcaacggcaaagaatacaaatgcaaagtctcaaacaaagccctccccgcccccatagagaaaaccatatccaaagccaaaggtcaaccccgcgaaccccaagtctatacccttccaccctcacgcgaagaaatgaccaaaaaccaagtaagcctaacatgccttgtcaaaggtttctacccctcggacatcgccgtagaatgggaatctaacggccaaccagaaaacaactacaagaccaccccacccgtcctagactcagatggatccttcttcctctactccaaactaaccgtagacaaatcacgctggcaacaaggcaacgtcttcagctgctccgtcatgcacgaagcactccacaaccactatacccaaaaatcactgtccctctcacccggtaag

SEQ ID NO: 58758 - RNA, 1353 nt, synthetic construct
  misc_feature 1..1353: note = derived and/or modified sequence opt11 from anti-influenza_Chain
  source 1..1353: mol_type = other RNA
gaagtacaactcgtcgaaagcggggcagaagtcaagaaacccggctcatcagtcaaagtctcctgcaaagccagcggcggaactttctccttctactccatgtcctgggtcagacaggccccaggccaaggactggaatggatgggaggaatcatacccatgttcggcaccacaaactatgctcaaaaatttcaaggccgcgtcaccataaccgccgtagaatctacctccactgcatacatggaagtatcctccctacgctcagaagacacagccgtctactactgcgcacgcggggataaaggcatctactactactacatggacgtctggggcaaaggcaccacagtcacagtatcctcagcctccacaaaaggcccatccgtattccccctcgccccctcatcaaaatcaacatcaggcggcacagccgcactaggctgccttgttaaagattacttccccgagccagtcacagtatcctggaacagcggagcacttacttccggcgtccacaccttccccgccgtactacaatccagcggactctacagtctctcctccgtcgtcacagtcccctccagctcactcggcacccaaacctacatctgtaacgttaaccacaaaccatcaaacaccaaagtcgacaaaagagtcgaacccaaatcgtgtgacaaaacccacacatgcccaccctgccccgcacccgaactcctcggcggaccctccgtcttcctattcccacccaaacccaaagacaccctaatgatcagccgcacccccgaagtcacctgtgtcgtcgtcgacgtatcccacgaagaccccgaagtcaaattcaactggtacgtcgacggcgtagaagtccacaacgccaaaaccaaacccagagaagaacaatacaacagtacctaccgagtagtctcagtcctaaccgtcctccaccaagactggctaaacggcaaagaatacaaatgcaaagtctcaaacaaagccctccccgcccccatcgagaaaaccatatccaaagcaaaaggccagccacgcgaacctcaggtatacaccctgccaccctcccgcgaagaaatgaccaagaatcaagtctccctaacctgcctcgtcaaaggtttctacccaagcgacatcgcagtcgaatgggaatccaacggacaacccgaaaacaattacaaaaccaccccaccagtcctcgactccgacggctccttcttcctatattccaaactcaccgtcgacaagtcccgatggcaacaagggaacgtcttcagctgctcagtaatgcacgaagcactccacaaccactacacacaaaaatcactaagcctatcccccggcaaa

SEQ ID NO: 58759 - RNA, 1353 nt, synthetic construct
  misc_feature 1..1353: note = derived and/or modified sequence opt11 from anti-influenza_Chain
  source 1..1353: mol_type = other RNA
gaagtacaattagtcgaaagcggcgccgaagtcaagaaacccggctctagcgtaaaagtctcctgcaaagcaagcggaggcccctttcgcagctacgccatctcatgggtcagacaagcacccggacaaggccccgaatggatgggaggaataatccccatcttcgggacaaccaaatacgccccaaaattccaaggacgcgtcaccataacagccgacgacttcgcaggcaccgtctacatggaactcagcagtctccgatccgaagacaccgccatgtactactgcgccaaacacatgggataccaagtacgcgaaaccatggacgtgtggggcaaaggaacaaccgtcaccgtctcatccgcctccaccaaaggcccctccgtctttcccctcgcacccagctccaaatccacctccggcggcacagcagccctcggctgcctagtcaaagattacttccccgaacccgtcactgtctcctggaactccggcgcgctaacatccggcgtccacaccttccccgccgtcctccaatcatccggtctatacagcctaagctccgtcgtcaccgtcccctcgtcctcactagggacccagacctacatctgcaacgtaaaccataaaccatccaacacaaaagtcgacaaacgagtagaacccaaatcatgtgacaaaacccacacctgtcccccatgccccgcaccggaactcctaggcggccctagcgtcttcctctttccacccaaacccaaagacacccttatgatctcacgcaccccagaagtcacatgcgtagttgtcgacgtatcacacgaagaccccgaagtaaaattcaactggtacgtcgacggcgtcgaagtacacaacgccaaaaccaagccccgagaagaacaatacaactccacataccgcgtcgtatcagtcctaaccgtgctacaccaagactggctcaacggaaaagaatacaaatgcaaggtctcaaacaaagccctcccagcccccatcgagaaaaccatctccaaagccaaaggccaacccagagaacctcaagtatacacactgccaccctcccgagaagaaatgaccaaaaaccaagtctccctcacatgcttagtcaaaggattctaccccagcgacatcgccgttgaatgggaatccaacggccaaccagagaacaactacaaaacaacaccccctgtcctagactccgacggttcattcttcctatactccaaactcaccgtcgacaaatcccgctggcaacaaggcaacgtcttctcctgctcagtaatgcacgaagccctccacaaccactacacccagaaatcgctctccctctcccccggcaaa

SEQ ID NO: 58760 - RNA, 1353 nt, synthetic construct
  misc_feature 1..1353: note = derived and/or modified sequence opt11 from anti-influenza_Chain
  source 1..1353: mol_type = other RNA
caagtgcaactcgtccaatcaggagcagaagtcaagaaacccggcagcagcgtcaaagtctcctgcaaagcatccggcggacccttccgctcctacgccatctcctgggtacgacaagcccctggccaaggacccgaatggatgggaggaatcattcccatcttcggaactaccaaatacgcgcccaaattccaaggccgcgtaaccataacagccgacgacttcgccggcaccgtatacatggaactctcctccctccgctccgaagacaccgccatgtactattgcgccaaacacatgggataccaagtccgcgaaacaatggacgtatggggtaaaggaactacagtaaccgtttcctccgcgtccaccaaaggcccatccgtcttcccattagccccttcctccaaatccacctcaggcggaacggccgcactcggatgcctagtaaaagactacttccccgaacccgtcaccgtctcctggaactcaggcgccctaacgtcaggagttcacaccttcccagccgtcctacagtccagcggcctctactcactctcaagcgtcgtaaccgtaccctcctcatccctcggcacccaaacctacatctgcaacgtcaaccacaaaccatcaaacacaaaagtcgacaaacgagtcgaacccaaaagctgtgacaaaacccacacatgccctccctgccccgcacccgaactcctcggcggcccatccgtcttcctctttcccccaaaacccaaagacaccctaatgatcagccgaacacccgaagtgacatgcgttgtagtcgacgtatcacacgaagaccccgaagtcaaattcaactggtacgtagacggcgtcgaagttcacaacgccaaaaccaaaccccgagaagaacaatacaactcgacataccgtgtcgtcagcgtactcacagtcctccaccaagactggctaaacggaaaagaatacaaatgtaaagtgagcaataaagcactccccgccccgatagagaaaaccatatcgaaagcaaaaggacaaccccgagaaccacaagtctacaccctacccccatcccgcgaagaaatgaccaaaaaccaagtatcactaacctgcctcgtcaaaggcttctacccctcagacatcgccgtagaatgggaatcaaacggacaacccgaaaacaactacaaaaccaccccacccgtcctcgactccgacggctcattcttcctctactccaagctcacagtcgacaaatcccgatggcagcaaggaaacgtcttctcctgcagcgttatgcacgaagccctccacaatcactacacacaaaaatccctcagcctgagccccggcaaa

SEQ ID NO: 58761 - RNA, 1353 nt, synthetic construct
  misc_feature 1..1353: note = derived and/or modified sequence opt11 from anti-influenza_Chain
  source 1..1353: mol_type = other RNA
gaagtccaactcgtagaatccggcgccgaagtcaagaaacccggcagctccgtcaaagtcagctgcaaagcatcaggaggaacattctcgttctactccatgagctgggtccgccaagcccccggccaaggcctcgaatggatgggcggcatcatccccatgttcggcaccacaaactacgcccaaaaattccaaggccgcgtcaccataaccgcagtcgaatcaacctccaccgcatacatggaagtctccagcctccgttctgaagatacagctgtctattactgcgcccgaggcgacaaaggaatctactactactacatggacgtctggggaaagggcaccaccgtcaccgtctcgtcagcaagcacaaaaggaccctccgtcttcccactcgccccctcatccaaatcaacatcaggaggcacagccgctctcggctgcctcgtcaaagactacttccccgaacccgtaacagtcagctggaactccggcgccctcaccagcggcgtccacaccttccccgccgtcctccaatcatccggcctatacagcctcagctcagtggtcactgtcccatccagctccctaggaactcaaacctacatctgcaacgtcaaccacaaaccgtccaacacaaaagtagacaaacgggtcgaacccaaatcctgcgacaaaacccacacttgcccaccctgccccgcacctgaacttctcggaggcccctccgtcttcctcttcccacccaaacccaaggacaccctaatgatatcccgaaccccagaagtgacctgcgtcgtcgtggatgtcagccacgaagaccccgaagtcaaattcaactggtacgtcgatggcgtagaagtccacaacgccaaaaccaaaccccgagaagaacagtacaactcaacctacagagtcgtctccgtcctcaccgtgctacaccaagactggctcaacggtaaagaatacaagtgcaaagtctccaacaaagccctcccagctcccatcgaaaagacaatcagcaaagcaaaaggccaacccagagaaccacaagtttacaccctcccaccctcacgcgaagaaatgactaaaaaccaagtctccctaacctgcctcgtcaaaggcttctatccctccgacatagccgtcgaatgggaatcaaacggccaacccgaaaacaactacaaaaccaccccacccgtcctcgactccgacggctccttcttcctctactccaaactaaccgtcgacaaatcccgctggcaacaaggcaacgtattctcttgctccgtcatgcacgaagccctacacaaccactacacccaaaaatcactcagcctctcccccggcaaa

SEQ ID NO: 58762 - RNA, 1356 nt, synthetic construct
  misc_feature 1..1356: note = derived and/or modified sequence opt11 from anti-influenza_Chain
  source 1..1356: mol_type = other RNA
caagtccaactcgttcaatccggcggaggattagtcaaacccggcggatccttacgcctatcctgcgccgcatccggcttcaccttctcctcctactcaatgaactgggtccgccaagcccccggcaaaggtctagaatgggtctcctccatctcctcctcatcctcatacatctactacgtcgactcagtcaaaggccgcttcacaatctctcgagacaacgccaaaaattccctatacctccagatgaacagcctccgcgccgaagacaccgctgtatactactgcgcccgtggcggaggcagctacggtgcttacgaaggcttcgactactggggacaaggcaccttagtcaccgtatcctccgcctctaccaaaggcccctccgtcttccccctcgccccctcatccaaatccacctcaggcggcaccgcggcactgggctgcctcgtcaaagactacttcccagaaccagtcaccgtaagctggaactcaggcgcactcacgtcaggcgtccacaccttccccgccgtcctgcaatcatccggcctctactccctctcctcggtcgtcaccgtcccatcctcctccctaggaacacaaacgtacatctgcaatgtcaaccacaaaccttcaaacacaaaagtcgacaaacgagtcgaacctaagtcctgcgacaaaacccacacctgtccaccctgccccgcccccgaactcctcggcggcccctccgtattcctattcccacccaaacccaaagacaccctaatgatatctcgcacccccgaagtaacatgcgttgtagtcgacgtctcacacgaagaccccgaagtcaaattcaactggtatgtagacggagtcgaagtccacaacgccaaaaccaaacctcgcgaagaacaatacaactccacctaccgagtcgtctctgtcctcaccgttctacaccaagactggctcaacggcaaagaatacaaatgcaaagtgtccaacaaggccctccccgcccccatcgagaaaacaatatcaaaagccaaaggccaaccgagagaaccccaagtgtacaccctgccaccctcacgcgaagaaatgaccaaaaaccaggtctccctgacctgcctcgtcaaaggcttctacccctctgacatcgccgtcgaatgggaatccaacggacaacctgaaaataactacaaaaccacacccccagtcctcgactccgacggatctttcttcctctactcaaaactaactgtcgacaaatccagatggcaacaaggcaacgtcttcagctgctccgtaatgcacgaagccctacacaaccactacacacaaaaatcgctatccttatcccccggcaaa

SEQ ID NO: 58763 - RNA, 1356 nt, synthetic construct
  misc_feature 1..1356: note = derived and/or modified sequence opt11 from anti-influenza_Chain
  source 1..1356: mol_type = other RNA
caggtccagctagtccaatccggcgccgaagtaaaacaacccggcgcttccgtcaaagtctcatgtaaagcctccggctacacattcaacgcctactatatccactgggtcagacaggcacccggacaaggtctcgaatggatgggttggataaaccccaacttcggcggaacccactacgcgcgcaaattccaaggaagagttacaatgacgcgcgacgcctccatcaacaccgcctacatggaactcgacaggctcataagcgacgacaccgccgtatactactgcgtacgctggcgagcagcagctgtaatcatggaccaattctacaaaatggacgtctggggccaaggcaccctcgtaactgtcagctccgcttccaccaaaggcccctcagtcttccccctagcaccctgcagccgcagcacctccgaaagcaccgccgccctcggctgcctggttaaagactacttccccgaaccggtcaccgtctcctggaacagcggagccctaacatccggcgtccacacattccccgctgtcctccaatcaagcggcctctactcactatcctccgtcgtcacagtcccctcctctagcctcggaacgaagacctatacctgcaacgtagatcacaagccctccaacacaaaagtcgacaaaacacgagaatccaaatacggcccaccatgcccctcttgccccgcccccgagttcctcggaggcccctccgtcttcctcttcccacccaaacccaaggacaccctcatgatatcacgcacacccgaagttacatgcgtcgtagtcgacgtctcccaagaagatcccgaagtccagttcaactggtacgtcgacggcgtcgaagtccacaacgctaaaacaaaaccccgcgaagaacaattcaactcaacctaccgcgtcgtatccgtccttaccgtcctccaccaagactggctcaacggaaaagaatataagtgcaaagtatccaacaaagggctcccttcatcaatcgaaaagaccatctccaaagccaaaggccaaccacgagaaccacaagtctacaccctcccacccgcccaagaagaaatgaccaaaaaccaagtatccctaacctgcctcgtaaaaggattctacccctcagacatcgccgtcgaatgggaatccaacggccaacccgaaaacaactacaaaacaaccccgcccgtcctcgactccgacggcagtttcttcctctactcacgactaaccgtagacaaatcccgctggcaagaaggaaacgtcttctcatgctcggtcatgcacgaagctctgcacaaccactatactcagaaatcactctcactatcactcggcaaa

SEQ ID NO: 58764 - RNA, 1356 nt, synthetic construct
  misc_feature 1..1356: note = derived and/or modified sequence opt11 from anti-influenza_Chain
  source 1..1356: mol_type = other RNA
gaagtccaactcgtccaatccggcgcagaagtcaagaaacccggcgcatctgtcaaagtctcctgcaaagcctccggctatatcttcaccggctactacatccactgggtacgccaagcccccggccaaggcctcgaatggatgggacgcatcgaccccaacggagctggcacaacctacgcacaaaaattccaaggccgagtcacactcacaatggacaccagcatcacaaccgcatacatggaactatcccgactccgcttcgacgacaccgccatctactactgcgcacgctgggactggaacttcgacctatacctaggctggttcgacccctggggacaaggaacccccgtcaccgtcgcctccgcctccactaaaggcccctccgtcttccccttagcaccgtcatccaaatccacttcaggaggcaccgcagccctaggatgcctcgtaaaagactacttccccgaacccgtcaccgtatcctggaactccggcgccctaacctccggcgtacacaccttcccagccgtcctccaaagctcaggcctctactccttatcctccgtcgtcactgtcccctcttcatctctaggaacacaaacatacatctgcaatgtcaaccacaaaccatcaaacaccaaagtcgacaagaaagtcgaacctaaatcctgcgacaaaacccacacatgcccaccctgcgcccccgaactcctcggaggcccctccgtattcctgttcccacccaaacccaaagatacactcatgatctcccgcacacccgaagtcacatgtgtcgtcgtcgacgtatctcacgaagaccccgaagtcaaattcaactggtacgtagacggcgtcgaagtccacaacgccaaaaccaaaccccgagaagaacaatacaactccacctatcgcgtagttagcgtactaacagtcctccaccaagactggctcaacggcaaagaatacaaatgcaaggtatccaacaaagccctccccgcacccatcgagaaaacaatatccaaagccaaaggacaaccccgagaaccccaagtatacacactcccaccatctcgcgaagaaatgaccaaaaaccaagtttccctgacatgcctcgttaaaggattctacccctctgacatcgccgtcgaatgggaatctaacggacaacccgaaaacaactacaaaacaaccccacccgtcctcgactccgacggctcattcttcctatactccaaactcactgtcgacaagtcccgctggcaacaaggcaacgttttctcctgctccgttatgcacgaagcactccacaaccactacactcaaaagtccctctccctttcaccaggcaaa

SEQ ID NO: 58765 - RNA, 1356 nt, synthetic construct
  misc_feature 1..1356: note = derived and/or modified sequence opt11 from anti-influenza_Chain
  source 1..1356: mol_type = other RNA
caagtccaactcgtccaatccggcgcagaagtcaaacaaccaggggcctcagtcaaagtctcctgcaaagcctccggctacaccttcaacgcctactacattcactgggtccgccaagctcccggccaaggcctcgaatggatgggctggataaaccccaacttcggcggcacccactacgccagaaaattccaaggccgcgtcaccatgacacgcgacgcatccataaataccgcctacatggaactagaccgcctcatatctgacgacacagctgtctactactgcgtccgctggagagccgccgcagtcatcatggaccaattctacaaaatggacgtatggggccaaggcacactcgtcaccgtctcctccgcctccaccaaaggcccctcagtattccccctcgcaccttgctccagatccacatcagaaagcaccgccgcactcggatgcctcgtcaaagactactttcccgaacccgtcacagtctcatggaactccggcgccctcacctccggcgtccacaccttccccgccgtcctccaaagctcaggactatactccctctcatccgtcgtcaccgtaccatcctcaagcctaggcacgaaaacatatacctgcaacgtagaccacaaaccctccaacaccaaagtcgacaaaacccgcgaatccaaatacggacccccatgccccagctgcccagcccccgagttcctaggcggccccagcgtcttcctattccctcccaaacccaaggacacactaatgatctcccgcacccccgaagttacctgcgtcgtcgtcgacgtctcccaagaagaccccgaagtccaattcaactggtacgtcgacggcgtagaagtccataacgccaaaaccaaaccccgcgaagaacaattcaactctacataccgcgtagtatcggtactaaccgtactccaccaagactggctaaacggaaaggagtacaaatgcaaggtctcaaacaaaggcctcccctcctccatcgagaaaaccataagcaaggcaaaaggtcaaccacgtgaaccacaagtctacaccctcccacccgcccaagaagaaatgaccaaaaaccaagtctcactaacctgcctcgtcaaaggcttctacccctcagacatcgccgtcgaatgggaaagcaacggccaacccgaaaacaactacaaaaccactcccccagtcctcgactccgacggatcattcttcctgtactcccgtctcaccgttgacaaatcccgctggcaggaaggcaacgtcttctcctgctcagtaatgcatgaagccctgcacaaccactacacacaaaaatccctttcactctccctaggcaaa

SEQ ID NO: 58766 - RNA, 1356 nt, synthetic construct
  misc_feature 1..1356: note = derived and/or modified sequence opt11 from anti-influenza_Chain
  source 1..1356: mol_type = other RNA
caagtacaactcgtccaatccggaggaggcctcgtcaaacccggaggctcactccgactatcttgcgccgcctccggattcaccttttccagctactctatgaactgggtacgccaagcaccaggcaaggggttagagtgggtatcatccatctcctcatcatctagctacatatactatgtcgattccgtaaaaggccgattcaccatctctcgcgacaacgccaagaactccctctatctccagatgaatagcctccgagcggaagacacagccgtctactactgcgcacgcggcggcggatcctacggcgcctacgaaggcttcgactactggggtcaaggcacactcgtcacagtatcatcagcctccaccaaaggcccctccgtcttccccctagcccccagctcaaaatccacctcaggcggcaccgccgccctaggctgcctcgtcaaagactacttcccagaacccgtaacagtctcctggaactccggagccctcacctccggagtccatacattcccagcagttcttcaatcctccggcctctactccctctcctcagtcgtcacagttccctcatcatcactcggcacccaaacctacatctgcaacgtcaaccacaaacccagcaacactaaagttgacaaacgcgtcgaaccaaaatcatgcgacaaaacccacacatgcccaccctgccccgcgcccgaactcctcggcggaccctccgtattcctcttccctcccaaacccaaagacaccctcatgatctcccgtacccccgaagtcacatgcgtcgtagtcgacgtatcccacgaagaccccgaggtcaaattcaactggtatgtagacggcgtagaagtacacaacgccaaaaccaaaccccgagaagaacaatacaactccacctaccgagtcgtctcagtactcaccgtactccaccaagactggctaaacggaaaagaatacaaatgcaaagtctccaacaaagccctccccgcaccaatcgagaaaaccataagcaaagccaaaggacaaccccgcgaaccccaagtctacacccttccaccctcacgcgaagaaatgaccaaaaaccaagtttcacttacctgcctcgtcaaaggcttctacccctccgacatcgccgtggagtgggaaagcaacggacaacccgaaaacaactacaaaaccaccccacccgtactcgactcggacggctccttcttcctctactccaaactcaccgtcgacaaatcacgctggcaacaaggcaatgtcttctcttgctccgtcatgcacgaagccctccacaaccactacacccaaaaatcactctccctctcccccggaaaa

SEQ ID NO: 58767 - RNA, 1356 nt, synthetic construct
  misc_feature 1..1356: note = derived and/or modified sequence opt11 from anti-influenza_Chain
  source 1..1356: mol_type = other RNA
gaagtccaactcgtacaatccggcgccgaagtcaagaaacccggcgcctccgtcaaagtatcatgcaaagcctcaggctacatattcacaggttactacatccactgggtgcgccaagcccccggccaaggcctagaatggatgggccgcatcgaccccaacggcgccggtactacctacgcccaaaaattccaaggacgagtcacactcacaatggacacttccatcaccactgcctacatggaactatcccgacttcgcttcgacgacactgctatctactactgcgcgagatgggactggaacttcgacctctacctcggctggtttgacccctggggccaaggcaccccagtcaccgttgcctccgcctccaccaaaggcccatcagtcttccccctcgccccctccagcaaaagcacatctggaggcaccgcggcactcggatgcctcgtcaaagactacttccccgaacccgttacagtctcctggaactccggagcattaacgtccggagtccacaccttcccagccgtcctacaatcatccggactttactccctctcctccgtcgtcaccgtcccctcctcctccctcggaacccaaacctacatctgcaacgtaaaccacaaaccctccaacaccaaagtcgacaagaaagttgagccaaaatcatgcgacaaaactcacacatgcccaccctgcgccccagaactactaggcggaccctccgtattcctcttcccacccaaacccaaagacaccctgatgatctcccgaacccccgaagtaacctgcgtcgtcgtcgacgtctcccacgaagaccccgaagtcaaattcaactggtacgtcgacggtgtcgaagtccacaacgcaaaaaccaaaccccgcgaggaacaatacaactccacctaccgagtcgtttccgttctcaccgtactccaccaagactggctcaacggaaaagaatacaaatgcaaagtctcgaacaaagccctccccgcacccatcgagaaaacaatctccaaagccaaaggccaacctcgagaaccccaagtctacaccctacctccctcacgcgaagaaatgaccaaaaaccaagtctcactcacttgcctggtaaaaggcttctacccctccgacatcgctgttgaatgggaatctaacggccaacccgaaaacaattacaaaaccaccccacccgtactcgacagcgacggctcattcttcctctactccaaactaacagtagacaaatcacgctggcagcaaggcaacgtcttctcatgctctgtaatgcacgaagcattacacaaccactacactcagaaatcactctcactctcccccgggaag

SEQ ID NO: 58768 - RNA, 1359 nt, synthetic construct
  misc_feature 1..1359: note = derived and/or modified sequence opt11 from anti-influenza_Chain
  source 1..1359: mol_type = other RNA
caagtacaactcgtccaatccggagcagaagtcaagaaacccggcagcagcgtccgcgtctcctgcaaagcatcaggctccatcttcagaaactacgccatgtcctgggtacgccaagcacccggccaaggactagaatggatgggcggcataatcgcaatattcggaaccccaaaatatgcccaaaaattccaaggccgcgtcaccataaccgctgacgaaagcacatcaacagtctacatggaactctccggactccgctccgaagacaccgcaatgtactactgcgcaagaatcccccactacaacttcggctctggctcctacttcgattactggggccaaggcaccctcgtaacagtctcatccgcctccaccaaaggtccctccgtcttccccctcgccccctcctccaaatccacctccggcggaaccgccgccctcggatgcctagttaaagactacttcccagaaccagtcaccgtgtcatggaactcaggcgcactcacctccggcgtccacacattccccgccgtactccaatcatccggcctatactccctctcttcagtcgtcaccgtcccctcctcctcactcggcacacaaacatacatatgcaacgtaaaccacaaacccagcaacaccaaagtcgacaaaagagtcgaacccaaatcctgcgacaaaacccatacctgcccaccctgccccgcccccgaactcctcggcggcccctcagtcttcctgttcccacccaaaccaaaagacaccctcatgatttccagaacccccgaagtcacatgcgtagtcgtcgacgtctcccacgaagaccccgaagtcaaattcaattggtacgtcgacggcgtcgaggtccacaacgccaaaaccaaaccccgcgaagaacaatacaactccacataccgcgtcgtgtccgtactcaccgtactccaccaggactggctaaacggcaaagaatacaaatgcaaagtctccaacaaagccctaccagccccaatagagaaaaccatatccaaagccaaaggccaaccccgcgaaccacaagtctacactctcccaccctcacgtgaagagatgaccaaaaaccaagtctccctgacctgcctcgtaaaaggattctacccctcagacatagccgtcgaatgggaatccaacgggcaaccagaaaacaactacaaaacaacaccccctgtactcgactcagatggctccttctttctctactcaaagctcacagttgacaagtcccgctggcaacaaggcaacgtcttctcctgctccgtcatgcacgaagcactccacaaccactacacccaaaagtccctctcactctcccccggcaaa

SEQ ID NO: 58769 - RNA, 1359 nt, synthetic construct
  misc_feature 1..1359: note = derived and/or modified sequence opt11 from anti-influenza_Chain
  source 1..1359: mol_type = other RNA
caagtccaactcgtacaatccggagccgaagtaaagaaacccggtgcctccgtaaaagtgtcctgcaaagccagcggatacatcttcactggatactacatacactgggtccgacaagcccccgggcaaggcctcgaatggatgggccgcatcgaccccaacggaagcggcaccacctacgcgcaaaaattccaaggcagagtcaccctcaccatggacacctccattaccaccgcgtacatggaactctcccgcctacgcttcgacgacaccgccatctactactgcgcccgatgggactggaactttgacctatatctcggctggttcgacccatggggacaaggcacaccagtcaccgtcgcctccgcgtccaccaaaggcccatcagtcttccccctcgcccccagctcaaaatccacctccggcggcacggcagccctcggatgcctcgtcaaagactacttccctgaacccgtaacagtctcatggaactccggagccctcaccagcggcgtccacaccttccccgctgtactccaatcatcagggctatactccctctcctcagtcgtgaccgtcccctcatcttcactcggcacacaaacctacatctgcaacgtaaaccacaaaccatccaacaccaaagtagacaagaaagtcgaacccaaatcctgcgacaaaacccacacctgtcccccatgccccgcacccgaactactcggaggcccatccgtattcttattcccacccaaacccaaagacacactaatgatctcccgcacccccgaagtaacctgcgtcgtagtagacgtctcccatgaagacccagaagtaaaattcaactggtacgtcgacggggtagaggtccacaacgcaaaaaccaaaccccgagaagaacaatacaactcaacctaccgagtagtctccgtcctgaccgtactccaccaagactggctcaacggcaaagaatacaaatgcaaagtctcgaacaaagccctacccgccccaatcgagaaaaccatctccaaagccaaaggccaacccagggaacctcaagtatacacactcccaccatcccgcgaagagatgaccaaaaaccaagtatccctcacttgcctagtcaaaggcttctacccaagcgacatcgccgtcgaatgggagtccaacggccaacccgaaaacaactacaaaaccaccccacccgtcctagactccgacggctccttcttcctctactccaaattaaccgtcgacaaatcccgctggcaacaaggcaacgtattctcatgctcagtcatgcacgaagccctacacaaccactacactcaaaaatcgctctccctctcaccaggaaaa

SEQ ID NO: 58770 - RNA, 1359 nt, synthetic construct
  misc_feature 1..1359: note = derived and/or modified sequence opt11 from anti-influenza_Chain
  source 1..1359: mol_type = other RNA
gaagtccaactggtccaatcaggagccgaagtaaagaaacctggagcctccgtcaaagtctcatgcaaagcatcaggatacatatttaccggctactacatccactgggtccgccaagctcccggccaaggactcgaatggatgggccgcatcgaccccaacggcgcaggtaccacatacgcccaaaaattccaaggccgagtaaccctaactatggatacatccatcaccaccgcctacatggaactctcacgcctacgcttcgacgacactgcaatctactactgcgcccgctgggactggaacttcgacctctacctgggctggttcgacccctggggacaaggaacccccgtcacagtcgcctccgccagcacaaaaggcccctccgtattcccactagccccatcctccaaaagcacatcaggcggaaccgcagccctcggctgcctcgtcaaagactacttcccagaacccgttaccgtctcctggaactccggcgccctaacatccggcgtccacaccttcccagccgtccttcaatctagcggcctctactcactctcctccgtcgtcaccgtcccctcctcatccctcggaacccaaacctacatctgcaacgtcaaccacaaaccctccaacaccaaagtcgacaagaaagtcgaacccaaatcttgcgacaaaacccacacctgtcctccctgccccgccccagaactactcggaggcccctccgtatttctcttcccacccaaaccaaaagacactctaatgatctcccgcacaccagaagtcacatgcgtcgtcgtcgacgtctcccatgaagaccccgaagttaaattcaactggtacgtcgacggcgtagaagtacacaacgctaaaaccaaaccccgcgaagaacagtacaactcgacataccgcgtcgtctccgtcctcacagttcttcaccaagactggctaaacggaaaagaatacaagtgcaaagtctccaacaaagccctccccgccccaatcgagaaaacgatcagcaaagccaaaggccagccccgcgaaccccaagtatacaccctaccaccaagccgcgaagaaatgaccaaaaatcaagtctcactcacatgcctagtcaaaggattctaccccagcgacatagccgtcgaatgggaatccaacggccaacccgaaaacaactacaaaaccacacccccagtactcgacagcgacggctccttcttcctatactcaaaattaacagtcgacaagtccaggtggcaacaaggcaacgtcttctcatgttcagtcatgcacgaagccctccacaaccactacacccaaaaatccctctccctctcacccggcaaa

SEQ ID NO: 58771 - RNA, 1359 nt, synthetic construct
  misc_feature 1..1359: note = derived and/or modified sequence opt11 from anti-influenza_Chain
  source 1..1359: mol_type = other RNA
caagtacaactcgtccaatccggcgcagaagtcaagaaacctggcgcctccgtaaaagtctcttgcaaagcctccggctacaccttcaacgcccatcacatgcactgggtacgccaagccccaggacaaggcctcggctggatgggctggatcgaccccaacaacgatggcacaatctacgcacagaaattccaaggccgcgtaacactcacaatggacacatccatacacacagcatacatggaactctccggactacgctacgacgacaccgcaatctactactgcgtccgatgggcctggaacttcgacttcttcctcggatggttcgacccctggggccaaggcaccctagtcaccgtagcctccgcctccaccaaaggaccatccgtcttccccctagccccctcgagcaaatcaacctccggcggaactgccgcactaggatgcctcgtcaaagactacttccccgaacccgtcaccgtatcgtggaactccggcgccctcacctccggcgtccacacatttcccgctgtcctccaatcatccggcctctactccctctcaagcgtcgtcaccgttccctcaagttccctcggaacacaaacatacatctgcaacgtcaaccacaaaccatccaacacaaaagtcgataagaaagtcgaacccaaaagctgcgacaaaacccacacatgtcccccatgccccgcccccgaactcctaggcggaccctccgtcttcctattcccacccaaacccaaagacacactaatgatctcccgaacacccgaagtcacatgcgtagtagtcgacgtcagccacgaagaccccgaagtcaaatttaactggtacgtcgacggagtagaggtacacaacgccaaaaccaaaccccgcgaagaacaatacaactccacataccgagttgtctcagtactaacagtcctccaccaggactggctcaacggcaaagagtacaaatgcaaagtctctaacaaagcccttccagcccccatcgaaaagacaatctcaaaagctaaaggccaaccccgcgaaccccaagtctacaccctcccaccaagccgggaagaaatgaccaaaaaccaagtatcgctaacgtgcctcgtcaaaggcttctacccctccgatatcgccgtcgaatgggaatcgaacggccagcccgaaaacaactacaaaaccaccccgcctgttctcgactcagacggctccttcttcctatactcaaaactcaccgtcgacaaatcacgctggcaacaaggcaacgtcttctcttgctcagtcatgcacgaagccctacacaaccactacacccaaaaatccctctccctatcacccggcaaa

SEQ ID NO: 58772 - RNA, 1359 nt, synthetic construct
  misc_feature 1..1359: note = derived and/or modified sequence opt11 from anti-influenza_Chain
  source 1..1359: mol_type = other RNA
gaagtccagctggtgcaatccggagctgaagtcaagaaaccaggagaaagcctcaaaatctcatgcaaagtatcaggatatagcttcacgtcacaatggatcggctgggtccgacaaatgcccggaaagggactagaatggatcggcatgatgtaccccggcgactccgacacaatctactccccctcattccaaggccaagtaaccatatcagctgacaactccatctcaacagcctacctccaatggtcatccctaaaagcatccgacaccgccatatactactgtgccagcggacccggatactctggataccactacggctggttcgacacatggggccaaggaacactcgtcaccgtctcatccgcatcaactaaaggcccaagcgtcttccccctagccccctccagcaaatccacctctggaggcaccgcagccctcggctgcctggtcaaagactatttccccgaacccgttaccgtctcctggaacagcggcgccctaacctcaggcgtccacaccttccccgccgtcctccaatcatcaggactctactccctctcctcggtcgtcaccgtcccgtcctccagcctgggcacgcaaacctacatctgcaatgtcaaccacaaaccctccaacaccaaagtcgacaagaaagtcgaacccaaatcctgcgacaaaacccacacctgtccaccctgccccgcccccgaactcctaggcggcccctccgtcttcctcttcccacccaaacccaaagacaccctcatgatctcccgcacccccgaagtaacctgcgtcgtcgtagacgtgtcacacgaagaccccgaagtcaaattcaactggtacgtcgacggcgtagaagtacacaatgccaaaaccaaaccccgcgaagaacaatacaactccacctaccgcgttgtaagcgtactcacagtactacaccaagactggctcaacggcaaagaatacaaatgcaaagtatccaacaaagccctacccgcccccatcgagaaaacaatatcaaaagccaaaggccaaccacgcgaaccacaagtctacacactacccccatcccgagaagaaatgaccaaaaaccaggtctcactgacctgcctcgtcaaaggattctacccatccgacatcgcagtagaatgggaatccaacggccaacccgaaaacaactacaaaaccacccctccggtcctcgactccgacggctcattcttcctctacagcaaactcaccgtcgacaagtcccgctggcaacaaggaaacgtattctcatgctccgtaatgcacgaagccctacacaaccactacacacagaaatcactctccctctctcccggcaaa

SEQ ID NO: 58773 - RNA, 1359 nt, synthetic construct
  misc_feature 1..1359: note = derived and/or modified sequence opt11 from anti-influenza_Chain
  source 1..1359: mol_type = other RNA
gaagtccaacttgtccagtccggcgctgaagtcaagaaacccggcgaatcactcaaaatatcctgcaaagtatctggctactccttcacctcacaatggatcggctgggtccgacagatgcccggaaaaggcctcgaatggattggcatgatgtacccaggcgacgctgacgccatctactctcccagcttccaaggacaagtcacaatatccgccgacaactccatctccacggcataccttcaatggtcctccctaaaagcctccgataccgcaatctactactgcgcttcaggccccggttacagcggctaccactacggctggtttgacacctggggacaaggcaccctcgttaccgtatcctcagcctcaacaaaaggcccctctgtattccccctcgcaccctcatccaaatcaacctccggcggcaccgccgccctcggatgcctcgtcaaagactacttccccgaaccagtcacggtctcgtggaactccggagctctcacctccggcgtacacaccttccccgccgtactccaatcctccggactatattccttatccagcgtcgtcacagtcccctcctcatcactcggtacccagacctacatctgcaacgtcaaccacaaaccctccaacactaaagtagataagaaagtggaacccaaatcctgcgacaaaacccacacatgcccaccctgccccgcccccgaactcctcggcggcccctccgtcttcctatttccacccaaacccaaagacaccctcatgatctcccgtaccccagaagtcacctgtgtagtcgtcgacgtctcacacgaggaccccgaagtcaaattcaactggtatgtcgacggcgttgaagtacacaacgccaaaaccaagccacgcgaagaacaatacaactccacctacagagttgtctccgtcctaactgtcctccaccaggactggctaaacggcaaagaatacaaatgcaaagtctcaaacaaagccctccccgcccctatcgagaaaaccatctccaaagcaaaaggccaacccagagaaccccaagtctacaccctcccaccctctagagaagaaatgaccaaaaaccaggtctcactaacctgcctcgtcaagggcttctacccatccgacatcgccgtcgaatgggaatccaacggccagcccgagaacaactacaaaacaaccccacccgtcctcgattccgacggcagcttcttcctatacagcaaactcaccgtcgacaaatcacgatggcagcaaggcaacgtcttctcctgcagcgtcatgcacgaagcccttcacaaccactacacccaaaaatccctctccctctctcccggcaag

SEQ ID NO: 58774 - RNA, 1359 nt, synthetic construct
  misc_feature 1..1359: note = derived and/or modified sequence opt11 from anti-influenza_Chain
  source 1..1359: mol_type = other RNA
gaagtacagctagtacaatccggagccgaagtcaaaaagcccggagaatctctcaaaatatcctgcaaggtctccggctactcctttacctcccaatggataggctgggtccgacaaatgcccggaaaaggcctagaatggataggaatgatgtacccaggcgaatcagaaaccatctactcaccttccttccaaggccaagtaaccataagcgccgacaacagcatctctaccgcctacttacaatggagctccctaaaagcctccgataccgcaatctactactgcgcctccggacccggctacagcggctaccactacggatggttcgacacctggggccaaggcaccctggtcacagtctcatccgcctccaccaagggcccatccgtattccccctcgccccctcctctaaatccacatccggcggcaccgcagccttaggatgcctcgtcaaagactacttccccgaaccagtcaccgtttcctggaactccggcgccctaacctccggcgtacacaccttcccagccgtgctacagtccagcggcctctactccctatcctccgtcgtaaccgtaccatcctcctccctcggcacccaaacctacatctgcaatgtcaaccacaaaccctcaaacaccaaagtcgacaagaaagtcgaaccaaaatcctgcgacaaaacacacacatgccctccctgccccgcccccgaactcctcggaggtccctctgtcttcctcttcccaccgaaaccaaaagacaccctcatgatctcccgcacccccgaagtaacatgtgtcgtagtcgacgtctcgcatgaagacccagaagtcaaattcaactggtacgtcgacggcgtagaagtacacaacgccaaaacaaaaccacgcgaagaacaatacaactcaacataccgagtcgtatccgtactcacagtactccaccaagactggctcaacggcaaagaatacaaatgcaaagtctccaacaaggcgctaccagcccccatcgagaaaaccatcagcaaagccaaaggccaaccccgcgaaccccaagtatacacactaccacccagccgcgaagaaatgaccaaaaaccaagtctcactcacttgcctagtcaaaggcttctacccctccgacatcgccgtggaatgggaatcaaacggccaacccgaaaacaactacaaaaccacacccccagtcctcgactccgacggatcattcttcctctactccaagctaaccgtagacaaatcccgctggcaacaaggcaacgtcttcagctgctccgtaatgcacgaagccctacacaaccactacacccaaaaatccctctccctctcccccggcaaa

SEQ ID NO: 58775 - RNA, 1359 nt, synthetic construct
  misc_feature 1..1359: note = derived and/or modified sequence opt11 from anti-influenza_Chain
  source 1..1359: mol_type = other RNA
gaagtccaactcgtccaatcaggcgccgaggtcaagaaacccggcgaatcacttaaaatatcgtgcaaagtatccggctactccttcacatcccaatggatcggctgggtacgccaaatgcccggcaaaggcctagaatggatcggcatgatgtaccccggcgacgccgacaccatctactcccccagcttccagggacaagtcaccatctccgcagacaactccatatccactgcctacctccaatggtcctcactcaaagcatccgacaccgctatttactactgcgcctccggccccggctactcaggctaccactacggctggttcgacacctggggacaaggaaccctcgtcaccgtctccagcgcctccaccaaaggaccatccgtattcccactggctccctcctcaaaatcaacctctggcggcaccgcagccctcggctgcctcgtaaaagactacttccccgaacccgtcacagtatcatggaactcaggcgcactaacttccggcgttcacacattccccgcagtcctccaaagctccggcctttactccctatcatccgtcgtaaccgtcccttccagctcccttggtacccaaacctacatctgcaacgtcaaccacaaaccctccaacaccaaagtagacaagaaagtagaacccaaaagctgcgacaaaacacatacctgcccaccctgccccgcacccgaactcctcggcggccccagcgtcttcctattcccacccaaacccaaagacacactcatgatctcccgaacccccgaagtaacctgcgtcgtcgtcgacgtctcgcacgaagaccccgaagtcaaattcaactggtacgtcgacggagtcgaagtccacaacgccaaaaccaaaccccgcgaagaacaatacaactccacctaccgcgtcgtctctgtcctcaccgtactccaccaagactggctaaacggcaaagagtacaaatgcaaagtaagcaacaaagcgctccccgcaccaatagagaaaacaatctcaaaagcaaaaggacaaccccgcgaaccccaagtctacaccctacccccatcccgcgaagaaatgaccaaaaaccaagtctcactaacctgcctcgttaaaggcttctacccaagcgacatagccgtcgaatgggaatccaacgggcaaccagaaaacaactacaaaaccactcctcccgtcctcgacagtgacggctccttcttcctatattccaaactcactgtagacaaatccagatggcaacaaggcaacgtcttctcatgctccgtcatgcatgaagccctacacaaccactacacccaaaaatccctatccctctcccccggcaaa

SEQ ID NO: 58776 - RNA, 1359 nt, synthetic construct
  misc_feature 1..1359: note = derived and/or modified sequence opt11 from anti-influenza_Chain
  source 1..1359: mol_type = other RNA
gaagtgcagctagtccaatccggcgccgaagtaaagaaacccggcgaatccctaaaaatctcatgcaaagtttcaggctactccttcacgtcccaatggatcggatgggtcagacaaatgcccggaaaaggactcgaatggatcggcatgatgtaccccggctcctccgacactatctattccccttccttccaagggcaagtcacaatctccgcagataactccatctccaccgcatacctacaatggtcttcactcaaagcctccgacactgcaatctactactgcgcttccggacccggatactccggctaccactacggctggttcgacacttggggccaaggcaccctcgtaaccgtctcctccgcatctaccaaaggcccctccgtcttcccactagcaccatcctccaaatcaacctctggcggcaccgccgccctcggatgcctcgtgaaagactacttccccgaacccgtcaccgtctcctggaactccggcgccctcacctcaggcgtccacacattccccgccgtcctccaaagcagcggtctctactcgctatcctctgtcgtaaccgtcccatcctcctccctcggtacacaaacatacatctgcaacgtaaaccacaagcccagcaacaccaaagtagacaagaaagtagaaccaaaatcatgcgacaaaacccacacatgcccaccctgccccgcgcccgaactcctcggcggccccagcgtcttcctcttccctcccaaacccaaagacaccctcatgatctctcgaacccccgaagtaacctgcgtcgtcgtcgacgtctcccacgaagaccccgaagttaaattcaactggtacgtagatggagtcgaagtacacaacgccaaaacaaaaccacgcgaagaacaatacaactccacctaccgcgtcgtctcagttctaaccgtcctccaccaagactggctcaacggtaaagaatacaaatgcaaagtctccaacaaagccctcccagcacccatcgaaaagaccatcagcaaagcaaaaggccaaccccgcgaaccgcaagtctataccctcccaccatcccgagaagaaatgaccaaaaaccaagtctctctaacctgcctcgtcaaagggttctacccatcagacatagccgtcgaatgggaatccaatggccaacccgaaaacaactacaaaaccacaccacccgtcctcgactccgacggctccttcttcctatacagcaaactaaccgtcgacaaatcacgctggcaacaaggcaacgtcttctcgtgctccgtcatgcacgaagcactacacaatcactacacccaaaaatccctctctctctcgcccggcaaa

SEQ ID NO: 58777 - RNA, 1359 nt, synthetic construct
  misc_feature 1..1359: note = derived and/or modified sequence opt11 from anti-influenza_Chain
  source 1..1359: mol_type = other RNA
gaagtacaactagtccaatccggcgccgaagtaaaaaaacccggcgaatctctaaaaatcagctgcaaagtctcaggatactccttcacctcccaatggatcggctgggtccgccagatgcccggcaaaggcctcgaatggatcggcatgatgtaccccggcgactcagacgcaatatactcaccatcattccaaggccaagtaacaatctccgccgacaactccatctccaccgcctacctccaatggtcttcactcaaagcatcagacacagcaatctactactgcgcctccggacccggatactcaggataccactacggctggttcgacacctggggccaaggcacactagtaaccgtctcttccgcctcaacaaagggccccagcgtattccccctcgcaccctcctccaaatccacatccggcggaaccgccgcccttggctgcctcgtcaaagactacttccccgaacccgtcacagtatcctggaactccggcgcactcactagcggagtacacacattccccgccgtcctccaatccagcggcctctactcactcagctccgtagtcaccgtcccctcctcatcactcggaacacagacctacatctgcaacgtcaaccacaaaccctcgaacaccaaagtcgacaaaaaagtcgaacccaaaagctgcgacaaaacacacacttgccccccatgccccgcacccgaactcctcggcggcccctcagtcttcctattcccccccaaacctaaagacaccctaatgatctcccgcacccccgaagtcacatgcgtagtcgtcgacgtctcccacgaagatcccgaagtcaaattcaactggtacgtagacggcgtcgaagtccacaacgccaaaacgaaaccacgcgaagaacaatacaactcaacctaccgcgtcgtctccgtcctgacagttctccaccaagactggctcaacggcaaagaatacaaatgcaaagtctccaacaaagccctcccagcccccatagaaaaaaccatatccaaagccaaaggccaaccgcgcgaaccccaagtttatacactcccaccaagccgcgaagaaatgaccaaaaaccaagtctccctcacatgcctagtcaaaggtttctacccctcagacatagcagtagaatgggaatcaaacggacaacccgaaaacaactacaaaaccaccccccccgtactcgactcagacggaagcttcttcctttactccaaactcaccgttgacaaatcccgctggcaacaaggtaacgtcttctcatgcagcgtaatgcacgaagccctacacaaccactacacccaaaaaagcctatccctctcccccggaaaa

SEQ ID NO: 58778 - RNA, 1359 nt, synthetic construct
  misc_feature 1..1359: note = derived and/or modified sequence opt11 from anti-influenza_Chain
  source 1..1359: mol_type = other RNA
gaagttcaactcgtccaatccggcgcagaagtcaaaaagccaggcgaatcactaaaaatctcctgcaaagtctccggctacagcttcacctctcaatggatcggatgggtacgccaaatgccaggaaagggactcgaatggatcggcatgatgtaccccggcgacactgacaccatctactccccatcattccaaggccaggtcacaatctcagccgataactccatctccaccgcctacctccaatggtccagccttaaagcatccgacacagccatctactactgcgccagcggaccaggatacagcggctaccattacggatggttcgacacctggggccagggcacactcgtaaccgtctcctcagcctctaccaaaggcccctccgtcttccccctagcaccatcctcaaagtcaacatccggcggaaccgccgccttaggctgcctagtcaaagactacttccccgaacccgtcacagtaagctggaactccggcgcactaacctccggagtccacacctttcccgccgtcctccaatcctccggactctactccctatcatcagtagttaccgtcccctcctcatcactcggcacccaaacatacatctgcaacgtaaaccacaaaccctccaacaccaaagtcgacaagaaagtcgaacccaaatcctgcgacaaaacccacacctgtcccccttgccccgcacctgaactcctcggcggcccctctgtcttcctcttcccacccaaacccaaagacacccttatgatctccagaaccccagaagtcacatgcgtagtcgtagacgtctcccacgaagaccccgaagtcaaattcaactggtacgtcgacggcgtcgaagtccacaacgccaaaaccaaaccaagagaggaacagtacaactccacataccgcgtcgtatccgtcctcacggtcctccaccaagactggctcaacggcaaagaatacaaatgcaaagtctccaacaaagccctccccgccccaatcgagaaaaccatctccaaagcaaaaggacagccccgcgaacctcaagtctacaccctccctccatcccgagaagaaatgaccaaaaaccaagtatcactcacttgcctagtcaaagggttctacccctccgacatcgccgtagaatgggaatccaacggccaacccgaaaataattacaaaactaccccacccgtgctcgatagcgatggctccttcttcctctactccaaactcaccgtcgacaaatcacgctggcaacaaggcaacgtcttctcctgctccgtaatgcacgaagctctacacaatcactacacccaaaaatccctctccctctcccccggcaaa

SEQ ID NO: 58779 - RNA, 1359 nt, synthetic construct
  misc_feature 1..1359: note = derived and/or modified sequence opt11 from anti-influenza_Chain
  source 1..1359: mol_type = other RNA
gaagtccagctcgtccagtccggtgcagaagtcaaaaaaccaggtgagagcctaaaaatctcctgcaaagtatccggctactccttcacatctcaatggattggatgggtacgccaaatgccaggcaaaggactcgaatggatcggaatgatgtatcccggcgaatcagacaccatctactccccctccttccaaggacaagtcacaatttcagcagacaactccatatccaccgcctacctccaatggtcctcattaaaagcctccgacaccgcaatttactactgcgcctcaggccccggctactccggataccactacggatggttcgacacctggggacaaggcaccctcgtcaccgtctcttccgcctccacgaaaggaccctccgtcttccccctcgcccccagctccaaatcaaccagcggcggcaccgcagcactcggctgcctcgtaaaagactacttccccgaacccgtcaccgtctcctggaactcaggagccctgacctcaggcgtccacacattcccagcagtactccaatcctccgggctatactcactctcctccgtcgtcaccgtcccctcctccagccttggcacccagacatacatctgcaacgtcaaccacaaaccaagcaacaccaaagtcgacaaaaaagtcgaacccaaatcctgcgacaaaactcacacctgccctccctgccccgccccagaactcctcggcggcccctccgtcttcctcttcccccccaaacccaaagacaccctgatgatctcccgaacccccgaagtcacctgcgtcgtcgtcgacgtatcccacgaggaccccgaagtaaaattcaactggtacgtcgacggcgtcgaagtacacaacgccaaaaccaaaccccgtgaagaacaatacaactctacataccgcgtagtatctgtactaaccgtcctccaccaagactggctaaacggcaaagaatacaaatgcaaagtctccaacaaggccctccccgcgcccatcgaaaaaaccatctccaaagctaaaggccaaccacgcgaaccccaagtctacaccctacccccctcccgcgaagagatgacaaaaaaccaagtatccctaacctgcctcgtgaaaggattctacccgtccgacatcgccgtagaatgggaatccaacggacaacctgaaaacaactataaaaccaccccccccgtcctagactcagacggctcctttttcctctacagcaaactcaccgtcgacaaatcccgatggcaacaaggaaacgtcttctcctgctccgtcatgcacgaggcgctacacaaccactacacccaaaaatctctctcactttcccccggaaaa

SEQ ID NO: 58780 - RNA, 1359 nt, synthetic construct
  misc_feature 1..1359: note = derived and/or modified sequence opt11 from anti-influenza_Chain
  source 1..1359: mol_type = other RNA
caggtccaactcgtccaatcaggcgccgaagtaaagaaacccggaagctccgtccgagtatcatgcaaagcctcaggctcgatcttccgtaactacgcaatgtcctgggtaagacaagcccccggccagggactggaatggatgggcggcatcatagccatatttggcacacccaaatacgcgcaaaaattccaaggccgcgtaaccatcaccgctgatgaatccacatcgaccgtatatatggaactatccggactacgctccgaagacaccgccatgtattactgcgcccgaataccccactacaacttcggctccggcagctacttcgactactggggacaaggaactctcgtaaccgtctcctcagcctcaacaaaaggcccctccgtattcccgctcgccccctcctccaaatcaacaagcggaggcaccgccgccctcggatgcctagtcaaagactacttccccgaacccgtcacagtctcatggaacagcggcgccctcacctcaggcgtccacaccttccccgcagtactccaatcatcaggcctctacagcctatcatcagtagtcaccgtcccctcctcctccttaggaacccaaacctacatctgcaacgtcaaccacaaaccctccaataccaaagtcgacaaaagagtcgaacccaaatcctgcgataaaacccacacatgcccaccctgccctgcccccgaactactcggcgggccaagcgtcttcctctttccccctaaacccaaagacaccctgatgatctcccgaaccccagaggtaacctgcgtagtagtcgacgtatcccacgaagaccccgaagtaaaattcaactggtacgtcgacggagtagaagtccacaacgccaaaacaaaaccacgcgaagaacaatataactccacctaccgcgtagtctccgtactaaccgtccttcaccaagactggctcaacggaaaagaatacaaatgcaaagtatcaaacaaagccctaccagcccccatcgagaaaacaatatctaaagccaaaggccaaccacgcgaacctcaagtatacaccctcccaccctcccgcgaagaaatgaccaaaaatcaagtctcattaacctgcctcgtcaaaggattctacccctcagacatcgccgtcgaatgggaaagcaacggccaacccgaaaacaactacaaaacaacgcctcccgtactcgacagcgacggctctttcttcctatactctaaactcaccgtagacaaatcccgctggcaacaaggcaacgtcttctcctgctccgtaatgcacgaagccctccacaaccactacacccaaaaatcactctccctatcccccggcaaa

SEQ ID NO: 58781 - RNA, 1359 nt, synthetic construct
  misc_feature 1..1359: note = derived and/or modified sequence opt11 from anti-influenza_Chain
  source 1..1359: mol_type = other RNA
caggtccaactcgttcagtctggcgccgaagtcaagaaaccaggagcctccgtaaaagtctcttgcaaagcctcaggctacatcttcaccggctactacatccactgggtccgccaggcacccggtcaaggactagagtggatgggccgcatcgaccccaacggctccggaaccacctacgcccaaaaattccaaggccgagtaaccctcaccatggacacctccatcacaactgcctacatggaactctcacgcctccgcttcgacgacaccgcaatctactactgcgccagatgggattggaacttcgacctctacctaggctggttcgacccatggggacaaggcacacccgtcaccgtagcaagcgcaagcactaaaggcccctccgtcttccctctcgcaccctccagcaaatcaacctcaggagggacagccgcactcggctgcctcgtgaaagactacttccccgaacccgtcaccgttagctggaactccggcgccctcacatccggcgtccacaccttccccgccgtcctgcaatcctcaggtctatactccctctcctccgtagtcaccgtcccctcatcctcgctcggaacccagacatacatctgcaacgtaaaccacaaacccagcaacaccaaagtagacaagaaagtcgaacctaaatcgtgtgacaaaacccacacctgtcccccgtgccccgccccggaactcttaggcggaccctccgtcttcctcttcccacccaaacccaaagacaccctcatgatctcacgcacccccgaagtaacctgcgtcgtcgttgacgtatcccacgaagaccccgaagtcaaattcaactggtacgttgacggtgtcgaagtccacaacgccaaaaccaaaccccgagaggaacaatacaactccacttaccgcgtagtctccgtgctcaccgtactgcaccaagactggctcaacggcaaagaatacaaatgcaaagtctcaaacaaagcactccccgcccccatcgagaaaacaataagcaaagccaaaggccaaccccgcgaaccacaagtctacaccctaccaccctccagagaagaaatgaccaaaaaccaagtctcactaacatgccttgtcaagggcttctacccctccgacatagccgtcgaatgggaaagcaacggccaacccgaaaacaactacaagaccacacccccagtcctcgactcagacggctcctttttcctctactccaaactcaccgtcgacaaatcccgctggcaacaaggcaacgtattctcctgctctgtaatgcacgaagccctacacaaccattacacccaaaaatctctatcactttccccgggaaaa

SEQ ID NO: 58782 - RNA, 1359 nt, synthetic construct
  misc_feature 1..1359: note = derived and/or modified sequence opt11 from anti-influenza_Chain
  source 1..1359: mol_type = other RNA
gaagtccaactcgtacagtcaggcgccgaagtaaagaaacccggagccagcgtcaaagtctcctgcaaagcatccggatacatcttcaccggctactacatccactgggtccgacaagcccccggacagggcctcgaatggatgggccgcatcgatcccaacggcgccggcaccacctacgcccaaaaattccaaggccgcgtaaccctcaccatggacaccagcatcacaacagcctacatggaactctcacggctccgattcgacgacacagccatctactactgtgccagatgggactggaacttcgacctctacctcggctggttcgacccatggggacaaggtacacccgtcactgtcgcctccgcaagcaccaaaggcccctcagtcttccccctcgcaccctcatcaaagtccacatccggaggcacagccgccctcggctgcctcgtcaaagactacttccccgaacccgtcaccgtctcctggaactcgggagcgctaacaagcggagtccacacattccccgccgtactacaatcctccggcctctactcattatcatctgtagtcaccgtcccctcatcatccctaggaacccaaacctacatatgcaacgtaaaccacaaaccctccaataccaaagtcgacaagaaagtagaacccaaaagctgcgacaaaacccacacatgcccaccatgccctgcccccgaactcctcggcggaccctcagtattcctcttcccacccaaacccaaagacacacttatgatctcacgtacccccgaagtaacatgcgtagtcgtagacgtctctcacgaagaccccgaagtcaaattcaattggtacgtcgacggcgtcgaagtccacaacgccaagaccaagccccgagaagaacaatataactccacctatcgcgttgtctcagtcctaaccgtactacaccaagactggctcaacggcaaagaatacaaatgcaaagtctccaacaaagccctgcccgcacccatagaaaagactatctccaaagccaaaggccaaccccgtgaaccccaagtctacaccctcccaccctcccgagaagaaatgaccaaaaaccaagtctcccttacctgcctcgtcaaaggcttctacccctcagacatcgccgtcgaatgggaatccaatggccaacccgagaacaactacaaaaccacccctcccgtcctcgactccgatggatccttcttcctctactccaaattgaccgtcgacaaaagcagatggcaacaaggcaacgtcttctcctgctccgtaatgcacgaagcccttcacaaccactacacgcaaaagtcactctccctctcccccggaaaa

SEQ ID NO: 58783 - RNA, 1359 nt, synthetic construct
  misc_feature 1..1359: note = derived and/or modified sequence opt11 from anti-influenza_Chain
  source 1..1359: mol_type = other RNA
caagtccaactcgttcaatccggcgccgaggtcaagaaaccaggagccagcgtaaaagtttcttgcaaagcctccggctatacattcaatgctcaccacatgcactgggtccgccaagcccccggacaaggcctcggctggatgggatggatagaccccaacaacgacggaaccatctacgcccaaaaattccaaggccgcgtcacactcaccatggacactagcatacacactgcatacatggaactatccggcctccgctacgacgacaccgccatatactactgcgtccgctgggcatggaatttcgacttctttctcggctggttcgacccctggggccaaggaacgctagtcacagtcgcctcagcatccaccaaaggccccagcgtctttcccctcgcaccctccagcaaatccacctccggaggcacagcagccctcggctgcctcgtcaaagactacttccccgaacccgtcaccgtctcctggaactccggagccctaacctccggcgtacataccttcccagccgtcctacaatcatccggcctctactccctatcctcagtcgtaaccgtaccatcatcctcactcggaacccaaacctacatctgcaacgttaaccacaaaccctcaaacaccaaagtcgacaagaaagtagaacccaaatcctgcgacaaaacccacacttgcccaccctgccccgcccccgaactactcggaggcccctccgtcttcctcttcccacccaaacccaaagacaccctcatgatatcacgcacccccgaagttacctgcgtcgtcgtcgacgtcagccacgaagaccccgaagtcaaattcaactggtacgtcgacggcgtcgaagtccacaacgccaaaaccaaaccccgggaggaacaatacaactccacctaccgcgtagtctctgtcctcaccgtactccatcaagactggctcaacggcaaagaatacaaatgcaaagtatcaaacaaagcccttcccgccccaatagagaaaactatcagcaaagccaagggccaaccacgagaaccccaagtatacaccctacccccatcacgcgaagaaatgaccaaaaaccaagtctcactcacatgcctcgtcaaaggcttctacccttccgacatcgccgtcgaatgggaatccaacggccaacccgaaaacaactacaaaactaccccacccgtactggactccgatggttccttcttcctatactccaaactcacagtagacaagtctagatggcaacaaggaaacgttttctcctgctccgtcatgcacgaagcactccacaaccactacacccaaaaatccctttctctttcccccggaaaa

SEQ ID NO: 58784 - RNA, 1359 nt, synthetic construct
  misc_feature 1..1359: note = derived and/or modified sequence opt11 from anti-influenza_Chain
  source 1..1359: mol_type = other RNA
gaagtccaactcgtccaatccggcgccgaggtaaaaaaaccaggcgaatcactcaaaatctcctgcaaagtctccggttactccttcacctcccaatggatcggatgggtacggcaaatgcccggaaaaggactcgaatggatcggaatgatgtaccctggcgactccgacacaatctacagccccagcttccaaggacaggtcacaatctcagcagacaactccatctctacagcctacctccaatggagcagcctcaaagcatccgacaccgccatatactactgcgcttccggaccgggctactccggatatcactacggctggttcgacacatggggccaaggcacactagtcaccgtctcctccgcctcaaccaaaggaccaagcgtattcccactggcgcccagcagcaaaagcacctccggcggcacagccgcacttggctgcctggtcaaagactacttccccgaacccgtcaccgtctcctggaactccggcgccttaacatccggcgtccacaccttcccagcggtcctccaatcatcaggactatactccctctcctcagtcgtaaccgtcccatcatcctcgctcggcacccaaacctacatatgcaacgtcaaccacaaaccatccaacaccaaagtcgacaaaaaagtcgaacccaaatcctgcgacaaaacacacacctgcccaccctgccccgctccggaactactcggtggaccatccgtattcctattccccccaaaaccaaaagacaccctcatgatttcacgcacacccgaagtgacctgcgtcgtagtcgacgtatcccacgaagacccagaagtaaaattcaactggtacgtagacggcgtcgaagtccacaacgctaaaaccaaacccagagaagaacaatacaatagcacatatcgcgtagtctccgtccttaccgtactccaccaagactggctcaacggcaaagaatacaaatgcaaagtgtccaataaagccctccccgcccccatcgaaaagacaatctctaaagccaaaggacagccccgcgaaccccaagtctacaccctaccccccagccgagaagaaatgaccaaaaaccaggtaagcctcacctgcctggttaaaggcttctacccctccgacatcgcagtcgagtgggaatccaacggacaacccgaaaacaactacaaaactacgccgcccgtcctcgactccgacggctccttcttcctctactcaaaactaaccgtcgacaaatccagatggcaacaaggcaacgtcttctcctgctcagtgatgcacgaagccctacacaaccactacacacaaaaatccctaagcctgagccccggcaaa

SEQ ID NO: 58785 - RNA, 1359 nt, synthetic construct
  misc_feature 1..1359: note = derived and/or modified sequence opt11 from anti-influenza_Chain
  source 1..1359: mol_type = other RNA
gaagtccaactagtacaatccggcgcagaagtcaaaaaacccggtgaatccctaaaaatctcatgcaaagtaagcggctactccttcacctcccaatggatcggctgggtccgacaaatgccaggcaaaggcctagaatggataggcatgatgtaccctggtgacgccgacgccatctattccccatccttccaaggtcaagtcacaatctccgccgacaatagcatcagcacagcctatctccaatggtcctccctcaaagcctcagacaccgccatctactactgcgcctccggcccaggatactccggctaccactacggttggttcgacacatggggacaaggcaccctagtcaccgtcagctccgcttcaacaaaaggcccctcagtattccccctagccccctcctccaaatccacctcaggagggaccgccgccctcggatgcctagtcaaagactacttccccgaacccgtaaccgtctcctggaactcaggcgccctcaccagcggcgtccacaccttcccagccgtcctccaatcatcaggcctctactctctctcatcagtcgtaaccgtaccatcatcctccctaggaacccaaacatacatctgcaacgtcaaccacaaaccttccaacaccaaagtcgacaaaaaagtcgagcccaaatcctgcgacaaaacccacacctgcccaccatgccccgccccagaactcctcggcggcccctcagtcttccttttcccccccaaaccaaaagacacccttatgatctcccgaaccccagaagtcacatgtgtcgtcgtcgacgtatcacacgaagaccccgaagtaaagtttaactggtacgtcgacggcgtcgaagtccacaacgcaaaaaccaaaccccgagaagaacaatacaactcaacctaccgcgtcgtctcagtcttaaccgtcctccaccaagactggctcaatggcaaagaatacaaatgcaaagtctccaacaaagccctacccgcacccattgaaaaaaccatctccaaagccaaaggacaaccacgcgaaccccaagtgtacacactccccccctctcgcgaggaaatgaccaaaaaccaagtctccctcacgtgcctagtaaaaggcttctacccctccgacatcgccgtcgaatgggaatccaacggccaaccagaaaacaactacaaaaccaccccccccgtcctcgactccgacggctccttcttcctctattcaaaactcaccgtcgacaaaagccgatggcaacaaggcaacgtattcagctgctctgtaatgcacgaagccctccacaaccactacacacaaaaatccctctccctttcacccggcaaa

SEQ ID NO: 58786 - RNA, 1359 nt, synthetic construct
  misc_feature 1..1359: note = derived and/or modified sequence opt11 from anti-influenza_Chain
  source 1..1359: mol_type = other RNA
gaagtccagctcgtccaatcaggagcagaagtcaagaaacccggcgaatccctcaaaatatcttgcaaagtctccggctactccttcacctcccaatggatcggatgggtccgccagatgcctggcaaaggactcgaatggatagggatgatgtaccccggcgaatccgaaaccatctattctccctctttccaaggccaagtaacaatctccgccgataactccatatccaccgcgtacctccaatggtcttcactcaaagcatcagacaccgccatctactactgcgcatccggccccggatacagcggctaccactatggctggttcgacacctggggacagggcaccctcgtcacagtctcctccgcctccacaaaaggcccctccgtctttcccctcgccccctccagcaaaagcacctccggcggaacagccgctctcggctgcctcgtcaaagactactttcctgaacccgtcacggtctcctggaacagtggggccctaacctcaggcgtacacacttttccagcagtcctacaatcctccggcctatactctctatccagcgtcgtcaccgtaccctcttcctccctcggaactcaaacatacatctgcaatgtcaaccacaagccatccaacaccaaagtcgacaagaaagtcgaacctaaatcatgcgacaaaacccacacatgcccaccctgccccgcccctgaactcctaggcggcccatccgtattcctcttcccgcccaaacccaaagacaccctaatgatctcccggacccccgaagtaacctgcgtcgtcgtcgacgtctcacacgaggaccccgaagtcaaattcaactggtatgtcgacggagtcgaagtccacaacgcgaaaacaaaaccccgagaagaacaatacaattccacctaccgcgtcgtcagcgttctcaccgtcctccaccaagactggttaaacggcaaggaatacaaatgcaaagtatccaacaaagccctccccgcccccatcgagaaaaccatctctaaagccaagggccaaccccgcgaaccccaagtctacaccctcccacccagccgcgaagaaatgaccaaaaaccaagtctccctcacatgcctagtcaaaggcttctacccctcagacatcgcagttgaatgggaatccaacggccaacccgaaaacaactacaaaaccacccctcccgtcctcgactccgacggctctttcttcctttactcaaagctaaccgttgacaaatctcggtggcaacaaggcaacgtcttctcctgctccgtcatgcacgaagcgctccacaaccactatacccaaaaatcactctccctatccccaggcaaa

SEQ ID NO: 58787 - RNA, 1359 nt, synthetic construct
  misc_feature 1..1359: note = derived and/or modified sequence opt11 from anti-influenza_Chain
  source 1..1359: mol_type = other RNA
gaagtccaactcgtacagtccggagccgaagtcaagaaacccggcgaatcactaaaaatatcctgcaaagtctcaggctactcattcacctcccaatggatcggctgggtacgtcaaatgccaggcaaaggcctcgaatggatcggaatgatgtaccccggcgacgccgacacaatatattccccctccttccaaggacaggtcaccatctctgccgacaactctatctcaaccgcatacctccaatggtcttccctcaaagcctccgacaccgccatctactactgcgccagtggcccaggatacagcggctaccactatggctggttcgatacttggggacaaggaacactcgtcacagtatcatccgcctccaccaaaggcccctccgtcttccccctcgccccatcctcaaaatccacctccggaggaaccgcagccctcggctgcctcgtaaaagattacttccccgaacccgtaaccgtctcttggaactccggcgccctaacctcgggagtccacaccttccccgccgtcctccaatcatccgggctctacagcctctcctcggtcgtaaccgtcccctcctcctcactcggaactcaaacctacatctgcaatgtcaaccacaaaccaagcaacaccaaagtcgacaagaaagtcgaacccaaaagctgcgacaaaacccacacatgcccaccctgccccgcccccgaactccttggcggcccctccgtcttccttttcccacccaaacccaaagacaccctcatgatctcccgaacccccgaagtcacttgtgtagtcgtcgacgtatcacacgaagaccccgaagtcaaattcaactggtacgtcgacggcgtagaagtccacaacgccaaaaccaaaccccgcgaagaacaatacaactccacctaccgggtcgtctcggtactcacagttctccaccaagactggctaaacggaaaagaatacaaatgcaaagtctcaaacaaagccctcccagcacccatcgagaaaaccatctcaaaagccaaaggccaaccacgcgaaccacaagtatataccctcccgccctcacgagaagaaatgaccaaaaaccaagtctccctaacctgcctcgtcaaaggcttctatccctccgacatcgcagtagaatgggaatccaacggccaacccgaaaacaactacaaaaccacgccacccgtactagacagcgacggcagtttcttcctctactccaaactaaccgtcgacaaatccagatggcaacagggcaacgtcttctcctgctccgtcatgcacgaagccctccacaaccactacacccagaaaagcctctcactctcgccaggcaaa

SEQ ID NO: 58788 - RNA, 1359 nt, synthetic construct
  misc_feature 1..1359: note = derived and/or modified sequence opt11 from anti-influenza_Chain
  source 1..1359: mol_type = other RNA
gaagtacaactagtccaatccggcgccgaagtcaaaaaacccggagaatccctcaaaatcagctgcaaagtctccggctacagcttcacctcccaatggattggatgggtccgccagatgcccggcaaaggcctcgaatggatcggaatgatgtacccaggctccagcgacaccatatattccccatccttccaaggacaagtaaccatatccgctgacaacagcatctccactgcatacctacaatggtcctcccttaaagcctccgacaccgccatctactactgcgcctccggcccaggatactccggctaccactacggatggttcgacacatggggccaaggaaccctcgtcaccgtatccagcgcatcaactaaaggcccctccgtcttcccactcgccccctcaagcaaatccacctccggcggcaccgccgccctcggctgcctcgtaaaagactacttcccagaaccagtaacagtctcctggaacagcggcgcactaacatcaggcgtacacaccttccccgcagtcctccaatccagcggcctatactccctctcatccgtagtaaccgtcccatcctcctccctcggcacccaaacatacatctgcaacgtaaaccacaaaccctccaacaccaaagtagacaaaaaagttgaacccaaatcctgcgacaaaacacacacatgcccaccctgccccgccccagaactcctcggcggccctagcgtcttcctattcccacccaaaccaaaagacaccctcatgatctctcgcacccccgaagttacctgcgtagtcgtagacgtctcccacgaagacccagaagttaaattcaactggtacgtcgacggcgttgaagtccacaacgctaaaaccaagccgcgagaagaacaatataactctacctaccgagtcgtcagtgtcctcaccgtcctccaccaagactggctcaacggaaaagaatacaaatgcaaagtctccaacaaagccctccccgccccaatcgaaaaaaccatctccaaagcaaaaggccaaccccgcgaaccccaagtctacaccctaccgccctcccgcgaggaaatgacgaaaaaccaagtctcccttacatgcctggttaaaggattctacccttcagacatcgccgtcgaatgggaatcaaacggacaacccgaaaacaactacaaaaccacaccccccgtcctagactccgacggctccttcttcctctactccaaactcaccgtcgacaaatcacgctggcaacaaggaaacgtcttctcctgctccgtcatgcacgaagccctccacaaccactacacacaaaaaagcctctccctctccccaggcaaa

SEQ ID NO: 58789 - RNA, 1359 nt, synthetic construct
  misc_feature 1..1359: note = derived and/or modified sequence opt11 from anti-influenza_Chain
  source 1..1359: mol_type = other RNA
gaagtacaactcgttcaatccggcgcagaagtcaagaaaccaggcgaaagccttaaaatctcatgcaaagtctccggctactccttcacctcacaatggatcggctgggtacgccaaatgcccggaaaaggcctagaatggatcggcatgatgtacccaggcgactcagacgccatctactcaccctcattccaaggccaagtcaccatctcagcagacaacagcatctccaccgcctacctccaatggtcctccctcaaggcctccgacaccgccatatactattgcgcctccggccccggctactccggttaccactacggctggttcgacacatggggacaaggaaccctagtcaccgtcagctccgccagcacaaaaggaccctcagtcttcccactagccccatcaagcaaatcaacatcaggcggcacagccgccctcggctgcctcgtcaaagactacttccccgaaccagtcacggtctcttggaactccggcgcactcacctcaggagtccacaccttcccagccgtgcttcagtcctctggactctactcactctcatccgtcgtcacagtccccagttcctcactcggcacacaaacctacatttgcaacgtcaaccacaaaccttccaacacaaaggtggacaagaaagtcgaacccaaatcctgcgacaaaacacacacatgcccaccttgccccgcacccgaactactcggcggcccatccgtcttcctcttcccacccaaacctaaagacacactcatgatctcccgcacacccgaagtcacatgcgtagtcgtcgacgtctctcacgaagaccccgaagtaaaattcaactggtacgtagacggcgtcgaagtccacaacgcaaaaaccaaaccacgagaagaacaatacaactccacatatcgcgtagtctccgtcctcaccgtcctacaccaagactggctcaacggaaaagaatacaaatgcaaagttagcaacaaagccctcccggcccctatagagaaaaccatctcaaaagccaaaggccaacccagagaaccccaagtctacacactcccgccctccagagaagaaatgaccaaaaaccaagtatctcttacctgcctcgtcaaaggcttctacccctcagacatagcagtcgaatgggaatccaacggccaacccgaaaacaactacaaaacaaccccacccgtcctggactccgacggctcattcttcctttactccaaactcaccgtcgacaaatcgcgatggcaacaaggaaacgtcttctcatgctccgtaatgcacgaagccctccacaaccactacacccaaaaatccctatcactcagccccggcaaa

SEQ ID NO: 58790 - RNA, 1359 nt, synthetic construct
  misc_feature 1..1359: note = derived and/or modified sequence opt11 from anti-influenza_Chain
  source 1..1359: mol_type = other RNA
gaagtccaactcgttcaaagcggcgcagaggtcaaaaaacccggagagtccctaaaaatctcctgcaaagtctccggatactcattcacctcacaatggatcggctgggtgaggcaaatgcccggaaaaggactcgaatggatcggcatgatgtacccaggcgacaccgacaccatatactccccatcattccaaggacaagtcacaatctcagccgacaactctatatccaccgcctacctccaatggtcctctctcaaagcctccgacacagccatttactactgcgcctccggtcccggctactcaggctaccactacggctggttcgacacatggggccaaggcacattagtcaccgtatcatcagcttccacaaaaggaccatcagttttccccctcgccccctcatccaaatccacctccggaggaaccgccgccctcggctgcctcgtaaaagactacttccccgaacccgtcaccgtctcatggaactccggcgccctcaccagcggcgtccacaccttcccagctgtactccagtcatccggcctctacagcctcagttcagtcgtcaccgtcccctcctcatccctcggcacacaaacctacatatgcaacgtaaaccataaaccctcaaacaccaaggtcgacaaaaaagtcgaacccaaatcgtgcgacaaaacacacacatgcccgccctgccccgcacccgaactactcggcggcccctccgtcttcctcttcccccccaaacccaaagacacactcatgatatccagaacccccgaggtcacctgcgtggtcgtcgacgtatcccacgaagacccagaagtcaaattcaactggtacgtcgacggcgtcgaagtacacaacgccaaaaccaaaccccgtgaggaacaatacaacagcacttaccgagtagtttccgtcctcaccgtcctccaccaagactggctcaacggaaaagaatacaaatgcaaagtatcaaacaaagccctccccgcaccaatagaaaaaacaatctccaaagccaaaggacaaccccgagaaccccaagtatacacgctccccccctcccgtgaagaaatgaccaaaaaccaagtcagcctcacctgcctcgttaaaggcttctacccctccgacatagctgttgaatgggaatcaaacggccaacccgaaaacaactacaaaaccacaccccccgtactcgactccgacggatccttcttcctctactcaaaactcacagtagacaaatcccgctggcaacaaggcaacgtattctcctgctccgtcatgcacgaagccctccacaaccactacacccaaaaaagcctttccctttcacccggaaaa

SEQ ID NO: 58791 - RNA, 1359 nt, synthetic construct
  misc_feature 1..1359: note = derived and/or modified sequence opt11 from anti-influenza_Chain
  source 1..1359: mol_type = other RNA
gaagttcaactcgttcagtccggcgctgaagtcaaaaaaccaggcgaatccctaaaaatttcctgcaaagtctccggctactccttcacatcccaatggatcggctgggtacgccaaatgcccggcaaaggcctcgaatggataggcatgatgtaccccggcgaatccgacaccatatactccccatcattccaaggacaagtcaccatctccgcggacaactcgatcagcacagcatacctccaatggtcctcactaaaagccagcgacaccgctatatactactgcgcctccggccccggctactccggctaccactacggctggttcgacacatgggggcaaggcaccctcgtcaccgtctcctccgcgtccaccaaaggaccctcagtatttcccctagccccctccagcaaatccaccagcggcggcaccgccgccctaggttgtctcgtaaaagactacttccccgaacccgtaacagtctcatggaattctggcgccctcacctccggagtccacaccttcccagcagtcctccaaagctccggactatactccctctcctccgtagtcaccgtcccatcatcctccctcggaacacaaacctacatctgcaacgtcaaccacaaaccctccaacaccaaagtcgacaaaaaagtcgaacccaaatcttgcgacaaaacccacacctgtcccccctgcccagcccccgaactcctcggaggcccctctgtcttcctattcccccccaaacccaaagacacactaatgatatcacgcacaccagaagtcacctgcgtcgtcgttgacgtaagccacgaagaccccgaagtcaaattcaactggtacgtcgacggcgtagaagtccacaacgcaaaaaccaaaccccgcgaagaacaatacaacagcacctaccgagtcgtcagcgtcctaaccgtcctgcaccaagactggctcaatggcaaagaatacaaatgtaaggtctcaaacaaagccctacccgccccaatcgaaaaaaccatctcaaaagccaagggccaaccccgagaaccccaagtctacacacttcccccttccagggaagaaatgacgaaaaaccaagtatccctgacatgcctcgtcaaaggcttttacccctcagacatagccgtcgaatgggaaagcaacggccaacccgaaaacaactacaaaacaacgccccccgtcctcgactctgacggctcattcttcctctactcaaaacttaccgtcgacaaatcccgctggcaacaaggaaacgtattctcctgctccgtcatgcacgaagccctccacaaccactacacccaaaaatcgctcagcctatcaccaggaaaa

SEQ ID NO: 58792 - RNA, 1365 nt, synthetic construct
  misc_feature 1..1365: note = derived and/or modified sequence opt11 from anti-influenza_Chain
  source 1..1365: mol_type = other RNA
caggtacaactcgtcgaatccggaggaggcgtcgtccaaccaggccgctccctccgcctatcatgcgcagcctccggcttcgcatttcacaatcgcgccatgcactgggtccgacaagcccccggcaaaggactagaatgggtcgctctcatctacttcgacggctccaagcaatactacgcagacagcgtaaaaggcagattcacaatctcacgagacaattccaaaaacaccgtctttcttcaaatgaactcactccgtccagaagacacagccgtctactactgcgcagtccccggccccatcttcggcatatttcccccatggtcatacttcgaccactggggccaaggcatcctggtcactgtatcctccgcctctaccaagggcccatcagtcttcccactcgccccctcctccaaatccacatccggcggcacagcagccctcggctgcctcgtcaaagactacttccccgaaccagtaaccgtgtcatggaactcaggcgccctcacctccggcgtccataccttccccgcagtcctccagtcctccggcctctactccctatcctccgtcgtaaccgtccccagctcatcactaggaacccaaacatacatctgcaacgtcaaccacaaaccatccaacacgaaagtcgacaagaaagtcgaaccaaaatcctgcgacaaaacccacacatgccctccctgccccgcccccgaactcctcggcggaccctccgtcttcctattcccgcccaaaccaaaagacaccctcatgatatccagaacccccgaagtaacctgtgtagtagttgacgtatctcatgaagaccccgaagtcaaattcaactggtacgtagacggcgtagaagtacacaatgcaaaaacaaaaccccgcgaagaacaatacaacagcacctaccgcgtcgtatccgtcctcacagtcttacaccaagactggctcaacggcaaagaatacaaatgcaaagtttccaacaaagccctgcccgcccccatagaaaagaccatctccaaagccaaaggacaaccaagagaaccccaggtctataccctgcctccctcccgagaagaaatgaccaaaaaccaagtatccttaacctgcctcgtgaaaggcttctacccctccgacatagcagtcgaatgggaatcaaacggtcaacccgaaaacaactacaaaaccacgccacccgtcctcgactccgacggatctttcttcctctactccaaactcacagtcgataaatcccgctggcaacaaggcaacgtcttctcatgcagcgtaatgcacgaagctctccacaaccactacacccaaaagtccctctccctctcacccggcaaa

SEQ ID NO: 58793 - RNA, 1365 nt, synthetic construct
  misc_feature 1..1365: note = derived and/or modified sequence opt11 from anti-influenza_Chain
  source 1..1365: mol_type = other RNA
gaagtccaactcgtcgaatccggcggaggcgtcgtccaacccggccgatcccttcgcctctcctgtgccgcctccggatttgccttccacaaccgcgccatgcactgggtgcgccaagcccccggcaaaggactcgaatgggtcgcactcatctatttcgatggctccaaacaatactacgctgactccgtcaaaggccgctttacaatatcccgcgacaactccaaaaacaccgtcttcctacaaatgaactcactacgacccgaagacacagccgtctactactgcgccgtccccgggcccatcttcggcatcttccctccctggtcatacttcgaccactggggccaaggcatcctagtcaccgtctcctccgcctctaccaaaggcccctcagtcttccccctagcaccatcctccaaaagcacatccggcggcacagccgcactgggctgcctcgtaaaggactactttcccgaacccgtaaccgtctcatggaactccggcgcactaacctccggagtccacacattccccgccgtcctccaaagctccggactctactcactctcctccgtcgtcaccgtcccatcatcctccctaggaacccaaacctacatctgtaatgtaaaccacaaaccatcaaacacaaaagttgataagaaagtagaacctaaatcctgcgacaaaacccatacctgcccaccctgccccgcacccgagctcctcggcggacccagtgtcttcctattcccacccaaacccaaagacaccttaatgatctcaagaacccccgaagttacctgcgtcgtcgtcgacgtctcccacgaagaccccgaagtcaaattcaactggtacgttgacggagtagaggtccacaacgccaaaaccaaaccacgcgaagaacaatacaactccacatatcgcgtcgtaagcgtactcacagtgctacaccaggactggctcaacggcaaagaatacaaatgcaaagtctccaacaaagccctccccgcaccaatcgagaaaactatctccaaagccaagggccaaccacgcgaaccacaagtctacaccctacccccatcacgagaagaaatgaccaaaaaccaagtctcactcacgtgcctcgtaaaaggcttctacccctccgacatagcagtcgaatgggaatcaaacggccaaccggaaaacaactacaaaacaacacccccagtactcgactcagacgggtccttcttcctctactccaaactcactgtagacaaatcccgatggcaacaaggaaacgtcttctcctgctcagtaatgcacgaagccctccacaaccactacacccaaaaatccctctccctttcccccggcaaa

SEQ ID NO: 58794 - RNA, 1365 nt, synthetic construct
  misc_feature 1..1365: note = derived and/or modified sequence opt11 from anti-influenza_Chain
  source 1..1365: mol_type = other RNA
gaagtccagctagtccaatccggcggcggcgtcgttcaacccggcaaaagcctccgcctctcctgcgccgcctccggcctcaccttttcctcctacgccgtccactgggtccgacaagcccccggcaaaggcctggaatgggtcaccctcatctcctacgacggcgccaaccaatactacgccgattccgtaaaaggccgcttcaccatctcccgggataacagcaaaaacacagtctacctccaaatgaactctctccgtcccgaagacaccgccgtctactactgcgccgtacccggcccagtattcggcatcttcccgccctggtcatacttcgacaactggggccaaggcatcctagtaacagtatcatctgcatccactaaaggcccatcagtcttccccctcgccccctcaagcaaatccacctccggcggcaccgcagccctaggctgcctcgttaaagactatttccccgaacccgtaaccgtcagctggaactcaggcgccctaaccagcggcgtacacaccttccccgcagtcctacaaagctcaggcctctattccctcagctccgtcgtcacagtaccctcatcctccctcggcacccagacatacatctgcaacgtaaaccataaaccctccaacacaaaggtagacaagaaagtcgaacccaaatcctgcgacaaaacacatacatgcccaccatgcccggcccctgaactcctcggcggcccctccgtattcctcttcccaccaaaacccaaagacaccctaatgatatcacgcacacccgaagtaacctgcgtcgtagtcgacgtttcgcacgaagaccccgaggtaaaattcaactggtacgtcgacggcgtcgaagttcacaacgccaaaacaaaacctcgcgaagaacaatacaactccacataccgcgtcgtctcagtcctcacagtccttcaccaagactggctcaatggcaaagaatacaaatgtaaagtatccaacaaagccctcccagcccccatcgagaaaaccatatcgaaagccaaaggccaacccagagaaccacaggtctacacactaccaccctcacgagaagaaatgaccaaaaaccaagtctcccttacctgcctagtcaagggattctacccctcagacatcgccgtcgaatgggaatcaaacggacaacccgaaaacaactacaaaacaacacccccagtcctagactccgacgggtccttcttcctctactcaaaactcaccgtcgacaaatcacgctggcaacaaggaaacgtcttctcatgctcagtcatgcacgaagccctccataaccactacacccaaaaatcactttcactttcacccggtaaa

SEQ ID NO: 58795 - RNA, 1365 nt, synthetic construct
  misc_feature 1..1365: note = derived and/or modified sequence opt11 from anti-influenza_Chain
  source 1..1365: mol_type = other RNA
caagtccaactcgtcgaatctggaggcggcgtcgtacaacccggcaaatccctacgactatcctgcgcagcctccggactcacattctcctcctacgctgtccactgggtccgacaagccccaggaaaaggcctcgaatgggtaacactcatctcctacgacggcgccaaccagtactacgctgactcagtaaaaggccgcttcacaatctcacgagacaactccaaaaacaccgtataccttcaaatgaactcactccgcccagaagacaccgccgtctactactgcgccgtccccggccccgtcttcggcatttttcccccatggtcatacttcgacaactggggccaaggcatcctagtcaccgtcagctccgcctccacaaaaggaccctcagtcttccccctagccccctcaagcaaatccacatcaggcggcaccgccgcactcggatgcctcgtcaaagactatttccccgaaccagtcacagtatcctggaactcaggcgctctcacgtccggcgtccacaccttccccgcggtactacaatcttccggcctctactccctcagctccgtagtcaccgtcccctcctcctcactaggcacccagacctacatctgcaatgtaaaccacaaaccctcaaacaccaaagtcgataagaaagtagaaccaaaatcctgcgacaaaacccacacatgccctccctgccccgcacccgaactcctcggcggcccctccgtcttcctctttcccccgaaacccaaagacacactcatgatatcccgcacccccgaagtaacctgcgtcgtcgtagacgtctcccacgaagacccagaagtcaaattcaactggtacgtcgacggtgtagaagtccacaacgccaaaaccaaaccccgcgaagaacaatacaactcaacctaccgcgtagtctccgtcctcacagtcctccaccaggactggcttaacggcaaagaatacaaatgcaaagtctccaacaaagccctccccgccccaatagaaaagacaataagtaaagcaaaaggacaaccccgagaaccacaggtatacacactcccaccatcacgcgaagaaatgaccaaaaaccaagtctccctaacatgcctagtcaaaggcttctatccctccgacatcgccgtcgaatgggaatccaacggccaacccgaaaacaactacaaaaccaccccaccagtactcgactccgacggctccttcttcctctactccaaactcaccgtcgacaaatcccgctggcaacaaggaaacgtcttctcctgctcagtcatgcatgaagccctacacaaccactacacccaaaaatccctaagcctatcacccggcaaa

SEQ ID NO: 58796 - RNA, 1365 nt, synthetic construct
  misc_feature 1..1365: note = derived and/or modified sequence opt11 from anti-influenza_Chain
  source 1..1365: mol_type = other RNA
caagtccaactcgtcgaatcaggcggcggagtcgtccaaccaggcaaatcaccccgcctatcctgcgccgcttctggacccacattctcctcatacgccgttcactgggtccgccaagcccccggcaaaggcctcgaatgggtgaccctcatctcctacgacggcgcaaaccaatactacgcagactccgtcaaaggacgattcaccatcagccgagacaactccaaaaacaccgtctaccttcaaatgaactccctccgccccgaagacactgcagtatactactgcgccgttcccggccccgtcttcggaatcttcccaccctggtcatatttcgacaactggggccagggtatcctggtcaccgtctcctccgcctccaccaaaggtccctccgtcttccccctcgccccctcctcaaaatccacctccggaggcacagcagccctcggatgcctagttaaagactactttcccgaacctgtcaccgtatcatggaactcaggagccctcacctcaggagtccacaccttccccgccgtactccaatcctctggcctctactccctctcctccgtcgtaaccgtaccctcatcctcccttggaactcaaacttacatctgcaacgtcaaccacaaaccctccaatacaaaagttgacaagaaagtcgagcccaaatcctgcgacaaaacccacacttgcccaccctgcccagcccccgaacttctcgggggcccatccgtcttcctcttcccgcccaaacccaaagacaccctcatgatttcccgcacacccgaagtcacttgcgtcgtcgtcgacgtctctcacgaagaccccgaagtcaaattcaactggtacgtcgacggcgtcgaagtacacaacgcaaaaaccaaaccacgggaggaacaatacaactctacctatcgagtcgtcagcgtattaaccgtcctgcaccaagactggctaaacggcaaagaatacaaatgcaaagtctcaaataaagccctccccgcccccatcgagaaaactatctctaaagcaaaaggccaacccagagaaccacaagtatacaccctcccaccctctcgagaagaaatgaccaagaaccaagtctccctaacctgcctagtcaaaggattctatccatcggacatcgccgtagaatgggaatccaacggccaacccgaaaacaactacaaaaccacacctcccgtactcgactcagacggctccttcttcctatactcaaaactcacagtggacaaatcaagatggcaacaaggcaacgtcttctcttgttcagtcatgcacgaagcactccacaaccactacacccaaaaatccctctccctctcacccggtaaa

SEQ ID NO: 58797 - RNA, 1365 nt, synthetic construct
  misc_feature 1..1365: note = derived and/or modified sequence opt11 from anti-influenza_Chain
  source 1..1365: mol_type = other RNA
gaagtccaactcgtagaatcaggcggcggcgtcgtccaacccggcaaatcactccgactatcctgcgccgcctcgggcctaaccttctcctcttacgccgtacactgggtccgccaagcccccggcaaaggcctggaatgggtaaccctaatatcatacgacggcgccaaccaatattacgcagactccgtcaagggccgcttcaccatctcccgcgacaacagcaaaaataccgtatacctccaaatgaactcacttcgaccagaagacaccgcagtctactactgcgccgtacctggccccgtcttcggcatctttcccccttggtcctacttcgacaactggggccagggcatcctcgtcaccgtctcctctgcctccacaaaaggccccagcgtcttccccctagccccttcctcaaaatcaacctccggcggcacagccgcacttggctgcctcgttaaggactacttccctgaacccgtcaccgtctcttggaactccggcgccctcacctccggcgtacacaccttcccagctgtactccagagctccggcctttactccctatcatcagtagtcaccgttccctcgtcttctctcggaacacaaacatacatctgcaacgtaaaccacaaaccctccaacaccaaagtcgacaagaaagtcgaaccaaaatcctgcgacaaaacccacacgtgcccaccctgccccgcccccgaactcctcggcggcccctcagtattccttttcccacccaaacccaaagataccctaatgatcagccgcacccccgaagtcacctgtgtagtagtagacgtctcccacgaagaccccgaagtcaaattcaactggtacgtagacggagttgaagtccacaacgcgaaaacaaaaccccgagaagaacagtacaactccacctaccgagtagtctccgtccttacggtcctacaccaagactggctcaacggaaaagaatacaaatgcaaagtctcaaacaaagcactccccgcccccatcgagaaaaccatctcaaaagctaaaggccaaccccgcgaaccccaagtctacacactacccccatcacgcgaagagatgaccaaaaaccaagtctccctcacatgcctagtcaaaggattctacccctccgacatcgccgtggaatgggaatcaaacggacaacctgaaaacaactacaaaacaaccccacccgttctcgactcagacggctcattcttcctttactccaaactcaccgtcgacaaatcccgatggcaacaaggcaacgtattctcatgctccgtcatgcacgaagccctacacaaccactacacacaaaagtccctttccctatcccccggtaag

SEQ ID NO: 58798 - RNA, 1365 nt, synthetic construct
  misc_feature 1..1365: note = derived and/or modified sequence opt11 from anti-influenza_Chain
  source 1..1365: mol_type = other RNA
caggtccaactcgtccaatccggcgccgaacttaaacgtcccggagcaagcgtcaaagtctcctgcaaaacttctggctacagcttcaacaactacggaataaattgggtccgccaagcccccggccagggactagaatggatgggttggatctccgcctacaccggaaacactcactacgccaaaaacttcgaaggccgcgtcacactcacaaccgacacctccacatcaaccgcctacatggaagtgcgctctctccgttccgacgactccgccgtctacttctgcgcacgcgcaatgatccaaggagtcgtaaccctctacctacggcccggagactactggggtcaaggcactctcgtcaccgtaagcagcgcctccactaaaggcccctcagtattcccactcgccccctcctccaaatccacctcaggaggcacagccgccctcggatgcctcgtaaaagactacttccccgaacccgtcacagtttcctggaactcaggcgcactcacatccggcgtccacaccttccccgccgtcctccaatcatccggcctatattcactatcatccgtagtaaccgtaccctcatcctccctaggcacccaaacttatatatgcaacgtcaaccacaaaccctcaaacaccaaagtcgacaagaaagtcgaacccaaaagctgcgacaaaacccacacatgccctccctgccccgcccccgaactcctcggtggaccctctgtcttcctcttcccgcccaaacccaaagacaccctcatgatcagcagaacccccgaagtcacatgcgtcgtcgtcgacgtctcacacgaagaccctgaagtcaaattcaactggtacgtcgacggcgtcgaagtacacaacgccaagacaaagcctcgcgaagaacaatacaactcaacataccgcgtcgtcagcgtcctcaccgtcctccaccaagactggctgaacggcaaagaatacaaatgcaaagtaagcaacaaagcactcccagctcccatcgagaaaaccatatcaaaagcaaaaggacagccccgagaaccccaagtatacaccctacccccatcccgcgaagaaatgaccaaaaaccaagtgtcactcacatgcctcgttaaaggcttctacccctcagacatcgccgtcgaatgggaatccaacggacaaccagaaaacaactacaaaaccaccccacccgtcttagactcagacggctccttcttcctatactccaaacttacagtagacaaatcccgatggcaacaaggcaacgtcttctcctgctccgtaatgcatgaagcgctccacaaccactatacacagaaatccctatccctctcccccggcaaa

SEQ ID NO: 58799 - RNA, 1365 nt, synthetic construct
  misc_feature 1..1365: note = derived and/or modified sequence opt11 from anti-influenza_Chain
  source 1..1365: mol_type = other RNA
caagttcaactcgtcgaatccggcggcggagtagtacaacccgggcgatccctcagactatcctgcgccgcatccggcttcgcattccacaacagagccatgcactgggtacgtcaagcaccaggaaaaggcctcgaatgggtcgccctaatttacttcgacggctcaaagcaatactacgccgactcagtcaaaggccgcttcaccatatcccgcgacaacagcaaaaacacagtattcctccaaatgaactcacttcgacccgaagacaccgccgtctactactgcgcagtccccggccccatcttcggcatcttcccaccctggtcctacttcgaccactggggacaaggcatcctcgtcaccgtctcaagcgcatccacaaaaggcccctccgtatttccactcgccccatcaagtaaatccacctccggcggaacagccgccctcggctgcctcgtcaaagactacttccccgaacccgtcacagtctcctggaactctggcgcactcaccagcggtgtccacaccttcccagcagtcctccaatcctccgggctatacagcctttctagcgtagtcacagtaccaagctcatccctgggaacccaaacttacatctgcaacgtcaaccacaaaccatccaacaccaaagtagataagaaagtcgaacccaaatcatgcgacaaaacccacacttgcccaccatgccccgcccccgaactgctcggcggaccctccgtcttcctcttcccacccaaacccaaagacaccctcatgatcagccgaacccccgaagtcacttgcgtcgtcgtagacgtctcccacgaagaccccgaagtaaaatttaactggtacgtcgacggcgtcgaagtccacaacgccaaaaccaaacccagagaggaacaatacaactccacctatcgcgtagtctccgtactaaccgtccttcaccaagattggctcaacggcaaagagtacaagtgcaaagtctctaacaaagccctcccagcccccatcgagaaaaccatatcaaaggccaaaggccaaccacgagaaccacaagtctacaccctaccacccagccgcgaagaaatgaccaaaaaccaagtctccctaacatgcctagtaaaaggcttctacccctccgacatagccgtcgaatgggaatccaacggacaacccgaaaacaactacaaaaccacacctcccgtactagactccgacggatcctttttcctatactccaagctcaccgtcgacaaaagccgctggcagcaaggaaacgtattctcatgctccgtcatgcacgaagccctccacaatcactacacccagaaaagcctttcactctccccaggcaaa

SEQ ID NO: 58800 - RNA, 1365 nt, synthetic construct
  misc_feature 1..1365: note = derived and/or modified sequence opt11 from anti-influenza_Chain
  source 1..1365: mol_type = other RNA
gaagtccagctagtcgagtcaggaggtggcgtcgtccaacccggccgatccctccgcctctcctgcgccgcatctggattcgcattccacaaccgagcaatgcactgggtacgccaggcccccggcaaaggcctcgaatgggttgcactcatttacttcgacggcagcaagcaatactacgccgactcagtaaaaggccgattcacaatctcacgtgacaactccaaaaacaccgtcttcctacaaatgaactccctccgccccgaagacaccgcagtctactactgcgccgtccccgggccaatattcggcatcttcccaccctggtcctacttcgaccactggggtcaaggcatccttgtcacagtctcttccgcctcaaccaaaggaccctcagtcttccccctcgccccctcctccaagagcacgtccggcggaacagccgcactcggctgcctcgtcaaagactacttccccgaacccgtcactgtatcatggaactccggagccctaacctccggcgtccacaccttccccgccgtcctccaatcctccggcctttactcactttcttctgtagtcactgtgccctcctcctcactaggcacccaaacatatatctgcaacgtcaaccacaagccctcaaataccaaagtagacaagaaagtcgaaccgaaatcctgcgacaaaacccacacatgcccgccgtgcccagccccagaactactcggtggcccctccgtcttcctattcccacccaaacccaaagacaccctcatgatctcccgaacccccgaggtaacatgcgtagtcgtagacgtcagccacgaagaccccgaagtaaaattcaactggtacgtcgacggagtcgaagtacacaacgctaaaacgaaaccccgtgaagaacaatacaactccacctaccgagtcgtctcagtactaaccgtcctccaccaagattggctcaacggcaaagaatacaaatgcaaagtctccaacaaagcactcccagcacccatcgagaaaaccatttcaaaagccaaaggacaacccagagaaccacaagtctacacactacccccatccagagaagaaatgaccaaaaaccaagtctctctaacctgcctcgtcaaaggattctacccctccgacatagctgtcgaatgggaatccaacggccaacccgaaaacaactacaaaaccaccccacccgtcctagattcagacggctccttcttcctctactcgaaacttacagtcgacaaatcccgctggcaacaaggaaacgtcttctcctgcagcgtcatgcacgaagccctccacaaccactatacacaaaaatccctctcactatcccccggtaaa

SEQ ID NO: 58801 - RNA, 1365 nt, synthetic construct
  misc_feature 1..1365: note = derived and/or modified sequence opt11 from anti-influenza_Chain
  source 1..1365: mol_type = other RNA
gaagtccagctagtccaatccggcggaggcgttgtacaacccggcaaatccctgcgtctttcctgcgcagcatccggactcacattctcctcatacgcagttcattgggtccgacaggcacccggcaaaggcctcgaatgggtcaccctaatctcatacgacggcgcaaaccaatactacgccgactccgtaaaaggacgcttcaccatatcccgcgacaactctaaaaacaccgtctacctccaaatgaactcactacgtcccgaagacaccgccgtttactactgcgctgtacccggacccgtattcggcatattcccaccctggtcttacttcgacaattggggccagggcattctcgtcaccgtctcctccgcctccaccaagggcccctcagtattccccctcgcacccagctcaaaatccacctcaggcggcaccgccgccttaggctgcctcgtcaaagactacttccccgaacccgtaaccgtatcctggaactccggagccctaacatctggcgtgcacaccttcccagccgtcctacaatcctcaggcctctactccctatcctcagtcgtcacagtcccctcctcctccctcggtacccaaacttacatctgcaacgtcaaccacaaaccctcaaacaccaaggtcgacaagaaagtcgaaccaaaatcttgcgacaaaacccacacatgtcccccatgccccgcccccgaactactcggcggcccatccgtcttcctattcccacccaaacccaaagacacccttatgatctcccgcacccccgaagtcacatgcgttgtcgtcgacgtttctcacgaagaccccgaagtcaaattcaactggtacgtcgacggcgtcgaagtccacaacgccaaaaccaaaccccgcgaggaacaatacaactccacataccgagtcgtatcagtccttaccgttctccaccaagactggctaaacggaaaagaatacaaatgcaaagtctccaacaaagcactccccgcccccatcgaaaagaccatttcaaaagccaaaggacaaccacgagaaccacaagtctacactctacccccatccagagaagaaatgaccaaaaaccaagtctcactaacatgcctcgttaaaggcttctaccccagcgacatcgccgtcgaatgggaatccaacggccaacccgaaaacaactacaaaaccactcctcccgtcctcgactctgacggctccttcttcctctactcaaaactcaccgtcgacaaaagccgatggcaacaaggcaacgtattctcctgctccgtcatgcacgaagccctacacaaccactacacccagaaatccctctccctcagccccggcaaa

SEQ ID NO: 58802 - RNA, 1365 nt, synthetic construct
  misc_feature 1..1365: note = derived and/or modified sequence opt11 from anti-influenza_Chain
  source 1..1365: mol_type = other RNA
caggtacaacttgtcgaatccggaggaggcgtcgtacaacccggaaaatccctccgcctcagctgcgcagcctcaggcctcaccttctcaagctacgccgtccactgggtccgccaagcgcccggaaaaggcctcgaatgggtcaccctaatttcatatgacggcgccaaccaatattacgccgactccgttaaaggacgcttcacaatcagccgcgacaactccaaaaacaccgtctaccttcaaatgaacagcttacgacccgaagacaccgccgtatactactgcgccgtcccaggccccgtattcggaatctttccaccctggtcctacttcgacaactggggacaaggcatcctagtcaccgtctcatccgcaagcacgaaaggcccctccgttttccccctagccccatcttccaaatccacctccggtggcaccgcagccctaggctgcctcgtaaaagactatttcccagaacccgtcacggtctcgtggaactcgggcgccctcacatccggagtccacacattccccgccgtactccaatcctccggactctactcactatcatccgtcgtcactgtcccctcatcctccctaggcacccaaacctacatctgcaacgtcaaccacaaaccatccaacaccaaagtcgacaagaaagtcgaacccaaatcctgcgacaaaacccacacctgtccaccctgccccgcccccgagctcctcggcggcccctccgtcttcctcttcccacccaaacccaaagacaccctcatgatatctcgcacccccgaagtaacctgcgtcgtcgtcgacgtctcacacgaagaccccgaggttaaattcaactggtacgtagacggcgtcgaggtccacaacgcaaaaaccaaaccccgcgaagaacaatataactccacctaccgtgtagtctcagtactaaccgttctccaccaagactggctcaacggcaaagaatacaaatgcaaagtatccaacaaagccctccccgcaccaatcgagaaaaccatctcaaaagccaaaggccaaccccgcgaaccccaagtctacacactacccccttcccgagaagaaatgaccaaaaaccaagtctccttaacctgcctcgtcaaaggcttctacccctccgacatcgcagtagaatgggaatccaacggacaacccgaaaacaactataaaactaccccacccgtcctcgacagcgacggctccttctttctctactctaaactaacagtcgacaagtcacgctggcaacaaggaaacgtattctcatgcagcgtcatgcatgaagccttacacaatcactatacccaaaaatccctatccctctcacccggcaaa

SEQ ID NO: 58803 - RNA, 1365 nt, synthetic construct
  misc_feature 1..1365: note = derived and/or modified sequence opt11 from anti-influenza_Chain
  source 1..1365: mol_type = other RNA
caagtccaacttgttgaatcaggcggcggagtcgtccagcccggcaaaagcccccgcctctcctgcgccgcctccggccccaccttctcctcctacgccgtgcactgggtcaggcaagcccccggaaaaggcctcgaatgggtcaccctaatatcctacgacggagctaaccaatactacgccgactcagtaaaaggccgattcaccatctcccgcgacaattccaaaaacaccgtctacctccaaatgaactccctcagacccgaagacaccgcagtatactactgcgccgtacccgggcccgtcttcggcatcttcccaccctggagctacttcgacaattggggacaaggcatactcgtcactgtctcctcagcctccactaaaggacccagcgtattccccctcgccccctctagcaagtcaaccagcggaggaaccgccgccctcggctgcctcgtcaaagactacttccccgaacccgtcaccgtctcctggaacagcggcgccctcacatccggagtacacaccttccccgccgtcctccaatccagtggcctatactccctaagctccgtcgtaacagtaccctcgtcctccctcggcacccagacctacatatgtaacgtcaaccacaaaccaagcaacacaaaagtggacaagaaagtagaacccaaatcctgcgacaaaacacatacctgccctccctgccccgccccagaactcctaggcggccccagcgtcttcctctttccacccaaacccaaagacacactcatgatctcccgcacccccgaagttacctgcgtagtcgtagacgtctctcacgaagacccagaagtcaaattcaactggtacgtcgacggcgtagaagtccacaacgccaaaaccaaaccacgagaagaacaatacaactcaacctaccgagtagtctctgtgcttaccgtactccaccaagactggcttaacggaaaggaatacaaatgtaaagtatccaacaaggctctccccgcccccatcgaaaagaccatctcaaaagccaaaggccaaccacgcgaaccccaagtctacacactcccaccctcacgcgaagaaatgaccaaaaaccaagtctctcttacctgcctagtcaaaggcttctacccgtccgacatagccgtagaatgggaatcaaacggacaaccggaaaacaactacaaaaccacaccccctgttctcgacagcgacggttccttcttcctatactccaaactcaccgttgacaaatcacgatggcaacaaggaaacgtcttctcctgctcagtcatgcacgaagcccttcacaaccactacacccaaaaatccctctcactctcccccggcaag

SEQ ID NO: 58804 - RNA, 1365 nt, synthetic construct
  misc_feature 1..1365: note = derived and/or modified sequence opt11 from anti-influenza_Chain
  source 1..1365: mol_type = other RNA
gaagtccaactcgtggaatccggcggcggcgtcgtacaacccggtaaatccctccgcctttcatgcgcagcctcaggcctcaccttctcctcctacgccgtccactgggtccgacaagcacccggaaaaggactcgaatgggtcacccttatctcatacgacggcgcaaaccaatactacgccgactctgtaaaaggtagattcaccatatcccgggacaactccaaaaacacagtctacctacaaatgaactccctacgccccgaagacaccgccgtctactactgcgccgtcccaggccccgtattcggcatattccctccctggtcatacttcgacaactggggccagggcatcctagtaaccgtctcatccgcctccacaaagggaccctcagtcttccccctcgccccatcatccaaatccacctctggaggcacagccgccctcggctgccttgtcaaggactacttccccgaacccgtaaccgtcagctggaactcaggcgcattaacgagcggcgtccacaccttcccagccgtcctacaaagctccgggctctactccctctcctcagtagtaaccgtcccctcctcctccctaggaacccaaacctacatctgcaacgtcaaccacaaaccctcaaatacaaaagtcgacaagaaagttgaacccaaaagctgtgacaaaacacacacctgtcccccatgcccagcccccgagctactaggcggcccctcagtcttcctcttcccacccaaacccaaagacaccctcatgatatctcgcaccccggaagtcacatgcgtcgtagtcgacgtcagccacgaagaccctgaagtcaaattcaactggtacgtcgacggcgtcgaagtacacaacgctaaaaccaagccccgcgaagaacagtacaacagcacctaccgcgtcgtatccgtcctcaccgtcctacaccaagactggcttaacggcaaagaatacaagtgcaaagtctcaaacaaagccctacccgcccccatcgagaaaaccatcagtaaagcaaaaggccaaccccgcgaaccccaagtatacacactccctccctcccgagaagaaatgaccaaaaaccaagtctcacttacctgcctcgtcaaaggcttctacccctccgacatcgccgtagaatgggaatccaacggacaacccgaaaacaactacaaaactacacccccagttctagactcagacggctcgttcttcctatactcaaaactaaccgtagacaaatcacgctggcaacaaggcaacgtcttctcctgctcagtcatgcacgaagcactccacaaccactacacccaaaagtccctctccctctcccccggaaaa

SEQ ID NO: 58805 - RNA, 1365 nt, synthetic construct
  misc_feature 1..1365: note = derived and/or modified sequence opt11 from anti-influenza_Chain
  source 1..1365: mol_type = other RNA
caagtccaactcgtccaatccggcgccgaactaaaaagaccaggcgcctccgtcaaagtatcttgcaaaacctccggctactccttcaacaactacggcatcaactgggttagacaagcacccggacaaggcctcgaatggatgggctggataagcgcctacactggcaacacacactacgccaaaaacttcgaaggccgcgtcaccctcaccaccgacacctcaacatccaccgcctacatggaagtccgatcgctccgatccgacgactcagccgtctacttctgcgcacgagccatgatccaaggggtcgtcacactctaccttcgccccggcgactactggggacaaggcaccctagtaaccgtctcctccgcctccaccaaaggaccctccgtcttcccactcgccccctcatcaaaatccacctcaggaggcaccgccgccctcggctgcctcgtaaaagactacttccccgaacccgtcacagtatcctggaactcaggggccctcacctccggcgtacacaccttccccgcagtcctccaatcctctggactctactccctatcatccgtcgtaactgtaccctcatccagcctcggcacacaaacctatatctgcaacgttaaccacaaaccctccaacacaaaagtcgacaagaaagtcgaacccaaatcttgcgacaaaacacatacctgccctccctgccccgcccccgaactcctagggggcccctcggtcttcctcttcccacccaaacccaaagacaccctcatgatatcccgcacccccgaagtcacatgcgtagtcgtcgacgtctcccacgaggaccccgaagtaaaattcaactggtacgttgacggcgtcgaagtccacaacgcaaagaccaaaccacgcgaagaacaatacaactccacctacagagtcgttagcgtcctcaccgttctccaccaagactggcttaacggcaaggaatacaaatgcaaggtttccaacaaagcccttccagccccaatcgagaaaaccatctccaaggccaaaggccaaccacgcgaaccccaggtatacaccctaccacccagccgcgaagaaatgacaaagaatcaagtatcactgacctgcctcgtcaaaggattctacccctctgacatcgccgtcgaatgggaatccaacggccaacccgaaaacaactacaaaaccaccccgccagtcctagattccgacggatccttcttcctatactccaaactcaccgtcgacaaatcccgatggcaacaaggaaatgtcttcagctgctcagtaatgcacgaagccctccacaaccactacacccagaaaagcctatccctctctcccggcaaa

SEQ ID NO: 58806 - RNA, 1368 nt, synthetic construct
  misc_feature 1..1368: note = derived and/or modified sequence opt11 from anti-influenza_Chain
  source 1..1368: mol_type = other RNA
gaagtccaactcgtccaatccggcggaggcgtcgtacaaccccgccgctccctaagactctcatgcgccgcctcaggctttaccttctcctcctacgccatgcactgggtacgccaagccccaggcaaaggcctagaatgggtcgccgtaatatcatatgacggacgcaacaagtactacgcggactccgtcaaaggacgcttcacagtctcccgcgacaacagtaaaaacaccctatacctgcaaatgaactccctacgggccgaagacacatccgtctactactgcgcccgcgaactactcatggactactacgaccacatcggttactcccccggacctacctggggtcaaggaacactcgtaacagtttcaagcgccagcaccaaaggcccatccgtcttcccattagcccccagttccaaatcaacctccggcggcaccgcagccctaggctgccttgtaaaagactacttccccgaacccgtcaccgtttcatggaactccggcgccctaaccagcggtgtccacaccttccccgcagtgctccaatcttccggcctttacagcctatcctccgtcgtcaccgtaccttcttcttccctcggcacccaaacctacatctgcaacgttaaccacaaaccatcaaacaccaaagtagacaaacgcgtcgaacccaaatcctgtgacaaaacccatacctgccctccctgccccgccccagaactccttggaggccccagcgtcttcctattcccacccaaacccaaagacacactcatgataagccgcacacccgaagtcacttgcgtcgtcgtcgacgtctcacacgaagaccccgaggtcaaattcaattggtacgtcgacggagtcgaagtgcacaacgccaaaaccaaaccccgcgaggaacagtacaactcgacatacagagtagtatccgtcctaacagtcctccaccaagactggctcaatggcaaagaatacaagtgcaaggtctccaacaaagccctcccagccccaattgagaaaaccatatccaaggccaaaggccaaccccgcgaaccacaagtctacaccctcccaccctcccgcgaagaaatgaccaagaaccaagtctctcttacctgcctcgtcaaaggcttctacccctctgacatagcagtcgaatgggaaagcaacggccaaccagaaaacaactacaaaacaacacccccagtcctcgactccgacggctcattcttcctctactcgaagctaaccgttgacaaatcccgatggcaacaaggcaacgtattctcctgctcagtcatgcacgaagccctacacaaccactacacccaaaagtccctttcactctcaccagggaaa

SEQ ID NO: 58807 - RNA, 1371 nt, synthetic construct
  misc_feature 1..1371: note = derived and/or modified sequence opt11 from anti-influenza_Chain
  source 1..1371: mol_type = other RNA
atggtcatccaacgcaactccatcctacttctaatcataatctttgcatcctccatttccacatgccgaagcaacgtcatcgacgacaaccttttcaaacaagtctacgacaatatcctagagcaagagttcgcacacgacttccaagcgtacctctcctacctatccaaaaacatagaatccaacaacaacattgacaaagtcgacaaaaacggcatcaaagtcataaacgtcctttcattcggcgccaaaggagacggcaaaacctacgacaacatcgccttcgaacaagcctggaacgaagcatgttcatcccggaccccagtacaattcgtcgttcccaaaaacaaaaactacctacttaaacaaatcaccttctccggaccgtgccgctcctccatatcagtcaaaatattcggcagcctcgaagcctcatccaagatatccgactacaaagaccgacgcctctggatcgccttcgactccgtccaaaacctagtagtaggcggcggcggaaccataaacggaaacggccaagtctggtggccctcctcatgcaaaatcaacaagtcactcccctgcagagacgccccgaccgcacttacgttctggaactgcaagaacctgaaagtcaacaacctcaaatccaagaacgcacaacaaatacacatcaaattcgaatcctgcaccaacgtagtcgcatccaatctaatgatcaacgcatccgccaaatcccccaacaccgacggcgtccacgtctccaacacacaatatatccaaatcagcgacaccatcatcggcacaggcgacgactgcatctcaatcgtctcaggatcccaaaacgtacaagcgaccaacataacctgcgggccaggtcacggaatctccatcggctctctcggctcaggcaactccgaagcctacgtctccaacgtcaccgtcaacgaagcaaaaatcattggagccgaaaacggagtccgcataaaaacctggcaaggaggctccggccaagcctccaacatcaaattcctcaacgtagaaatgcaagacgtcaaataccccatcatcatcgaccaaaactactgcgaccgcgtcgaaccctgcatacaacaattcagcgccgtccaagtcaaaaacgtcgtctacgaaaacataaaaggaacaagcgccaccaaagtcgcaataaaattcgactgctcaaccaacttcccctgcgaaggaataatcatggaaaacatcaacctcgtcggcgaatcaggcaaaccctctgaagcaacctgcaaaaacgtccacttcaacaacgccgagcacgtcacaccccactgcacctcgctcgaaatctcagaagatgaagcactcctatacaactac

SEQ ID NO: 58808 - RNA, 1371 nt, synthetic construct
  misc_feature 1..1371: note = derived and/or modified sequence opt11 from anti-influenza_Chain
  source 1..1371: mol_type = other RNA
atggtcatccaacgcaacagcatcctactcctcatcatcatattcgcctcctctatctccacatgccgatccaacgtcatagacgacaacctcttcaaacaagtctacgacaacatcctcgaacaagagttcgcccacgacttccaggcctacctttcctacctatccaaaaacatagaaagcaacaacaacatcgacaaagtcgacaaaaatggaataaaagtcatcaacgtcctctccttcggcgccaaaggcgacggcaaaacctacgacaacatcgccttcgaacaagcctggaacgaagcctgctccagcagaaccccggtccaattcgtcgtccccaaaaacaaaaactacctactgaaacaaataaccttctcaggcccatgccgctcctccatcagcgtcaaaatcttcggctccctcgaagccagctcaaaaatctccgactacaaagacagacgactatggatcgccttcgactcagtccaaaacctagtcgtgggcggcggaggcaccataaacggtaacggtcaagtgtggtggccatcctcgtgcaaaatcaacaagagcctaccctgccgcgacgccccaaccgcactcaccttctggaactgcaaaaacctcaaagtcaacaacctcaaatccaaaaacgcccaacaaatccacatcaaattcgaatcatgcacaaacgtagtcgcctccaacctcatgattaacgcttccgcgaaatcccccaacacagacggcgtccacgtctcaaacacccaatacatccaaatctccgacaccatcatcggcaccggcgacgactgcatatcgatcgtttccggcagccaaaacgtccaagcaaccaacataacctgcggcccaggacacggtatctcaatcggaagcctcggctccggcaatagcgaagcctacgtctcaaacgtcaccgtcaacgaagccaaaatcattggagcggaaaacggcgtccgcatcaaaacctggcaaggcggcagcggccaagccagcaacatcaaattcctaaacgtcgagatgcaagacgtaaaatacccgatcataatcgaccaaaactactgcgaccgcgtcgagccctgcatccaacaattctccgcagtacaagtcaaaaacgtagtctacgaaaacataaaaggcacgtcggcaaccaaagtcgccatcaaattcgactgctccaccaacttcccctgcgaaggcataatcatggaaaacatcaacctcgtcggcgaatcaggcaaaccaagcgaagcaacctgcaaaaacgtccacttcaacaacgccgaacacgtcacaccccactgcacctcactcgaaatcagcgaagacgaagccctcctgtacaactac

SEQ ID NO: 58809 - RNA, 1380 nt, synthetic construct
  misc_feature 1..1380: note = derived and/or modified sequence opt11 from anti-influenza_Chain
  source 1..1380: mol_type = other RNA
atgaaactctggctcaactggatcttcctcgtcacactgctgaacgacatccaatgcgaagtcaaactcgtcgaatccggcggcggcctagtccaaccaggcggctccctacgcctctcctgcgcaaccagtggcttcaccttctccgattactacatgtcctgggtacgccagtcccccggcaaagccctagaatggcttggattcaccagatcacgcgtcctcggctacaccaccgactactccgcctccgtcaaaggccgcttcaccatctcccgcgacaactcccaatcaatcctctaccttcaaatgaactcactccgaggcgaggactccgccacctactactgcgcacgagaccgccccatggactactggggccaaggtacctccgttaccgtttcctccgcaaaaaccaccccaccctccgtctaccccctcgcccccggctccgccgcccaaaccaacagcatggtaaccttaggctgcctcgtcaaaggctacttccccgaacccgttacagtcacatggaactcaggatcactctcctccggcgtacacaccttccccgcagttctccaatccgacctgtacacactctcctcctccgtcaccgtcccctcatcaacctggccctcagaaaccgtaacctgcaacgtcgcccaccccgcatcctcaacaaaagtcgacaaaaagatcgtcccaagagactgcggctgcaaaccatgcatctgcaccgtccccgaggtctcctccgtcttcatcttcccaccgaaaccaaaagatgtcctcaccatcaccctcacacccaaagtaacctgcgtcgtcgtcgacatatccaaagacgacccagaagtccaattcagctggttcgtcgacgacgtcgaagtccacacagcccaaacccaaccccgcgaagaacaattcaactcaaccttccgctccgtatctgaactccccattatgcaccaagactggttaaatggcaaagagttcaaatgccgagtcaacagcgccgccttccccgccccaatcgaaaagacaatatccaagacaaaaggccgccccaaagccccacaagtatacaccataccaccaccaaaagaacaaatggccaaggacaaagtctccctaacctgcatgataaccgacttcttccccgaagacatcaccgtcgagtggcaatggaacggccaaccagccgaaaactacaaaaacacccaacccataatggacaccgacggctcctacttcgtatactccaaactcaacgtccaaaagtcaaactgggaagcaggcaacacctttacctgttcagtcctacacgaaggcctccacaaccaccacaccgaaaaatccctatcacactccccaggcaaa

SEQ ID NO: 58810 - RNA, 1380 nt, synthetic construct
  misc_feature 1..1380: note = derived and/or modified sequence opt11 from anti-influenza_Chain
  source 1..1380: mol_type = other RNA
atgaaactctggcttaactggatcttcctagtcaccctactcaacgacatccaatgcgaagtcaaactcgtcgaaagcggcggcggccttgtccagcccggaggatcgctccgcctatcctgcgcaacctccggcttcaccttctccgactactacatgtcctgggtccggcaatcacccggcaaagcactcgaatggctaggattcacccgatcccgagtcctaggctacactaccgactactccgcctcagttaaaggccgtttcaccatctcccgcgacaactcgcaatcaatcctatacctacaaatgaactccctaagaggcgaagactcagcaacgtactactgcgcccgcgaccgccctatggactattggggccaaggcaccagcgtcaccgtttcctcagccaaaacaaccccaccctccgtctaccccctagcccccggctccgcagcccaaaccaactccatggtcacccttggatgcctcgtaaaaggctatttccccgaacccgtcaccgtcacctggaactcaggttccctgtcttctggcgtccacacattccccgccgtcctccaatcagatctctacacattgtctagctccgtaacagtcccctcatccacctggccttccgaaaccgttacctgcaacgtcgcccacccagcatcctcaactaaagtcgacaagaaaatcgtcccacgtgactgcggctgcaaaccctgcatctgcaccgtccccgaagtctcctcggtcttcatcttcccacccaaacccaaagacgtcctcaccatcaccctcacccccaaagtcacatgcgtggttgtcgacatctccaaagacgaccccgaagtccaattctcctggttcgtagacgacgtagaagtccacaccgcccaaacacaaccccgcgaagaacaattcaactccaccttccgctccgtctccgaactccccatcatgcaccaagactggctcaacggaaaagaatttaaatgccgcgtaaattccgccgcgttcccagccccaatagaaaagaccatatccaaaactaaaggccgcccaaaagcaccccaagtatacaccatcccaccacccaaagaacaaatggccaaagacaaagtctccctaacctgcatgataaccgacttcttccccgaagacatcaccgtagaatggcaatggaacggtcaacccgcagaaaactacaaaaacacccaacccataatggacacagacggttcctacttcgtctatagcaaactcaacgtccaaaaatccaattgggaagccggaaacacattcacatgctcagtcctccacgaaggactacacaaccaccacaccgaaaaatcactctcccactcacccggcaaa

SEQ ID NO: 58811 - RNA, 1386 nt, synthetic construct
  misc_feature 1..1386: note = derived and/or modified sequence opt11 from anti-influenza_Chain
  source 1..1386: mol_type = other RNA
atggaatggtcatggatcttcctcttcctcctaagcggaaccgccggcgtccactcggaagtccaactccaacaatccggccccgaactcgtaaaacccggcgcctccgtcaaaatgtcctgcaaagcctcaggctatacattcacctcatacgtcatgcactgggtcaaacaaaaacccggacaaggcctagaatggatcggctacatcaacccctacaatgacggcacccggtacaacgaaaaattccgtgtcaaagccaccctaacctccgacaaatcgtcatccacagcatacatggaactatcatcactcacctccgaagactccgccgtctactactgcgcgcggcgtggcctcatcacaacccccaccctcgactactggggccaaggaacgaccctcacagtatcatccgcgaaaaccacccctccctcagtctaccccctcgcccccggatcagccgcacaaaccaactccatggtcacactcggctgcctagtcaaaggctacttccccgaaccagttaccgtaacatggaactctggctccctctcatcaggagtccacacattccctgcagttctccaatcagacctctacaccctctccagctccgtcaccgtcccctccagcacctggccatccgaaaccgtaacctgcaacgtcgcacaccccgcatcctcaacaaaagtcgacaagaaaatcgtcccacgcgactgcggctgcaaaccatgcatctgcacagtccccgaagtctcctccgtcttcatctttcccccaaaacccaaagacgtcctaacaataaccctcacccccaaagtaacctgcgtagtcgtcgacatttccaaagacgaccccgaagtccaattcagctgggtcgacgacgtcgaagtccacaccgcccaaacccaaccccgcgaagaacaattcaacagcaccttccgtagcgtctccgaactcccaataatgcatcaagactggctcaacggcaaagagttcaagtgccgcgtcaacagcgccgcgttccccgcccccatcgaaaagaccatctccaaaaccaaaggacgcccaaaagcaccccaagtatacaccattccaccacccaaagaacaaatggccaaagacaaagtctccctaacctgcatgatcaccgacttcttccccgaagacatcaccgtcgaatggcagtggaacggccaacctgccgaaaactacaaaaacacccaaccaataatggacaccgacggatcctacttcgtttacagcaaactcaacgtacaaaaatccaactgggaagccggcaacacctttacctgcagcgttctgcacgaaggcctccacaaccaccacaccgaaaaatccctctcccactccccaggcaaa

SEQ ID NO: 58812 - RNA, 1386 nt, synthetic construct
  misc_feature 1..1386: note = derived and/or modified sequence opt11 from anti-influenza_Chain
  source 1..1386: mol_type = other RNA
caagtccaactcgtccagagcggcgccgaagtaaagaaacccggcgcctccgtcaaagtatcctgcaaaacctccggatacaccttcaccgcctacaccatccactgggtccgccaagccccaggccaacgcctcgaatggatgggttggatcaacgccggaaacggccacacaaaatacagccaacgcttcaaaggccgcgtcacgataacacgagacacctctgcaaggaccacctacatggaactacgctccctcacttcagaagacaccgctttatacttctgcgcacgaggccctgaaacatactattacgacaaaaccaactggctaaactcccacccagacgaatacttccaacactggggccacggcacccaagtaaccgtctcttccgcttccaccaaaggaccctccgtcttccccctcgcccccagctccaaatctacctcaggaggcaccgccgccctaggctgcctcgtaaaagactacttccccgagccggtaacagtcagctggaactccggagccctcacctctggtgtacacaccttcccagccgtcctccaatcctccggcctctactcactctcttcagtagtaaccgtcccttcctccagcctaggcactcaaacctacatctgcaacgtgaaccacaaaccctctaacaccaaagtcgacaagaaagtcgaacccaaatcatgcgacaaaacccacacatgccctccctgcccggcccccgaactgctcggaggccccagcgtattcctcttcccacccaaaccaaaagacaccctcatgatctcacgcaccccagaagtgacctgcgtcgtcgtcgacgtctcccacgaagaccccgaagtcaaattcaactggtacgtcgacggcgtagaagtgcacaatgccaaaaccaaaccccgcgaagaacaatacaactccacctaccgagtcgtctccgtcctcactgtcctccaccaggactggctaaacggcaaagaatacaaatgcaaagtctccaacaaagcccttccagcaccaatcgaaaagaccatatcgaaagccaaaggccaaccacgcgagccccaagtatacacactcccaccctcacgcgacgagctaaccaaaaaccaagtatcccttacatgcctcgtaaaaggcttctacccttccgacatcgccgtcgaatgggaatcaaacggccagcccgaaaacaactacaaaacaacccctcccgtcctcgactccgacggatcatttttcctctactccaaactcaccgtcgataaatcccgctggcaacaaggaaacgtcttctcgtgctccgtcatgcacgaagctctccacaaccactacacccaaaaatcactctccctctcacccggcaag

SEQ ID NO: 58813 - RNA, 1386 nt, synthetic construct
  misc_feature 1..1386: note = derived and/or modified sequence opt11 from anti-influenza_Chain
  source 1..1386: mol_type = other RNA
caagtccaactcgtacaatcgggagcagaagtcaagaaacccggcgcatcagtcaaagtctcatgcaaaacatccggctacaccttcacagcttacactatccactgggtccgccaagcccccggccaacgcctagaatggatgggctggattaacgccggtaacggacacaccaaatactcacaacgcttcaaaggacgagtcaccatcacccgagacacctccgcccgcactacttacatggaactacgatcactcacctccgaagacaccgccctttacttctgcgcccgcggacccgaaacctactactacgacaaaacaaactggctcaactcccaccctgacgaatacttccaacactggggacacggcacacaagtaaccgtatcatctgcctcaaccaaaggcccctccgtcttccccctcgccccctcctccaaatccacatcaggcggaacagctgccctcggctgtctagtgaaagactacttcccagaaccagtaacagtaagctggaactccggcgccctcacaagcggcgtccataccttccccgccgtcctccaatcatccggactctacagcctatcctccgtcgtcaccgtaccctcatcatccctcggcacccagacctacatttgcaacgtcaaccataaacccagcaacacaaaagtcgacaagaaagtcgaacccaaatcgtgcgacaaaacccacacatgtcccccatgccccgccccagaactcctaggcggaccctccgtcttcctcttccctcccaaacccaaagacaccctcatgatctcacgaacccccgaagtaacctgcgtcgtcgtcgacgtatcccacgaagatcccgaagtcaaattcaactggtacgtcgacggcgtcgaagtccacaatgccaaaaccaaaccccgagaagaacaatacaactccacgtaccgagttgtatccgtcctgacagtcctacaccaagactggctcaacggaaaagaatacaaatgcaaagtatcaaacaaagcactccccgcccccatagaaaagaccatctccaaagccaaaggccaaccccgcgaacctcaagtctacaccttgccaccctcccgcgacgaactcaccaaaaaccaggtcagcctcacatgcctagtcaaaggattctatccttccgacatagccgtagaatgggaatccaacggacaacccgaaaacaactacaaaaccacccctcccgtactagactcagacggctcattcttcctttactccaaactaaccgtcgacaaatcacgctggcaacaaggcaacgtcttctcctgcagcgtaatgcacgaagcactacacaaccactacacccaaaaatccctctcactctcccccggcaaa

SEQ ID NO: 58814 - RNA, 1386 nt, synthetic construct
  misc_feature 1..1386: note = derived and/or modified sequence opt11 from anti-influenza_Chain
  source 1..1386: mol_type = other RNA
atggaatggtcctggatcttcctcttcctcctctctggcactgcaggcgtccactccgaagtacaactccaacagtccggacccgaattagtcaaaccaggcgcctccgtcaaaatgtcctgcaaagcaagcggatacaccttcacctcttacgttatgcattgggtaaaacaaaaacccggccaaggcctcgaatggattggctacatcaacccctacaacgacggaacccgctacaacgaaaaattcagagtaaaagccaccctcaccagcgacaagtcatccagcacagcctacatggaactctcatcactcacttcagaagacagcgccgtctactactgcgcccgccgcgggctcatcaccaccccaacactcgattactggggccaaggcaccaccctcaccgtctcctcagccaagaccacaccgccctcagtataccccctcgcacccggatcagccgcccaaaccaactcaatggtcacactgggctgcctcgtgaaaggatatttccccgaacccgtaaccgtcacatggaactcaggcagcctctcatcaggcgtacacaccttcccagccgtcctccaatcggacctatacaccctctcctcctccgtcaccgtcccctccagcacctggccctccgaaaccgtaacctgcaacgtcgcacaccccgcatcatccacaaaagtcgacaaaaagatcgtcccacgagactgcggctgcaaaccatgcatctgcaccgtacccgaagtctcctcagtattcatcttcccacccaaacccaaagacgtcctaaccatcaccctaacccccaaggtgacctgcgtcgtagtcgacatcagcaaggacgaccccgaagtccagttctcatgggtcgacgacgtagaagtccacactgcacaaacccaacccagagaagaacagttcaactcaaccttccgatccgtctcagaactccccatcatgcaccaagattggctcaacggaaaagagttcaaatgccgcgtcaactccgcggcattccccgcccccatcgagaaaaccatctccaaaacaaaaggccgccccaaagcaccacaagtctacacaatcccaccacccaaagaacaaatggccaaagacaaagtctccctaacctgcatgatcaccgatttcttccccgaagacatcacagtcgaatggcaatggaacggacaacccgccgaaaactacaaaaacacacaacccatcatggacaccgacggctcctacttcgtatactccaaactcaacgtccaaaaatccaactgggaagccggcaacacctttacctgctccgtcctccacgaaggcctccacaaccaccacacagaaaaatccctcagccactcccccggcaaa

SEQ ID NO: 58815 - RNA, 1398 nt, synthetic construct
  misc_feature 1..1398: note = derived and/or modified sequence opt11 from anti-influenza_Chain
  source 1..1398: mol_type = other RNA
atgctcccatccaccgtccaaaccctcaccctcctactcacatcaggcggagtactcctctccctctacgtaagcgcatcactatcctacctactctactctgacgtcctcctcaaattctcctccaccaaaacaaccgccccaacaatgtccttagaatgcactaacgcttccaacgcacaaaccgtaaaccactcagccaccaaagaaatgaccttcccgccacccgaacccgaatggacatacccccgcctctcatgccaaggctccacattccagaaagcactcctcatctcaccccacagattcggcgaaataaaaggcaactccgctcccctaatcatccgcgaacccttcgtagcctgcggccccaaagaatgccgccacttcgccctcacacactacgccgcacaacccggaggatactacaacggtacgcgcaaagaccgaaacaaactccgtcacctcgtctccgtcaaacttggaaaaataccaacagtcgaaaactcaatcttccacatggccgcctggtccggatccgcctgccacgacggccgcgagtggacctacatcggcgtcgacggacccgacaacgacgcccttgtcaaaatcaaatacggagaagcctacaccgacacctaccactcatacgcacacaacatactccgaacacaagaatccgcctgcaactgcatcgggggagactgctacctcatgatcaccgacggctccgcatcgggcatatccaaatgccgattcctcaaaatccgcgaaggccgcattatcaaagaaatactacccaccggccgagtcgaacacaccgaagagtgtacctgcggcttcgcatcaaacaaaaccatagaatgcgcctgccgcgacaactcctacaccgccaagcgacccttcgtaaaactcaacgtcgagacggacaccgccgaaatacggctcatgtgcaccaaaacctacctcgacacgccacgacccgacgacggctctatcgccggcccatgcgaatcaaacggcgacaaatggctgggaggaatcaaaggaggcttcgtccaccaaaggatggcctcaaaaatcggccgatggtactcacgaacaatgtcaaaaaccaaccgcatgggcatggagctatatgtcaaatacgacggcgacccctggacagactcagacgcactcacactatcaggcgtcatggtatccatcgaagaacccggctggtatagcttcggcttcgaaatcaaagataagaaatgcgacgtaccatgcatcggaatcgaaatggtacacgacggcggcaaagacacatggcacagcgccgccacagcaatatactgcctcatgggctccggacaactcctgtgggatacagtaaccggcgtcgacatggccctc

SEQ ID NO: 58816 - RNA, 1398 nt, synthetic construct
  misc_feature 1..1398: note = derived and/or modified sequence opt11 from anti-influenza_Chain
  source 1..1398: mol_type = other RNA
atgcttccctcaaccgtccaaactctcactctacttctaacaagcggcggagttctcctatccctatacgtctccgccagcctctcctacctcctatactctgacgtactcctaaaattctccagcaccaagaccacagcaccaactatgtcactagaatgcacaaacgcctcaaacgcacaaaccgtcaaccactcagccactaaagaaatgaccttcccaccacccgaacccgaatggacatacccccgcctatcctgccaaggctccactttccaaaaagcactcctcatctcaccccaccgattcggtgaaatcaaaggcaactcagcacccctcataatacgagaacccttcgtagcctgcggacccaaagaatgccgacacttcgccctaacacactacgccgcacaacccggcggctactacaacggaacgcgcaaagatcgcaataaactccgacacctagtctccgttaaacttggtaaaattcccacagtcgagaactcaatcttccatatggccgcctggtccggctccgcctgccacgacggcagagaatggacatacatcggcgtcgacggcccagacaacgacgcactcgtaaaaatcaaatacggagaagcctacacagacacataccactcatacgcccacaacatcctacgtacccaagagagcgcatgcaactgcatcggaggcgactgctacctaatgatcaccgacggatccgcctctggaatctccaaatgccgcttcctcaaaatccgcgaagggagaatcatcaaagaaatcctacccactggccgagtcgaacacaccgaagagtgcacatgcggcttcgcaagcaacaaaaccatcgaatgcgcctgccgagacaactcttacaccgccaaacgccccttcgtaaaactaaacgtcgaaaccgacaccgccgaaatccgactcatgtgcaccaagacctacctcgacacaccacgacccgacgacggctcaatcgccggcccttgcgaatccaacggagacaaatggctcggaggcatcaaaggcggctttgtccaccaacgcatggcaagcaaaatcggcagatggtactcccgcacgatgtccaaaaccaaccgcatgggcatggaactatatgtaaaatacgacggcgacccctggaccgactcagacgccctcacgctctccggagtaatggtatccatcgaagaaccaggatggtactccttcggcttcgaaatcaaagacaagaaatgcgacgtaccatgcataggcatagaaatggttcacgacggaggcaaagacacatggcactccgccgccaccgccatatactgcctaatgggctcaggccaactcctatgggacacagtcacaggagtcgacatggcccta

SEQ ID NO: 58817 - RNA, 1407 nt, synthetic construct
  misc_feature 1..1407: note = derived and/or modified sequence opt11 from anti-influenza_Chain
  source 1..1407: mol_type = other RNA
atggactggacctggagattcctcttcgtcgtcgccgccgcaaccggcgtccaatcccaagtacaactggtacaatcaggggcagaagtaaaaaaacccggctcatccgtcaaagtctcatgcaaagcctcgggaggaaccctaaacaactacgccatctcctgggtccgccaagcccccggacaaggcctcgaatggatgggcgggatctcccccatctttggcaccctcaactacgcagaacgtttccaagggagagtcaccatcacagccgacgtattcaccaacaccgtctatatggaactctcctctctacgttccgaagatacagcagtttacttctgcgcccgaggctgcggctacaactgctactacttcgacggatggggacaaggcacactcgtaaccgtctctagcgccagcaccaaaggcccctcggtcttccccctcgcaccctcatccaaatcaacttcaggaggcaccgccgccctcgggtgcctcgtcaaagactacttccccgaacccgtcaccgtctcatggaactccggcgccctcacctccggcgtccacaccttccccgcagtcctccaatcaagcggcctctactccctctcctccgtagtaaccgtcccctcctcctctcttggcacccaaacctacatctgcaacgtcaaccacaaaccctccaacacaaaagtcgacaaaaaagtcgaacccaaatcctgcgataaaacccacacatgcccaccctgcccagcccccgaactacttggcggcccctcagtcttccttttcccacccaaacccaaagacaccctcatgatcagccgcacccccgaagtaacctgcgtagtcgtcgacgtcagccacgaagaccccgaagtcaaattcaactggtacgtagacggcgtagaagtacataacgccaaaaccaaaccccgagaagaacagtacaactcaacctaccgtgtcgtctccgtactaactgtcctccaccaagactggctcaacggcaaagaatacaaatgcaaagtcagcaacaaagccctcccagcccccatcgaaaaaaccatatccaaagcaaaaggccaacctcgcgaaccccaagtatacacactcccaccctccagagacgaactcaccaaaaaccaagtctccctaacctgcctcgtaaaaggattctacccctccgacatcgcagtcgaatgggaatcgaacggacaaccggaaaacaactacaagaccactccccccgtcctcgactcagacggatcattcttcctctattccaagctcaccgtcgacaaatcccgctggcaacaaggaaacgtattcagctgctccgtaatgcacgaaggtctacacaaccactacacacaaaaatccctttccctctcaccaggcaaa

SEQ ID NO: 58818 - RNA, 1407 nt, synthetic construct
  misc_feature 1..1407: note = derived and/or modified sequence opt11 from anti-influenza_Chain
  source 1..1407: mol_type = other RNA
atggactggacctggcgcttcctcttcgtagtcgccgccgccacaggcgtccagagccaagttcaactggtccaatcaggtgcagaagtaaagaaacctggcagctccgtcaaagtctcatgcaaagcatctggcggcaccctaaacaactacgcaatctcctgggtccgacaagcccccggccaaggcctcgaatggatgggaggcatatcaccaatcttcggtaccctaaactacgctgaacgattccaaggcagagtcacaatcaccgccgacgtattcacaaacaccgtctatatggaactctcatccctgcggtccgaagacaccgctgtctacttttgcgcccggggctgcggatacaactgctactacttcgacggctggggccaaggcaccctcgtaaccgtatcatccgcctcaaccaaaggcccctccgtcttcccgctcgccccatccagcaaatccacttccggcggcaccgccgccctcggctgtctagtaaaagactacttccccgaaccagtaaccgtttcctggaactctggtgcactcacctccggcgtccacaccttccccgccgtcctccaaagctccggactctactccctcagctccgtcgtcaccgtccccagctcatcgctagggacccaaacctacatatgcaacgtaaaccacaaaccctccaacactaaagtcgacaagaaagtggaacccaaatcatgcgataaaacccacacatgcccaccctgccccgcccccgaactactaggcggcccctcagtcttcctcttccctccgaaacccaaagacacactcatgatatccagaacccccgaagtcacatgcgtcgtcgtagacgtatctcacgaagacccagaagtaaaattcaactggtacgtagacggcgtagaagtgcacaacgccaaaaccaaaccccgcgaagaacaatacaactcaacctaccgagtcgtcagcgtcctcaccgtcctccaccaagactggctcaacggaaaggaatacaaatgcaaagtctctaacaaagcactccccgcccccatagagaaaaccatctccaaagccaaaggccaaccacgggaaccccaagtctacaccctacccccatcccgagacgaactcaccaaaaaccaagtatccctcacttgtctagtcaaaggcttctacccgtcagacatcgccgtcgaatgggaatcaaacggccaaccagaaaacaactacaaaaccaccccaccagtactagactcagacggcagcttcttcctctacagcaaactcaccgtcgacaaatcccgatggcaacaaggaaacgtcttctcctgctccgtcatgcacgaaggactccacaaccactacacccaaaaatccctctcactctcccccggaaaa

SEQ ID NO: 58819 - RNA, 1407 nt, synthetic construct
  misc_feature 1..1407: note = derived and/or modified sequence opt11 from anti-influenza_Chain
  source 1..1407: mol_type = other RNA
atggactggacctggcgcttcctattcgtcgtcgccgccgccaccggtgtccaatcgcaagtccaactcgtacaatccggcgccgaagtcaagaaaccaggctcatccgtcaaagtaagctgcaaagcatccggcggcaccctgaacaactacgccatctcctgggtccgccaagcccccggtcaaggccttgaatggatgggaggcatctcccccatcttcggcacactcaactacgccgaacgcttccaaggaagagtcaccatcactgcggacgtcttcaccaacaccgtatacatggaactctcctccctccgcagcgaagacacagcagtatacttctgtgcacgcggctgcggctacaactgttactacttcgacggctggggccaaggcaccctcgtcaccgtatcctcagcctcaaccaaaggcccatccgtcttcccactcgcaccctcatccaaatccaccagcggcggaaccgccgcactcggctgcctcgtcaaggactacttccccgaacccgtaaccgtctcctggaacagcggcgcgctaacctccggagtgcacaccttccccgccgtcctccaatcatccggcctctacagcctatcctccgtcgtcacggttcccagctcatccctcggcactcagacctacatttgtaacgtgaaccacaagccctccaacaccaaggtcgacaagaaagtcgaacccaaatcctgcgacaaaacccacacatgcccgccatgcccagcccccgaactcctcggagggccctcagtgttcctcttcccacccaaacccaaagacacactcatgatcagccgaaccccagaagttacctgcgtcgtcgtcgacgtctcacacgaagaccccgaagtcaaattcaactggtacgtcgatggcgtcgaagtccacaacgccaaaacaaaacctcgcgaagaacaatacaacagcacctaccgagtcgtctccgttctaacagtcctacaccaagactggctaaacggcaaagaatacaaatgcaaagtctcaaacaaagccctccccgccccaatcgaaaagacaatatccaaagccaaaggccaaccccgcgaaccacaagtctacaccctacccccatcccgcgacgaactgaccaaaaaccaggtcagcctaacctgcctcgttaaaggcttctacccctccgacatagcagtagaatgggaaagcaacggccaaccagaaaacaactacaaaacaacaccccctgttctagacagcgacggctctttcttcctatactccaaactcaccgtcgacaaatcaagatggcaacaaggcaacgtcttctcatgctccgtcatgcacgaaggcctccataaccattacacccaaaaatcccttagcctatcccccggcaaa

SEQ ID NO: 58820 - RNA, 1413 nt, synthetic construct
  misc_feature 1..1413: note = derived and/or modified sequence opt11 from anti-influenza_Chain
  source 1..1413: mol_type = other RNA
gacggcgtcaaaccccttatcctccgagactgctcagtggccggctggcttctgggcaaccccatgtgcgacgagttcatcaacgtccccgaatggtcctacatcgtcgaaaaagcaaaccccgccaacgacctctgctaccccggcaacttcaacgactacgaagaattaaaacacctcctctcacgcatcaaccacttcgagaaaatccaaatcatccctaaatcatcctggagcgaccacgaagcctccagcggcgtctcatccgcctgcccctaccaaggcaccccctccttcttccgcaacgtcgtatggctcatcaagaaaaacaacacctacccaaccatcaaacggagctacaacaacaccaaccaagaagacctactcatactctggggcatccaccactcaaacgacgccgccgaacaaaccaaactataccaaaacccaaccacttacatctcagtcggcacctccacccttaaccaacgcctcgtcccaaaaatcgctacccgaagcaaagtcaacggccaaaacggccgcatggacttcttctggaccatcctcaagcccaacgacgctataaacttcgaaagcaacggcaacttcatagcccccgaatacgcctacaaaatcgtcaagaaaggctacattcccgaagcaccccgggacggacaggcctacgtacgaaaagacggcgaatgggttctcctctcaacattccttcgctcggacaaaacacatacctgcccaccctgccccgccccagaactacttggtggaccatccgtcttcctcttcccacccaaacccaaagacaccctcatgatctcgcgcacgccagaagtcacctgtgttgtcgtagacgtctcccacgaagacccagaagtcaaattcaactggtacgtagatggcgtcgaagtccacaacgcaaagacaaaaccccgagaagaacagtacaactctacctaccgcgtcgtatccgtcctaaccgttctccaccaagactggctcaacggcaaagaatacaaatgcaaggtctccaacaaagcactacccgcacccatcgagaaaactatctccaaggccaaaggtcaaccacgggaaccgcaagtctacacactacctccctcacgcgaagaaatgaccaaaaaccaagtatcactaacatgccttgtcaaaggcttctaccccagcgatattgccgtcgaatgggagtcaaacggccagcccgaaaacaactacaaaaccaccccacccgtcctagacagcgacggctccttcttcctctactcgaaactcaccgtcgacaagtcacgctggcaacaaggaaacgtattctcttgctccgtcatgcacgaagcactacacaaccactacacacaaaaatcactatcactctcccccggcaaa

SEQ ID NO: 58821 - RNA, 1413 nt, synthetic construct
  misc_feature 1..1413: note = derived and/or modified sequence opt11 from anti-influenza_Chain
  source 1..1413: mol_type = other RNA
gatggcgtaaaacccctcatcctacgcgactgctcagtcgcaggctggttactcggcaaccccatgtgcgacgagttcatcaacgtacccgaatggtcatatatagtcgaaaaggcgaaccccgcaaacgacctttgttaccccggaaacttcaatgactacgaagaactcaaacatctactctcccgcataaaccacttcgagaaaatacagatcatccccaaatcatcctggtccgaccatgaagcctcctctggcgtctcctccgcctgcccataccaaggcacaccatctttcttccgaaacgtcgtctggctaatcaagaaaaacaacacctacccaacaatcaaacgcagctacaataacaccaaccaagaagaccttctaatcctctggggcatacaccactcaaacgacgccgctgaacaaacaaaactataccaaaacccaacaacctacatatccgtcggtaccagtactctcaaccaacgcctagtacccaaaatcgccacccggtcaaaagtcaacggccaaaacggccgcatggacttcttttggaccatcctcaaaccaaacgacgcaataaacttcgaatcaaacggcaacttcatcgcaccagaatacgcatacaaaatcgtcaagaaaggctacatccccgaagcaccccgcgacggccaagcatacgtccgcaaagatggcgaatgggtcttactgtccacattcctccgctccgataaaactcacacatgcccaccctgccccgcgcccgaactactaggcggcccctcagtcttcctattccctcccaaacccaaagacacactcatgatctcccgcacacccgaagtaacatgcgtcgtcgttgacgtatcgcacgaagacccagaagtcaaattcaactggtacgttgacggcgtagaagtacacaacgcaaagaccaaaccccgcgaagaacaatacaactccacctaccgagttgtctccgtactcacagtactccaccaagactggctcaacggaaaagaatacaaatgcaaagtatccaacaaagcactccccgcccccatcgagaaaaccatctccaaagccaaaggccagccccgcgaaccccaagtctacacactaccaccctccagggaagaaatgaccaaaaaccaagtctccctcacatgccttgtcaaaggcttctatccctccgacatcgccgtcgaatgggaaagcaacggacaacccgaaaacaactacaaaaccacccctcccgtactcgactctgacggctccttcttcctatacagcaaactcacagtcgacaagagccgctggcaacaaggcaacgtattctcatgctcagtcatgcacgaagccttacacaaccactatacccaaaaatccctctctttatcccccggaaaa

SEQ ID NO: 58822 - RNA, 1416 nt, synthetic construct
  misc_feature 1..1416: note = derived and/or modified sequence opt11 from anti-influenza_Chain
  source 1..1416: mol_type = other RNA
atggactggacatggcgcttcctattcgtcgtcgccgccgccaccggcgtacaatgccaagtccagctcgtccaatcaggcgccgaagtcaaaatgcccggctcctccgttaaagtttcatgcaagacctcaggcgtattcttctcctctcacgccatctcctgggtccgccaagcacccggccaaggactagaatggatgggcgggatctcccccatgttcggcaccacccactatgcccaaaagttccaaggccgagtaaccataacagccgaccaatcaaccaccaccgcctacatggaactaacctccctcacatctgaagacacagccgtatactattgcgccagagatggcgcaggctcgtactatcccctaaattggttcgacccctggggacaaggcactctcgtcacagtctcctccgcatcgaccaaaggaccaagcgtcttccccctggccccctcatctaaatccacctccggcggaaccgccgcccttggatgcctagtcaaggactacttccccgaacccgtcaccgtctcctggaactccggagccctaacttccggcgtacacaccttccccgccgtactccaatcctcaggcctctactcactctcctcagtcgttaccgtacccagttccagcctcggcacccaaacctacatatgcaacgtaaaccacaaaccctccaacacaaaagttgacaaacgcgtcgaacccaagtcctgcgacaaaacccacacatgcccaccctgccccgccccagaactcctcggcggcccatccgtcttcctcttccctcccaaacccaaagacaccctaatgatctcacgcacccccgaagtcacatgcgtagtggtagacgtctcacacgaagaccccgaggtcaaattcaactggtacgtagacggcgtagaagtccacaacgcaaaaaccaaaccccgcgaggaacaatacaactccacctaccgcgtcgtatccgtcctcaccgtcctacaccaagactggctcaacggaaaagaatataaatgcaaagtctcaaacaaagcgctacccgcccctattgagaaaacaatctcaaaagccaaaggccaaccacgagaaccccaagtctacacactgccaccatcccgcgacgaacttaccaaaaaccaagtctcactaacatgtctcgtcaaaggcttctaccccagcgacatagctgtcgaatgggaatccaatggtcaaccggaaaacaactacaaaaccacaccacccgttcttgactccgacggttcattcttcctatactcaaagctcacagtagacaaaagccgctggcaacaaggcaacgtattctcctgcagcgtcatgcacgaaggactccacaaccactacacccaaaaatcactatcactatcccccggcaag

SEQ ID NO: 58823 - RNA, 1416 nt, synthetic construct
  misc_feature 1..1416: note = derived and/or modified sequence opt11 from anti-influenza_Chain
  source 1..1416: mol_type = other RNA
atggactggacctggcgattcctcttcgtcgtcgccgcagccacaggcgtacaatgtcaagtacaactcgtccaatccggcgccgaagtcaaaatgcccggcagctcagtcaaagtctcatgcaaaacatccggcgtcttcttctcctcccatgccatctcatgggtaagacaagcacctggccaaggcctcgagtggatgggcggcatatcccccatgttcggcaccacacactacgcccaaaaattccaaggccgtgtcacaataaccgccgaccaatccacaaccaccgcctacatggagctaacaagcctcacctccgaggataccgcagtatactactgcgcccgagacggtgccggctcatactaccctctaaactggttcgacccctggggacaaggaaccctagtaacagtctcatcagcctcaaccaaaggcccctccgtcttcccccttgcccccagctcaaaatccacctccggcggaaccgccgcccttggttgcctcgtaaaggactacttccccgaaccagtcacagtctcatggaactccggcgccctcacctccggagtccataccttcccagccgtactccaatcatccggcctatactcactctcaagtgtcgtcacagtcccctcctcctccctcggtacccaaacctacatctgcaacgtcaaccacaaaccctccaacaccaaagtagacaaacgcgtcgagcccaaatcctgcgacaaaacacacacgtgcccaccatgccccgcacccgaactcctcggcggcccctcggtattcctcttcccacccaaacccaaagacaccctcatgatctcacgaacccctgaagtaacctgcgttgtagtcgacgtcagccacgaagaccccgaagtcaaattcaactggtacgtcgacggcgtcgaagtccacaacgctaaaactaaacccagagaagaacaatacaacagcacataccgagttgtctcagtcctaacagtcctccatcaagactggttaaacggcaaagaatacaaatgcaaagtatccaacaaagcccttcccgccccaatcgagaaaaccatctcgaaagccaaaggccaaccccgagaaccacaagtatacaccctcccacccagccgcgacgaactcaccaaaaaccaagtctccctaacatgcctagtcaaaggcttctaccccagcgacatcgccgtcgaatgggaaagcaacggccaacccgaaaacaactataaaaccactcccccagtactcgactccgacggctctttcttcctctactccaaattgaccgtcgacaaatcccgatggcaacaaggcaacgtcttctcctgctccgtcatgcacgagggcctacacaaccactacacccaaaaatccctctctctgtcaccaggaaaa

SEQ ID NO: 58824 - RNA, 1416 nt, synthetic construct
  misc_feature 1..1416: note = derived and/or modified sequence opt11 from anti-influenza_Chain
  source 1..1416: mol_type = other RNA
atggactggacatggcgattcctattcgtcgtcgcagctgccaccggcgtccaatgccaagtacaactcgtccaatctggggccgaagtcaaaatgcccggatcctccgtcaaagtctcttgcaagacctcaggcgtcttcttctcatcccacgccatctcatgggtacgccaagcccccggacaaggtctagaatggatgggcggcatcagccccatgttcggcaccacccactacgcacaaaaattccaaggccgcgtcaccatcacagccgaccaatctaccactaccgcgtacatggaacttacctcactaacctcagaagacactgccgtttactactgcgcccgagacggcgccggctcgtactaccccctcaactggttcgacccatggggccaaggcaccctcgtcaccgtcagctccgcctcaacaaaaggacccagcgtattccccctcgccccctcaagcaaaagcacctccggaggaacagccgccctcggatgcctcgtcaaagactacttcccagaacccgtcactgtctcctggaactcaggagcactaacctccggcgttcacacttttcctgccgtactccaaagctcaggcctgtactccctcagctccgtagtcaccgtccctagctcatcactcggcacacaaacctacatctgcaacgtcaaccacaaaccctctaacaccaaagtcgacaaacgagtcgaacctaaatcatgcgacaaaacacacacctgtcccccatgccccgcccccgaactcctaggcggcccctcagtcttcctcttcccacccaaacccaaagacacactcatgatctctagaactcccgaagtaacatgcgtagttgtcgacgtatctcacgaagaccccgaagtaaaatttaactggtacgtcgacggcgtcgaagtacacaacgcaaaaaccaaaccacgcgaagaacaatacaacagcacataccgagtcgtatcggtcctcaccgtactacaccaagactggctcaacggcaaagaatacaaatgcaaagtctccaacaaagccctcccggcccccatcgaaaagacaatctcaaaagccaaaggccaacctcgcgaaccacaggtctacaccctccctccatccagagacgaactcaccaaaaaccaagtcagcttaacctgcctagtcaaaggcttctacccctccgacattgcagtcgaatgggaatcaaacggccaaccagaaaacaactacaaaaccacacccccagtactagattccgacggctcgttctttctctactccaaactaacagtcgacaagtcccgatggcaacaaggcaacgtcttctcctgctcagtaatgcacgaaggtctccacaaccactacacacagaaaagcctatccctcagccccggcaaa

SEQ ID NO: 58825 - RNA, 1419 nt, synthetic construct
  misc_feature 1..1419: note = derived and/or modified sequence opt11 from anti-influenza_Chain
  source 1..1419: mol_type = other RNA
atgacagaatcagccatgacatcacgagccggcagaggacggggcgcagacctcgtagcagccgtggtccaaggacacgccgccgcctcagacgccgcaggagacctatccttcccggacggattcatatggggcgcagcaacagcagcctaccaaatagaaggagcctggagagaagacggaaggggcctgtgggatgtattcagccacacaccaggaaaagtcgcaagcggacacacaggcgacatagcatgcgaccactaccaccgatacgccgacgacgtcagactaatggccggactcggagaccgagtataccgattcagcgtagcctggcccaggatcgtcccagacggaagtggaccagtcaacccagccggactagacttttacgaccgactggtagacgaactcttaggccacggtataacaccctacccaactctatatcactgggacctaccacaaacactggaagatagaggaggatgggccgcccgagacacagcgtaccgcttcgcagaatacgccctcgcagtacacagacgcctaggcgaccgagtccgatgctggatcaccctcaacgaaccctgggtcgccgccttcctcgcaacacaccgtggagcaccgggcgcagccgacgtcccacgattccgagcagtacaccacctactcctaggccacggcctaggactacgcctacgatccgccggcgccgggcaactcggcctaacattatcactatccccagtgatagaagcgcgaccaggcgtacgtggaggcggacgccgagtcgacgccctggcaaacagacagttcctagacccagccctccgcggccgctaccccgaagaagtactaaaaataatggcaggacacgccagactaggacatccagggcgcgacctggaaacgatacaccaacccgttgacctgctaggtgtaaactactacagccacgtcagactagcagccgaaggcgaacccgcgaaccgactcccaggctcagaaggaatacgattcgaacgacccaccgccgtcacagcatggcccggcgacagaccagacggactccgaacactcctgctccgcctctcgcgcgactaccccggcgtcggactaatcataaccgaaaacggcgccgcgttcgacgacagagcagacggcgaccgagtacacgaccccgaacgcattagatacctcaccgccacactcagagcagtacacgacgccataatggcaggagcagacctccgagggtacttcgtctggagcgtactcgacaacttcgaatgggcctacggctaccacaaacgtggaatcgtatacgtggactacaccacaatgaggcgaataccacgcgaatcagcactatggtatagagacgtagtgcgaagaaacgggctcagaaacggagaa

SEQ ID NO: 58826 - RNA, 1419 nt, synthetic construct
  misc_feature 1..1419: note = derived and/or modified sequence opt11 from anti-influenza_Chain
  source 1..1419: mol_type = other RNA
atgacagagtcagcgatgacaagcagagcaggaaggggaagaggagcggacctcgtcgccgcagtagtacaggggcacgcggcagcatcggatgcggcgggggacctgagcttcccagacggattcatatggggcgcggcaacggcagcgtaccaaatagagggggcatggagagaagacggaagaggactatgggacgtgttcagccacaccccaggaaaagtggcaagcggacacacgggagacatagcgtgcgaccactaccacagatacgcggacgacgtaagactcatggcaggactaggagacagggtctaccgatttagcgtcgcatggccaagaatagtaccagacgggtcaggcccagtcaacccggcaggattagacttctacgacaggctagtagacgaactcctaggacacggcattacgccatacccaacactgtaccactgggacctaccacagacgctagaagacagaggaggatgggccgcaagagacacagcatacaggttcgcagaatacgcgctagccgtacaccgccgcctaggggacagggtacggtgctggataacactcaacgaaccctgggtggccgcattcctggcaacacatagaggagcaccgggggcggcagacgtgcccagattccgcgcagtacaccacctactgctagggcacggactagggctgagactaagaagcgcaggagcaggacaactcggcctaacgctcagtctaagcccagttatagaagcgagaccaggagtgagaggagggggaagaagggtcgacgcactggcgaacagacagttcttggacccggcactacggggaaggtaccccgaagaagtattaaaaataatggcgggacacgcacgactaggacatccagggagagacctagaaacaatacaccaacccgtggacttactaggagtaaactactacagccacgtgaggctagcggcagaaggagaaccagcgaacaggctgccagggagcgaaggaataagattcgaaagaccgacagcagtaacggcatggccaggagacagaccagacggcctcagaacactgctgctaagactatcaagggattacccaggggttggattaataataacggaaaacggagcggcattcgacgaccgggcagacggagacagggtacacgaccccgaacgaataagatacctaaccgcgacgctaagagccgtacatgacgcaataatggcgggagcagacctgcgggggtatttcgtatggagcgtactagacaacttcgagtgggcatacggataccacaaaagagggatagtctacgtggactacaccacaatgagaaggataccacgggaaagcgccctatggtacagggacgtagtgagaagaaacggactaaggaatggagaa

SEQ ID NO: 58827 - RNA, 1422 nt, synthetic construct
  misc_feature 1..1422: note = derived and/or modified sequence opt11 from anti-influenza_Chain
  source 1..1422: mol_type = other RNA
ctatcccgcatcaaccactttgagaaaatacaaatcatccccaaatcctcctggtccgaccacgaagcatccagcggcgtatcctccgcctgcccctaccaaggaacacccagcttcttccgcaacgtcgtctggctcatcaaaaagaacaacacatacccaaccataaaacgcagctacaacaacaccaaccaagaagacctactaatcctctggggcatacaccactcaaacgacgccgccgaacaaacaaaactctaccaaaaccccacgacctacataagcgtcggcacatccaccctaaaccaacgcctggtccccaaaatcgccaccagatccaaagttaacggccagaacggccgaatggacttcttttggactatcctaaaacccaacgacgccatcaacttcgaatcaaacggcaacttcatcgcacccgaatacgcctacaagatagtcaaaaagggcgactccgccatcgtaaagtcagaagttgaatacggaaactgcaacaccaaatgccaaaccccaatcggagccatcaactcctcaatgcccttccacaacatacacccccttaccatcggcgaatgccccaaatacgtcaaatcaaacaagctagtcctcgccaccggcctccgcaactcaccactcggctacatccccgaagcaccacgagacggccaagcatacgtacgcaaagacggcgaatgggtcctactctcaaccttcctaaggtccgacaaaacccatacctgcccaccctgccccgctcctgaactcctcggaggaccatcagtcttcctcttcccacctaaaccaaaagacaccctcatgatatcacgaacgcccgaagtaacctgtgtagtagtagacgtatcccatgaagaccccgaagtcaaattcaactggtacgtcgacggagtcgaagtccacaacgccaaaactaaaccgagagaagaacaatacaactccacctaccgcgtcgtctcagtcctaaccgtactccaccaagactggctaaacggcaaggaatacaaatgcaaagtctccaataaggcactcccagcccccatcgagaaaacaatatccaaagccaaaggccaaccccgcgaaccccaagtttacaccctacctccctcacgcgaagaaatgaccaaaaaccaagtctccctaacctgcctcgtcaaaggattctacccctccgatatagcggtagaatgggaaagcaacggacaacccgaaaacaactacaaaacaaccccacccgtcctcgacagcgatggctctttcttcctatactccaaactaaccgtcgacaaaagccgctggcagcaaggcaacgtattctcatgcagcgtcatgcacgaagccctccacaaccactacacacaaaaatcactctcactcagccccggcaaa

SEQ ID NO: 58828 - RNA, 1422 nt, synthetic construct
  misc_feature 1..1422: note = derived and/or modified sequence opt11 from anti-influenza_Chain
  source 1..1422: mol_type = other RNA
ctctcccgaatcaaccacttcgagaaaatccaaatcatccccaaaagcagctggtccgaccacgaagcatcctcgggcgtctcctccgcatgcccctaccaaggcaccccctcattcttccggaacgtcgtttggctcatcaagaaaaacaacacctaccccaccatcaaacgttcatacaacaatacaaaccaagaagaccttctaatcctgtggggcatccaccactccaacgacgccgcagaacaaaccaaactctaccaaaaccccacaacctacatctccgtcggaacctctacactcaaccaacgcctcgtaccaaaaatcgccactcgctccaaagtcaacggccaaaacggaagaatggacttcttctggaccatcctaaaacccaacgacgccataaacttcgaatctaacggcaacttcatcgcgcccgaatacgcctacaaaatcgtcaagaaaggcgactccgccatcgtaaaatcagaagtcgaatacggcaactgcaacaccaaatgccaaacccctataggtgcaataaactcctccatgcccttccataacatacaccccctcaccataggagaatgccccaaatacgtcaaatccaacaaactcgtccttgccacaggactccgtaactcaccactcggatacatacccgaagctccccgagacggccaggcctacgtcagaaaagacggcgaatgggttctcctctccactttcctacgctcagacaaaacacatacctgcccaccctgccccgctcccgaactactaggcggaccctccgtattcctattccctcccaaacccaaagacaccctcatgatatcccgcactcccgaggtaacatgcgtcgtcgtcgacgtctcacacgaagaccccgaagtaaaattcaactggtacgtcgacggtgtcgaagtacacaacgccaaaaccaaaccccgcgaagaacaatacaactccacataccgcgtagtctcagtactcaccgtcctccaccaagactggctcaacggcaaagaatacaaatgcaaagtttccaacaaagccctacccgcaccgatagagaaaaccatctccaaagccaaaggccaaccaagagaaccccaagtatacaccctcccgccctcgcgagaagaaatgaccaaaaaccaagtctccctcacttgcctcgtcaaaggattctacccctccgacatcgcagtcgaatgggaatccaacggccaacccgaaaacaattacaaaaccaccccacccgtcctagactccgacggttccttcttcctctactccaagctcaccgtagacaaatcccgctggcaacagggcaacgtcttcagctgctcggtcatgcacgaagccctccacaaccactacacccagaaatcactctcactctcccccggaaaa

SEQ ID NO: 58829 - RNA, 1428 nt, synthetic construct
  misc_feature 1..1428: note = derived and/or modified sequence opt11 from anti-influenza_Chain
  source 1..1428: mol_type = other RNA
atggagttcggcctctcatgggtattcctcgtagccctactacgaggagtccaatgccaagtccagctagtcgaatcaggcggcggcgtagtccaaccaggccgatccctccgcctatcgtgcgcagcctcaggcttcacattctcccgatttggcatccactgggtccgccaagcccccggcaaaggcctcgaatggatggctgtaatctggtacgacggatcaaacaaattctacgccgactccgtaaagggacgattcacaatatcccgagacaacagcaaaaacacagtctacctccaaatgaactccctacgcgccgaagacaccgcagtctactactgtgccaaagattcccgcggatactgctcctccatcatctgcttcgaaggcggcctcgacaactggggccaaggcacactcgtcaccgtatcctccgctagcacaaaaggcccctcagtcttccctctcgccccctcctccaaaagcacctccggcggaaccgccgccctcggctgcctggtaaaagactacttcccagaaccagtcaccgtatcatggaacagtggagcacttacatctggcgtgcacacctttcctgccgtactccaaagctccgggctatactccctcagctccgtcgtcaccgtcccgtcatccagcctcggcacccaaacctacatctgtaacgtgaaccacaaaccctcaaacacaaaagtcgacaaacgagtggaaccaaaatcctgcgacaaaacacacacctgtccaccctgccccgcccccgaactcctcggcggaccctccgtcttcctattcccacccaaacccaaagacaccctcatgatctcccgaactcccgaagtaacctgcgtcgtcgtcgacgtctcacacgaagaccccgaagtcaaattcaactggtacgtcgacggagtagaggtccacaacgcaaaaaccaaaccccgagaggaacaatacaactcaacctacagagtcgtatccgtcctcacagtcctccaccaagattggctcaacggcaaagaatataaatgcaaagtctccaataaagccctacccgcccccatcgagaaaaccatatcgaaagccaaaggacaacctcgagaaccacaagtctacaccctaccaccctcccgcgacgaactaaccaaaaaccaagtctcactcacatgccttgtcaaaggcttctacccctccgacatcgccgtagaatgggaatcgaacggccagcccgaaaacaactataaaacaaccccgcccgtactcgactccgacggcagcttcttcctctactcaaaactaacagtagacaaatcccgctggcaacaaggcaacgtattcagctgctccgtaatgcacgaaggcctccacaaccactacacacaaaaatcactaagcctatcccccggcaaa

SEQ ID NO: 58830 - RNA, 1428 nt, synthetic construct
  misc_feature 1..1428: note = derived and/or modified sequence opt11 from anti-influenza_Chain
  source 1..1428: mol_type = other RNA
atggagttcggcctctcctgggttttcctagtcgcactcctccgcggagtccaatgccaagtccaacttgtcgaatcaggaggcggagtcgtacaaccaggccgctccctccgtctatcctgcgccgcttccggtttcaccttctcacgcttcggaatccattgggtccgacaagcccccggcaaaggcctggagtggatggccgtaatctggtacgacggctccaacaagttctacgcagactccgtgaaaggccgcttcaccatcagccgcgataactccaaaaacacggtttacctacaaatgaactccctccgagccgaagacacagccgtctactactgtgccaaagactcacgcggctactgctcctcaataatatgcttcgaaggcggcctcgacaactggggccagggcaccttagtaaccgtctcctcagcctctaccaagggaccctcagtattccccctagcacccagtagcaaaagcacctcaggcggaaccgccgccctaggctgcctagtcaaagattacttcccggaacccgttaccgtttcctggaactccggagccctcaccagcggcgtgcacacattccccgccgtcctacaaagctccggcctatactccctctcctccgtagtcaccgtcccctcctcctcactaggcacccaaacctacatctgcaacgtcaaccacaaaccctccaacaccaaagtagacaaacgcgtcgaacccaaatcttgcgacaaaactcacacgtgccctccttgcccagccccagaactccttggaggcccctcagtcttccttttcccacccaaacccaaagacaccctgatgatcagtcgaacccccgaggtgacctgcgtagtcgtcgacgtctcccacgaagaccccgaagtaaaattcaattggtacgtcgacggcgtcgaggtacacaacgcaaaaaccaaaccccgtgaagaacaatacaattccacctaccgagtcgtaagcgtactaacagtcctgcaccaagactggcttaacggcaaagaatacaaatgcaaagtctccaacaaagcactaccagcaccaatagagaaaacaataagcaaagcaaaaggacaaccccgagaaccacaagtctatacactcccaccctcacgcgacgaactaaccaaaaaccaagtaagcctaacctgcctcgtcaaaggcttctacccctccgacatcgccgtcgaatgggaatccaacggacaacccgaaaacaactacaaaaccacaccacccgtattagactcagacggatcattcttcctctactcaaaactaaccgtcgacaaatcccgctggcaacaaggcaacgtattcagctgctccgtcatgcacgaaggccttcacaaccactacacacaaaaatccctctcactctcccccggcaaa

SEQ ID NO: 58831 - RNA, 1428 nt, synthetic construct
  misc_feature 1..1428: note = derived and/or modified sequence opt11 from anti-influenza_Chain
  source 1..1428: mol_type = other RNA
atggagttcgggctcagctgggtattccttgtcgcccttcttagaggcgtccaatgccaagtccagctagttgaatcaggaggcggcgtcgtacaacccggccgatccctccgactatcatgcgccgcctccggcttcacattctcccggttcggcatccactgggtacgccaagcccctggaaaaggactggaatggatggccgtaatctggtacgacggatcaaacaaattctatgcagactccgtcaaaggccgcttcaccatatcgcgcgacaacagcaaaaacaccgtatacctccaaatgaactccctccgagccgaagacaccgccgtatactactgcgcaaaagactcacgcggttactgctcctcaatcatctgcttcgaaggaggcctcgacaactggggtcaaggcaccctcgtaacagtcagcagcgcaagcaccaaaggcccatcagtcttcccactagccccctcctccaagtccacctccggtgggacagctgcactcggctgcctagtcaaagactacttcccagaacccgtaaccgtatcatggaactcaggcgcactcacatccggagtccataccttcccagccgtactccaatcctcaggcctctactccctctcctccgttgtcaccgtcccctcctcatccctaggcacccaaacctacatatgcaacgtaaaccacaaaccctcaaacacaaaagtcgacaaacgcgttgagccaaaatcatgcgacaaaacccacacctgtcccccatgccccgccccagaactcctcggcggcccatcggtgttcctcttccctcccaaacccaaagacacattaatgatctcgagaacccccgaagtaacctgcgtcgtagtcgacgtctcccacgaagatcccgaagtcaaattcaactggtacgtcgacggcgtagaagtccacaacgccaaaaccaaaccccgcgaagaacaatacaacagcacctaccgcgtagtctcggtcctaacagtacttcaccaagactggcttaacggcaaagaatacaaatgcaaagtatccaacaaagccctccccgcccccatagagaaaaccatatcaaaagcaaaaggccagccccgagaaccccaagtctacaccctaccaccctcccgcgacgaactcaccaaaaaccaagtcagcctaacatgcctcgtcaaaggcttctacccatccgacatcgcagtcgaatgggaatctaacggccagcccgaaaacaactacaagacaaccccaccagtcctagactctgacggctccttcttcctctactcaaagctgaccgtcgacaaatcccgctggcaacaaggcaacgtcttcagctgctccgtcatgcacgaaggcctacacaaccactacacccaaaagagcttgtcactcagccccggcaaa

SEQ ID NO: 58832 - RNA, 1440 nt, synthetic construct
  misc_feature 1..1440: note = derived and/or modified sequence opt11 from anti-influenza_Chain
  source 1..1440: mol_type = other RNA
atgcccagcgtcaaaataggcataatcggggcaggatcagcagtcttctcgctacgactcgtgagcgacctatgcaaaacccccggactatccggctccaccgtaacactaatggacatagacgaagaaagactagacgcgatcctcacaatagcaaagaaatacgtagaagaagtcggagccgacctaaaattcgagaaaacgatgaacctcgacgacgtcatcatcgacgccgacttcgtaataaacacggccatggtcggcggccacacctacctcgaaaaagtacgacaaatcggagaaaaatacggatactaccgcgggatcgacgcacaagagttcaacatggtcagcgactactacaccttctcgaactacaaccaactcaaatacttcgtcgacatcgcacgaaaaatagaaaaactcagcccaaaagcatggtacctccaggccgccaaccccatcttcgaaggcaccacactggtaacacgcacagtacccataaaagccgtcgggttctgccacggccactacggagtaatggagatcgtagaaaagctcggactcgaagaagaaaaagtcgactggcaagtagccggcgtcaaccacggaatatggctgaaccgcttccgatacaacggcgggaacgcataccccctcctcgacaaatggatcgaagagaaaagcaaagactggaaaccggaaaaccccttcaacgaccaactctcaccagcggcgatcgacatgtacagattctacggcgtcatgcccataggcgacaccgtaagaaacagctcatggagataccaccgcgacctagaaaccaaaaagaaatggtacggcgaaccgtggggcggagccgacagcgaaatcggctggaaatggtaccaagacacactgggcaaagtcacagaaataacaaagaaagtcgcaaaattcatcaaagaaaaccccagcgtacgcctaagcgacctgggcagcgtcttaggcaaagacctcagcgaaaaacaattcgtcctcgaagtcgaaaagatcctcgaccccgaacgaaaatccggcgaacaacacataccattcatagacgcactcctaaacgacaacaaagcccgcttcgtggtaaacataccaaacaaaggcatcatccacggcatcgacgacgacgtagtagtggaagtcccggccttggtcgacaaaaacggcatacaccccgagaaaatcgaaccaccactaccagaccgcgtagtgaaatactaccttcgcccccgcatcatgcgcatggaaatggccctcgaagccttcctcaccggggacatccgaataatcaaagaactactctaccgagaccctagaacaaaatccgacgaacaggtcgaaaaagtgatcgaagagatcctcgcactacccgaaaacgaggagatgcgcaaacactacctaaaaaga

SEQ ID NO: 58833 - RNA, 1440 nt, synthetic construct
  misc_feature 1..1440: note = derived and/or modified sequence opt11 from anti-influenza_Chain
  source 1..1440: mol_type = other RNA
atgcctagcgtcaaaataggaatcatcggcgccggctccgcagtcttctccctacggctagtcagcgacctatgcaaaaccccaggcctgagcgggtccaccgtcaccctcatggacatagacgaggaacgcctcgacgcaatactgacaatcgcaaagaaatacgtagaagaagtgggagccgacctcaaattcgaaaagaccatgaacctcgacgacgtgatcatcgacgcagatttcgtcatcaacaccgccatggtaggaggacacacatacctcgaaaaagtgcgccaaatcggagaaaaatacggctactaccgaggcatcgacgcccaagagttcaacatggtatcagactactacacgttcagcaactacaaccaactcaaatacttcgtcgacatcgcacgcaaaatcgaaaaactcagccccaaagcctggtacctccaagccgccaatccgatattcgaaggaaccaccctagtgacccgaacagtccccataaaagccgtaggattctgccacggacactacggggtcatggaaatagtagaaaagctcgggctcgaagaagaaaaagtagactggcaagtcgccggcgtcaaccacggaatatggctaaaccgcttccgatacaacggaggaaacgcctacccactacttgacaaatggatagaagaaaagagcaaagactggaaacctgaaaatcccttcaacgaccaactaagcccagcggccatcgacatgtaccgcttctacggcgtcatgccaataggcgacaccgtccgaaacagtagctggcgataccaccgcgacctagaaaccaaaaagaaatggtatggtgaaccgtggggcggagcagacagcgaaatcggatggaaatggtaccaggacaccctaggaaaagtcacagaaatcaccaagaaagtagccaaattcatcaaagaaaaccccagcgtccgactaagcgacctcggaagcgtcctcggcaaagacctcagcgaaaaacaattcgtactcgaagtcgagaaaatcctagaccccgaacgcaaatccggggaacaacacataccattcatagacgccctcctcaacgacaacaaagcccgcttcgtagtaaacatcccaaacaaaggcatcatacacggcatagacgacgacgtcgtagtcgaagtacccgcgctcgtcgacaaaaatggaatccaccccgagaaaatagaaccacccctacccgaccgcgtagtcaagtactacctaagaccccgaataatgcgcatggaaatggccctagaagccttcctcaccggagacatccgaataataaaggaactcttataccgcgacccccgcaccaagtccgacgaacaagtcgaaaaagtaatagaagaaatcctcgcgctccccgaaaacgaagaaatgcgaaaacactacctgaagcgc

SEQ ID NO: 58834 - RNA, 1443 nt, synthetic construct
  misc_feature 1..1443: note = derived and/or modified sequence opt11 from anti-influenza_Chain
  source 1..1443: mol_type = other RNA
atgaaatttccaaaagacttcatgatcggctattccagctcgcccttccaattcgaagcgggaatcccaggatccgaagaccccaattccgactggtgggtatgggtccacgacccggaaaacacagccgccggcctggtctccggcgacttccccgagaacggacccggctactggaacctaaaccaaaacgaccacgacttagccgaaaaactaggcgtcaacacaatcagagtcggagtcgagtggtcccgcatcttcccaaaacccaccttcaacgtaaaagtcccagtggaacgcgacgaaaacggatccattgtccacgtcgacgtagatgacaaagccgtcgaacgactagacgaactcgccaacaaagaagccgtcaaccactacgtagaaatgtacaaagactgggtcgagcgcgggcgaaagctaatactcaatctctaccactggcccctccccctatggctgcacaaccccataatggtccgccgaatgggacccgaccgagcaccctccggctggctgaacgaagaatcagtcgtcgagttcgccaaatacgccgcctacatagcctggaaaatgggcgaactaccagtaatgtggtcaaccatgaacgagcctaacgtagtatacgaacaaggctacatgttcgtgaaaggaggcttcccacccggatacctatcactcgaggccgccgacaaagccagacgaaacatgatacaagcccacgcgcgcgcctacgacaacattaaacgattctccaagaaaccagtaggactaatctacgcattccaatggttcgaactcctagaaggacccgcggaagtcttcgacaaattcaaatctagcaaactatactacttcaccgacatcgtgtccaaaggctcgagcataatcaacgtagaataccgccgcgatctcgccaaccggctcgactggctaggcgtgaactactattcccgtctagtctacaaaatagtcgacgacaaacccatcatcttacacggatacggcttcctctgcacacccggcggcatctccccggccgaaaatccatgctcagatttcggctgggaagtctatcccgaaggtctctacctactcctcaaagaactatacaatcgatacggcgtggacctaatcgtcaccgagaacggcgtctcagactcacgagacgcgctgcgaccagcatacctagtctcccacgtatacagcgtatggaaagcagcaaacgaaggaataccagtgaaagggtacctccactggtccctaaccgacaactacgaatgggcccaaggattccgccaaaaattcggcctagtaatggtagacttcaaaaccaagaaacgatacctccgcccatcagccctagtattcagggagatcgccacccacaacggaatacccgacgaactacaacacctaaccctcatacaa

SEQ ID NO: 58835 - RNA, 1443 nt, synthetic construct
  misc_feature 1..1443: note = derived and/or modified sequence opt11 from anti-influenza_Chain
  source 1..1443: mol_type = other RNA
atgaaattccccaaagacttcatgatcggatactcatcctcaccctttcaattcgaagccggcatacccggaagcgaagacccaaactcagactggtgggtatgggtccacgacccagaaaacacggccgccggccttgtctccggcgacttccccgaaaacggcccaggctactggaacctcaaccaaaacgaccacgacctagccgagaaactcggcgtcaacacaatcagagtcggagtcgaatggtcccgaattttccccaaacccaccttcaacgtaaaagtccccgtagaacgcgacgaaaacggcagcatcgtacacgtcgacgtcgacgacaaagccgtggaaaggctcgacgaattagccaacaaagaagccgtcaaccactacgtcgaaatgtacaaagactgggtcgagcgaggacgaaaactcatactcaatctctaccactggcccctacccctatggctacacaacccaataatggtacgccgcatgggccccgaccgagcgccctcgggctggctcaacgaggaatcagtagtcgagttcgccaaatacgccgcctacatagcctggaaaatgggagaactaccggtcatgtggagcaccatgaacgagcccaacgtcgtatacgaacaaggatacatgttcgtcaaaggcggcttcccacccggatacctttccttagaagccgcagacaaagcccgacgcaacatgatccaagcacacgctcgagcctacgacaacattaaaagattctcaaagaaacccgtaggcctaatctacgccttccaatggttcgaactcctagaaggacccgcagaagtattcgacaaattcaaatcgtccaaactctactacttcacagatatcgtctcaaagggctcgagcatcatcaatgtcgaataccgtcgagatttagcaaaccgcctcgactggctcggtgtcaactactactcacgcctagtctacaaaatcgtagacgacaagcccatcatactccacggctacggattcctctgcacgccaggcggcataagccccgccgaaaacccctgttccgacttcggatgggaagtatacccagaaggcctgtacctcctcctaaaagaactatacaaccgatacggcgtagacctcatcgtcaccgaaaacggagtctccgactcacgcgacgccctgcgcccagcctacctagtctcacacgtctactccgtctggaaagccgccaacgaaggcatcccagtcaaaggctacctgcactggagcctcaccgacaattacgaatgggcccaaggcttccgccagaaattcggactcgtcatggtcgacttcaagacgaagaaacgatacctacgcccaagcgcactcgtgttccgagagatagccacccacaacggcatacccgacgagctacaacacctcaccctaattcag

SEQ ID NO: 58836 - RNA, 1464 nt, synthetic construct
  misc_feature 1..1464: note = derived and/or modified sequence opt11 from anti-influenza_Chain
  source 1..1464: mol_type = other RNA
cacgcccaagacatcctcgagaaaacccacaacggcaaactctgcgacctcgacggcgtcaaaccactcatcctacgcgactgctccgtcgcaggatggctcctcggaaaccctatgtgtgacgagttcatcaacgtacctgaatggagctacatcgttgaaaaagccaaccccgcaaacgacctttgctaccccggcaactttaacgactacgaagaactcaaacacctcctcagccgcatcaaccacttcgagaaaatccaaatcatccctaaatcctcatggtccgaccacgaagcatcctccggtgtatcctcagcctgtccctaccaaggcaccccctccttcttccgcaacgtcgtatggctcatcaagaaaaacaacacataccccaccatcaaacgctcctacaacaataccaatcaagaagacctcctcatactatggggcatacaccactccaacgacgccgccgaacaaacaaagctgtaccaaaaccccaccacctacatctcagtaggaacatctaccctaaaccaacgtctcgtccccaaaatagccacccgctccaaggtaaacggccaaaacggacgaatggacttcttctggaccatcctcaaacccaacgacgcaatcaacttcgaatccaacggaaatttcatcgccccagaatacgcctataaaatcgtcaagaaaggctacatccccgaagctccacgcgacggccaagcctacgtccgcaaagacggcgaatgggtcttactctccactttcctacgctccgacaaaacccatacctgcccaccctgtcctgccccggaactacttggcggcccatccgtcttcctattccctcccaaacccaaagacaccctcatgatctcacgtacccccgaagtaacctgcgtcgtcgtcgacgtctcacacgaagaccccgaagtcaaattcaactggtatgtcgacggagtcgaagtccacaacgccaaaaccaaaccccgagaagaacaatacaactccacctacagggtcgtctccgtcctcaccgtcctacaccaagactggctaaacggcaaagaatacaaatgcaaagtatcaaacaaagctctgcccgcccccatcgagaaaaccatatccaaagccaaaggccaaccccgcgaaccccaggtctacacactcccaccctcccgcgaagaaatgaccaaaaaccaagtatccctcacgtgcctcgtaaaaggcttctaccccagcgacatcgcggtcgaatgggaaagcaacggtcaacccgaaaacaactacaaaaccaccccgcccgtcctcgactctgacggctccttctttctatactccaaactaacagtcgataaatcccgttggcaacaaggcaacgtgttctcatgctccgtcatgcacgaagccctccacaaccactacacccagaaatcactcagcctttcccccggaaaa

SEQ ID NO: 58837 - RNA, 1464 nt, synthetic construct
  misc_feature 1..1464: note = derived and/or modified sequence opt11 from anti-influenza_Chain
  source 1..1464: mol_type = other RNA
cacgcccaagacattctcgaaaagacacacaacggcaaactctgcgatctcgacggcgtcaaacccctaattctccgcgactgctccgtagccggatggctcctaggcaaccccatgtgcgacgagttcatcaacgtccccgaatggagctacatagtagaaaaagccaaccctgctaacgacctatgctaccccggcaacttcaacgactacgaagaactcaaacacctcctctcacgaatcaaccacttcgagaaaatacaaatcatccctaaatcgtcatggagcgaccacgaagccagctcaggcgtttcctccgcctgcccctaccaaggcacccccagctttttccgcaacgttgtttggctcatcaagaaaaacaacacctaccctacaatcaaacgatcatacaacaataccaaccaagaagaccttctaatactatggggcatacaccactccaacgacgcagcagaacaaacaaaactctaccaaaaccccacgacctacatctccgtcggcaccagcacactcaaccaacgcctcgtccccaaaatcgccacccgcagcaaagtcaacggccaaaacggccgcatggacttcttctggacaatcctcaaacccaacgacgccataaacttcgaatccaacggcaacttcatcgccccagaatacgcctacaaaatcgtaaagaaaggctacattccagaagcacctagagacggacaggcttacgtcagaaaagatggcgaatgggtcctcctctccaccttcctccgatccgacaaaactcatacctgcccaccctgcccagcccccgaacttctcggcggcccctccgtcttcctcttcccaccaaaacccaaagacacactcatgatatcccgcacccccgaagtaacctgcgtagtcgtagacgtctcacacgaagaccccgaggtgaaattcaactggtacgtcgacggtgtcgaagtccacaacgccaaaacaaaaccccgcgaagaacaatacaacagcacataccgcgtcgtttccgtcctcacagtactccaccaagactggctcaacggcaaagagtacaaatgcaaagtctccaacaaagccctacccgcccctatcgagaaaacaatatctaaagccaaaggccaacccagagaaccccaagtctacacactcccaccctcccgcgaagaaatgaccaaaaaccaagtatccctaacctgcctcgtcaaaggattctacccctcagacatcgcagtagaatgggaaagcaacggacaacccgaaaacaactacaaaacaacacccccagtcctagactccgacggctccttcttcctatacagcaaactcaccgtcgataaatcaagatggcaacaaggcaacgtattctcctgctccgtgatgcatgaagccctccataaccactacacccagaaatcactctccctcagccccggcaaa

SEQ ID NO: 58838 - RNA, 1473 nt, synthetic construct
  misc_feature 1..1473: note = derived and/or modified sequence opt11 from anti-influenza_Chain
  source 1..1473: mol_type = other RNA
atgctctcattccctaaaggcttcaagttcggctggtcacaatcgggattccaatccgagatgggcaccccagggagcgaagaccccaactccgactggcatgtctgggtgcatgaccgcgaaaacatcgtaagccaagtcgtctcaggcgacctccccgagaacggacccggctactggggcaactacaagcgattccacgacgaagccgaaaagataggactcaacgcagtccgaataaacgtagaatggagccgcatcttcccacgccccctccccaaaccagaaatgcaaacgggcaccgacaaagaaaacagcccagtgatatctgtggacctcaacgaatccaaactccgtgaaatggataactacgcaaaccacgaagcactctcccactacagacaaatcctagaagacctgagaaaccgaggcttccacatcgtccttaacatgtaccactggaccctcccgatctggctccacgacccaatccgagtccggcgcggcgacttcaccggacccaccggctggctcaactccagaaccgtatacgagttcgcgcgattctctgcatacgtcgcctggaaactcgacgacctcgcgtccgaatacgccaccatgaacgaacccaacgtcgtctggggcgccggctatgccttcccccgtgccggattcccacccaactacctatccttcagactctccgagatagcaaaatggaatatcatacaagcccacgcccgcgcatacgacgccatcaaatccgtctccaagaaatccgtcggcataatctacgccaacacctcctactaccccctacgcccccaagacaacgaagcagtcgaaatcgccgaacgcctcaaccgctggtcattcttcgactcaatcatcaaaggcgaaatcacatccgaaggccaaaacgtccgggaagacctccgcaaccgactagactggatcggcgtcaactactacacccgaaccgtcgtcaccaaagccgaatccggctacctaacactacccggctacggcgacagatgcgaaagaaacagcctgtccctcgctaacctcccgacatccgacttcggctgggagttcttcccagaaggactctacgacgtgctcctgaaatactggaacagatacggactacccctgtacgtaatggaaaacggcatcgccgacgacgccgactaccagcgcccatactacctcgtaagccacatataccaagtccaccgcgcactcaacgaaggagtcgacgtccgcggttacctacattggagcctcgccgacaactacgaatggagctcaggcttctccatgcgcttcggcctactcaaagtagactacctaactaaaagactctactggcgcccctccgcgctagtctacagagaaatcacacgctccaacggcatccccgaagaactagaacacctcaaccgcgtacccccaataaaacccctccgccac

SEQ ID NO: 58839 - RNA, 1473 nt, synthetic construct
  misc_feature 1..1473: note = derived and/or modified sequence opt11 from anti-influenza_Chain
  source 1..1473: mol_type = other RNA
atgctctccttccccaaaggcttcaaattcggctggtcccaatccggcttccaatccgaaatgggaacacccggaagcgaagaccccaactccgactggcacgtctgggtccacgaccgagaaaacatcgtctcccaagttgtctcaggagacctccccgaaaacggtcccggctactggggcaactacaaaagattccatgacgaagccgagaaaatcggcctaaatgcagtccgcatcaacgtagaatggtcacgcatcttcccccgccccctccccaaacccgaaatgcaaaccggtaccgacaaggaaaacagccccgtaatatccgtcgacctaaacgaatccaaactaagagaaatggacaactacgcaaaccatgaagcactctcccactaccgtcaaatcctcgaagacctacgcaaccgaggcttccacatcgtccttaacatgtaccactggacacttcccatctggctccacgaccccatacgagtccgacgaggcgacttcaccggccccacaggctggctaaactccagaacagtctacgaatttgcccgcttctccgcctacgtcgcctggaaactcgacgacctagcctcagaatacgccaccatgaacgaacccaacgtagtttggggcgccggctacgccttccctcgggccggcttcccacccaactacctctccttccgcctctccgagatcgccaaatggaacatcatacaagctcacgcccgagcatacgacgccataaaatcagtctcaaagaaatccgtcggaataatctacgcaaacacctcatactaccccctccgcccccaagacaacgaagccgtcgaaatcgccgaacgtctaaaccgatggagcttctttgactcgataataaaaggcgaaataacatcagaaggccaaaacgtccgcgaagacctccgtaaccgactagactggattggcgtcaactactacacccgcaccgtcgtcaccaaagcggaaagcggctacctcaccctccccggctacggcgaccgctgcgaaagaaactccctctcactcgccaacctgccaacctccgacttcggctgggagttcttcccagaaggcctatacgacgttctactcaaatactggaaccgctacggcctacctctgtacgttatggaaaacggcatcgcagacgacgcagactaccaacgcccctattacctcgtctcccacatctaccaagtccaccgagctctcaacgagggcgtcgacgtacgaggctacctccattggtccctagcagacaactacgaatggtccagcggcttctccatgcgtttcggcctcctcaaagtcgactacctcaccaaacgcttatactggcgaccatccgcactcgtctacagggagatcactagatccaacggcatcccagaagaactcgaacacctgaaccgagtcccacccatcaaacccctccgccac

SEQ ID NO: 58840 - RNA, 1494 nt, synthetic construct
  misc_feature 1..1494: note = derived and/or modified sequence opt11 from anti-influenza_Chain
  source 1..1494: mol_type = other RNA
atggcctcacaaggaacaaaacgaagctacgaacagatggaaacagacggggaaagacagaacgccacagaaataagagcgtcagtaggcaaaatgataggaggaatcgggcgcttctacattcaaatgtgcacggaactgaagctaagcgactacgaaggaagactgatacaaaattccctgacaatagaaaggatggtactctcggccttcgacgaacgaagaaacaaatacctagaagaacacccaagcgcagggaaagacccaaagaaaaccgggggccccatatacagacgagtcaacggtaaatggatgagagaactaatcctctacgacaaagaagaaatcaggcgcatatggagacaagcgaacaacggcgacgacgcaaccgcaggcctgacacacatgatgatctggcactcaaacctaaacgacgccacgtaccaacgaacacgagccctagtgcggacgggaatggacccacgaatgtgctcgctaatgcaagggagcacgctcccacgtagaagcggggcagcaggagcagcagtcaagggggtaggaaccatggtcatggaactggtccggatgataaaaagaggcatcaacgaccgcaacttctggcgaggagaaaacggcaggaaaacgcgcatagcctacgagaggatgtgcaacatactaaaaggcaagttccagaccgcagcccagaaagcaatgatggaccaagtcagagaaagccgagaccccgggaacgcggagttcgaagacctaaccttcctcgccagaagcgcattgatactaagggggtcagtggcccacaaaagctgcctaccagcatgcgtatacggcccagcagtagccagcggctacgacttcgaacgtgaagggtacagcctagtgggcatagacccattccggctactacaaaacagccaagtctacagcttaatccgacccaacgaaaacccagcacacaaaagtcaacttgtatggatggcatgccacagcgcagcattcgaagacctccgagtcctctccttcataaaaggaacaaaggtagtaccgcggggcaaactgtccacaagaggagtacaaatcgcatcaaacgaaaatatggaaacaatggaaagttcaaccctagaactacgaagccgctactgggccatcaggacacggagcggaggcaacacaaaccaacaacgcgcaagcgccggccagatatcaatacaaccaaccttcagcgtccagagaaacctaccattcgaccgaacaacagtgatggcggcgttcaccggaaacacggaagggcggacgagcgacatgagaaccgaaataatccgcatgatggaaagcgcccgaccggaagacgtatcattccagggcagaggcgtatttgaactaagcgacgagaaagcggccagccccatagtcccgagcttcgacatgagcaacgaaggaagctacttcttcggcgacaacgcggaggaatacgacaac

SEQ ID NO: 58841 - RNA, 1494 nt, synthetic construct
  misc_feature 1..1494: note = derived and/or modified sequence opt11 from anti-influenza_Chain
  source 1..1494: mol_type = other RNA
atggcctcacaaggaacaaagcgatcatacgagcaaatggaaacagacggagaaagacaaaacgcaacggaaatccgcgccagcgtaggcaaaatgatagacggaatcggacgcttctacattcaaatgtgcacggaactcaaactaagcgactacgaaggcaggctcatacaaaacagtctgacaatagaaagaatggtgctctcggccttcgacgagagacgaaacaagtacctagaagaacacccaagcgcgggcaaagacccgaagaaaacaggaggcccaatatacaaaagggtggatggaaaatggatgcgcgagctagtgctatacgacaaggaagagatcagacgaatatggcgccaagcgaacaacggagacgacgcgaccgcaggactgacacacatgatgatctggcactcaaacctgaacgacacaacgtaccaacggacccgagccctagtgagaacgggaatggacccgcgaatgtgcagcctcatgcaagggagcacactcccgcgaagaagtggcgcagcaggggcagccgtgaaaggagtgggaacaatggtcatggaactcataagaatgataaaaaggggaatcaacgatagaaacttctggcgcggagaaaacggaagaaaaacgaggtcagcctacgaaaggatgtgcaacatactcaagggcaaattccagaccgcagcccaacgagcgatgatggaccaggtcagagaatcgcgcaacccaggaaacgcggaaatagaagacctcatatttctcgccaggagtgcactcatactcagaggctcagtagcgcacaagagctgcctaccggcatgcgtatatggcccagccatcgcatcgggatacaacttcgaaaaagaagggtactcactcgtgggaatagacccattcaagctactgcagaacagccaggtatacagcctaatcaggccaaacgaaaacccagcgcacaagagccaactcgtgtggatggcctgcaactcagcagcattcgaggacctacgagtgcttagcttcataagaggaaccaaggtcagccccaggggcaaactcagcacaaggggagtacaaatagcgagcaacgagaacatggacacgatggagagtagcaccctggaactgagaagccgatactgggcaataaggacaagaagcgggggcaacaccaaccaacaaagagccagcgcgggacaaatatcagtacagccggcgttcagcgtccagcgaaacctaccgttcgacaaaccgaccataatggcggcattcaccggaaacacagaagggcggaccagcgacatgagggccgagataatacgaatgatggaaggagcgaaaccggaagaaatgtccttccaaggaaggggagtcttcgagctctcagacgaaaaagcaacaaaccccatagtcccgagcttcgacatgagcaatgaagggagttacttcttcggcgacaacgcagaagaatatgacaac

SEQ ID NO: 58842 - RNA, 1494 nt, synthetic construct
  misc_feature 1..1494: note = derived and/or modified sequence opt11 from anti-influenza_Chain
  source 1..1494: mol_type = other RNA
atggcaagccaaggaaccaagaggagctacgaacagatggagacgggcggcgagcgacaaaacgccaccgaaataagggcaagcgtaggacgcatggtcggaggaataggacgattctacgtacagatgtgcacagaactcaaactctcagaccaagaaggaagactaatccaaaacagcataaccatagaacgcatggtactaagcgcattcgacgaaaggcgcaaccgctaccttgaagaacacccaagcgcaggaaaagacccaaagaaaaccggaggaccaatataccggagacgagacggcaaatgggtaagggaactaatactatacgacaaagaagaaatacgacgcatatggagacaggcaaacaacggagaagacgcaaccgcaggactgacacacatgatgatctggcatagcaacctaaacgacgcaacgtaccaaagaacccgagccctagtcagaacagggatggaccccagaatgtgcagcctcatgcaaggatcaaccctaccaagacgatcaggcgcagcgggcgcagccatcaaaggggtaggcaccatggtaatggaactaatcaggatgatcaaaagaggaatcaacgacagaaacttctggcgcggagacaacggacggcgaaccagaatcgcctacgaaagaatgtgcaacatactgaaaggaaaattccagaccgcagcgcaacgagcaatgatggaccaagtccgggaaagtagaaacccgggaaacgcggaaatagaagacctgatctttctagccaggagcgcactaatactacgcggctccgtggcacacaaaagctgcctcccagcctgcgtctacggactcgcagtagcaagcggctacgacttcgaacgcgaaggctacagcctggtaggaatagacccattccgactactccaaaacagccaagtattctcactcatacgcccaaacgaaaacccagcacacaaaagccaacttgtctggatggcatgccacagcgcagccttcgaagacctaagagtaagctccttcataagaggaacacgggtaatcccacgcggacaactaagcacacgaggcgtacaaatagcatcaaacgagaacgtcgaagcaatggacagcagcaccctcgaactcagaagccgatactgggccataaggacaaggagcggagggaacacaaaccagcaacgcgcaagcgcaggacaaatcagcgtccaaccaacattcagcgtacaacgaaacctacccttcgaacgaccaaccataatggccgccttcaaaggaaacaccgaaggcagaaccagcgacatgcgaacagaaatcataaggatgatggaatcagcaagaccagaagacgtgagcttccaaggccgcggagtattcgaactcagcgacgaaaaggcaaccaaccccatagtacccagcttcgacatgtccaacgagggaagctacttcttcggagacaacgcagaagaatacgacaac

SEQ ID NO: 58843 - RNA, 1494 nt, synthetic construct
  misc_feature 1..1494: note = derived and/or modified sequence opt11 from anti-influenza_Chain
  source 1..1494: mol_type = other RNA
atggcctcacagggaaccaagcgatcgtacgaacaaatggaaacagacggggaaagacaaaacgccacggaaatcagagcaagtgtaggaaaaatgataggcggaatcgggagattttacatacaaatgtgtacggaactgaaactaagcgattatgagggcagacttatacaaaacagcctaacgatcgaacgaatggtgctatcggcattcgacgaacgcagaaacaagtacctggaagaacacccgagcgcgggcaaagacccgaagaaaacaggaggaccaatataccgcagagtcaacggaaaatggatgagagaactcatactctacgacaaggaagagatcagacgtatatggagacaagccaacaatggcgacgacgcgaccgccggactcacacacatgatgatctggcactcaaacctaaacgacgcaacataccagcgaacgcgggcgctcgtaagaacgggaatggacccacgaatgtgcagcctcatgcaagggagcacactcccacgtaggagcggggccgcaggcgcggctgtgaaaggggtcgggaccatggtcatggaactggtcaggatgataaagagaggcattaacgaccgaaacttctggagaggagaaaacggcaggaaaacacgcatagcctacgaacggatgtgtaacatactcaagggcaagttccagacagcagcccagaaagcgatgatggaccaggtccgagaatcgcgtgacccagggaacgcagagttcgaggacctcacatttctggccagaagcgcgttaatactcaggggctcagtcgcgcacaagagctgcctaccggcctgcgtctacggcccggcagtggcctcgggctacgacttcgaaagggaagggtactcgctcgtggggatagacccgttcagactactacaaaacagccaagtatacagcttgataaggccaaacgaaaaccccgcgcacaaaagtcagctagtatggatggcctgccactcagccgcattcgaagacctacgcgtgctatcgttcataaaaggaaccaaggtcgtgcccagaggaaagctatcgacaaggggtgtacaaatagcctcaaacgagaacatggaaacgatggagagctcaaccttggaactacgatcacgctactgggccataaggacaagaagtgggggcaacaccaaccaacaacgcgcgagtgcgggccaaatatcgatccaaccaacgttctcggtccagcgcaacctaccgttcgaccgcacgaccgtaatggcagcgttcaccggaaacacagaagggcgcacaagcgacatgcgaaccgagatcataagaatgatggagagtgcgcgcccagaagacgtatccttccagggcagaggagtattcgagctatcagacgagaaagcagcctcgccaatagtaccgagcttcgacatgagcaacgaagggagctacttcttcggcgacaacgcggaagagtacgacaac

SEQ ID NO: 58844 - RNA, 1494 nt, synthetic construct
  misc_feature 1..1494: note = derived and/or modified sequence opt11 from anti-influenza_Chain
  source 1..1494: mol_type = other RNA
atggcctcccaaggaaccaagcgaagctacgaacagatggagacagacggagaaaggcaaaacgcgacggaaataagagcgagcgtgggaaagatgatagacgggatcgggcgattctacatacaaatgtgcacagaactaaaactaagcgattacgagggccgactgatccaaaacagcctgacaatagaacggatggtgctatcagcattcgacgaacgcagaaacaagtacctagaagaacacccaagcgctggaaaagatccgaagaagacaggcggcccaatatacaagcgggtagacggcaagtggatgagagaattagtgctatacgacaaagaagagataaggaggatctggcggcaagcgaacaacggagacgacgcaacagcaggcctgacacacatgatgatatggcacagcaacctaaacgacaccacgtaccagagaacgcgggctctagtacggacaggaatggacccacgaatgtgcagcctcatgcaaggcagcacgttaccgcgacggtcaggagcagcgggcgccgcagtcaaaggggtaggaacgatggtcatggagctgataagaatgataaaacgaggaataaacgaccggaacttctggcgaggcgaaaacggaaggaaaacacgaagcgcatacgaaagaatgtgcaacatactaaaaggaaaattccaaacagcggcccagagagcgatgatggaccaagtcagggaatcgaggaaccccggaaacgcggaaatagaagacctaatattcctggcaagaagcgcactgatactaaggggaagcgtcgcgcacaaaagttgcctcccagcatgcgtctacggaccggctatcgcatcaggatacaacttcgaaaaagaaggatactcactcgtgggaatcgacccgttcaagctactgcagaacagccaggtatacagcctaataagaccgaacgaaaacccagcacacaaaagccaactggtatggatggcctgcaactccgcggcgttcgaggacttacgcgtactcagcttcataagagggacgaaggtaagcccaagagggaaactcagcacaaggggagtacaaatagccagcaacgagaacatggacacgatggagagctcgacactggaactgcgatcgagatactgggcgatcaggaccaggagcggaggaaacaccaatcaacaaagagcgagcgcaggccaaatcagcgtccaaccagcattcagcgtacagagaaacctcccgttcgacaaaccaacaataatggcggcattcacaggaaacacggaagggagaaccagcgacatgagggccgagatcatacgcatgatggagggcgcaaaaccggaagagatgagtttccagggaaggggcgtgttcgagctgagcgacgagaaagcaacgaacccaatcgtcccgagcttcgacatgagcaacgaaggaagctacttcttcggcgacaacgcagaagaatacgacaac

SEQ ID NO: 58845 - RNA, 1494 nt, synthetic construct
  misc_feature 1..1494: note = derived and/or modified sequence opt11 from anti-influenza_Chain
  source 1..1494: mol_type = other RNA
atggcctcgcaaggaaccaagcgctcgtacgagcaaatggaaaccggaggagaaagacaaaacgcaacggaaataagagccagtgtgggaaggatggtaggcgggataggccgcttttacgtccaaatgtgcacggaactaaaactaagtgaccaagagggccgactcatacaaaacagcataaccatagaaagaatggtgctatcggccttcgacgaacgaagaaaccgatacctggaggaacacccaagcgccggaaaggacccaaagaaaacaggcggcccgatctaccgcaggcgcgacggcaaatgggtccgagagctcatcctctacgacaaggaagaaatccgccgaatatggaggcaagcaaacaacggcgaggacgcaaccgcgggattaacccacatgatgatctggcactccaatctgaacgacgccacgtaccagcgcacgcgcgccctcgtaaggaccggcatggacccacgaatgtgcagcctaatgcaaggaagcacgctcccgcgaaggagcggagcggcaggcgcggccatcaaaggagtcggaaccatggtgatggaactaatcaggatgataaaaagaggaatcaacgacagaaacttctggagaggcgacaacggaaggcgcacacgcatagcatacgaaagaatgtgcaacatcctcaaaggcaaattccaaacggcagcccaaagagcgatgatggaccaagtaagagagtcgcgcaaccccggaaacgcagaaatagaagacctcatcttcctggcaagaagtgcgctcatactaaggggctccgtagcccataagagctgcctacccgcctgcgtatacggactagcagtagcctcaggctacgacttcgaacgggaagggtactcactcgtaggcatagacccgttccgactcctccaaaacagccaggtctttagtctaatccggcccaacgagaacccagcacacaagtcccagctagtatggatggcatgtcactcagccgcgttcgaagacctaagagtgagcagcttcatccgggggacaagggtcatccccaggggccaactctcaacaagaggcgtacaaatagcatcgaatgagaacgtggaagccatggacagctcgacattagagctgcgcagcaggtactgggcaataaggaccaggagcggaggcaacacaaaccaacaacgagcgagcgcaggccagatctcggtacagcccacattctcggtacagcgcaatctaccattcgagcgcccaacaataatggcagccttcaaagggaacacggaagggagaacaagcgacatgagaaccgagataatccggatgatggaaagcgcacgacccgaagacgtatcgttccaggggagaggcgtcttcgaactaagtgacgagaaagcaacaaacccaatagtcccgagcttcgacatgagtaacgaagggagctacttcttcggcgacaacgcggaagaatacgacaac

SEQ ID NO: 58846 - RNA, 1530 nt, synthetic construct
  misc_feature 1..1530: note = derived and/or modified sequence opt11 from anti-influenza_Chain
  source 1..1530: mol_type = other RNA
atgttccccgaaaaattcctctggggagtcgcacaatccgggttccaattcgaaatgggggacaaactccgtcgaaacatcgacacaaacacagactggtggcactgggtacgcgacaaaaccaacatagagaaaggactggtatccggcgacctcccagaagagggaataaacaactacgaactgtacgaaaaagaccacgaaatcgcccgcaaactaggcctaaacgcctacagaatcggcatagagtggtcacgaatcttcccctggcccaccacattcatagacgtcgactactcctacaacgaatcctacaacctaatcgaagacgtcaaaatcactaaagacaccctcgaagaactagacgaaatagcaaacaaaagagaagtcgcatactaccgcagcgtaataaacagcctcaggtcaaaaggcttcaaggtaatcgtcaacctgaatcacttcacactcccctactggctacacgacccaatagaagccagagaacgagcactcaccaacaagcgcaacggctgggtaaacccccgcacagtcatcgagttcgccaagtacgcggcctacatcgcctacaaattcggcgacatagtcgacatgtggagcacattcaacgaaccgatggtagtcgtcgaactcggatatctcgccccatactccggttttccacccggagtcctcaaccccgaagcagccaagttagccatactccacatgatcaacgcccacgctttagcctaccgacaaatcaagaaattcgacaccgaaaaagccgacaaagattcaaaagaacccgccgaagtcggcatcatctacaacaacataggagtcgcataccccaaagaccccaacgacagcaaagacgtcaaagccgccgaaaacgacaacttcttccactccggcctcttcttcgaagctatccacaagggtaaactcaacatcgagttcgacggcgagacattcatcgacgccccatacctcaaaggaaacgactggataggcgtcaactactacacaagagaagtcgtcacctaccaagaacccatgttccccagcataccactcatcaccttcaaaggcgtccagggctacggctacgcttgtcgccctggaaccctgtccaaagacgatcgaccagtatccgacatcggctgggagctctaccccgaaggaatgtacgactcaatcgtcgaagcacacaaatacggagtccccgtatacgtaaccgaaaacggcatcgccgactccaaagacatcctacgcccctactacatcgccagccacatcaaaatgacagaaaaggccttcgaggacggctacgaagtaaaggggtacttccactgggcactcaccgacaacttcgaatgggccctcggcttccgcatgagattcggcctctacgaagtcaacctcatcaccaaggaaagaatccccagagaaaaatcagtctccatattccgagaaattgtagcaaacaacggcgtcacaaagaaaatagaagaagaactactaagaggc

SEQ ID NO: 58847 - RNA, 1530 nt, synthetic construct
  misc_feature 1..1530: note = derived and/or modified sequence opt11 from anti-influenza_Chain
  source 1..1530: mol_type = other RNA
atgttcccagaaaaattcctgtggggcgtggcccaatccggttttcaattcgaaatgggagacaagctacgcagaaacatcgacacgaacaccgactggtggcactgggtacgcgacaaaaccaacatcgaaaaagggctagtctccggagacctccccgaagagggaatcaacaactacgaactctacgagaaggaccacgaaatagcacggaaactaggactcaacgcctacagaatcggcatagaatggtcccgaatattcccctggccaactaccttcatcgacgtcgactacagttacaacgagtcctacaaccttatcgaagacgtaaaaatcaccaaagacaccctcgaagaactcgacgaaatagccaacaagagagaagtagcctactaccgctctgtcatcaacagcctccgatctaaaggcttcaaagtaatcgtcaacctcaaccacttcacgctcccctactggctccacgaccccatcgaagcacgcgaacgcgctctcacgaacaaacgaaacggctgggtcaacccccgcaccgtcatcgagttcgcaaaatacgcggcatacatagcatacaaattcggcgacatagtagacatgtggtccacattcaacgaacccatggtcgtcgtagaactcggctacctcgccccctactccggattcccgcccggagtactaaaccccgaagccgcaaaactcgcgatactacacatgataaacgcccacgcactcgcctaccgacaaatcaagaaattcgacaccgaaaaagccgacaaagacagcaaagaacccgcggaagtagggataatctacaacaacatcggagtcgcgtaccccaaagacccgaacgactccaaagacgtcaaagccgccgaaaacgacaacttcttccactcaggactcttcttcgaagccatccacaaaggtaaactgaacatcgagttcgacggcgaaaccttcatagacgccccctacctgaaaggaaacgactggatcggagttaactactatacccgcgaagtcgtcacataccaagaacccatgttccccagcatccccctaatcacgttcaaaggcgtccaagggtacggatacgcctgccgcccaggcacactctccaaagacgaccgccccgtcagcgacatcggatgggaactataccccgaaggaatgtacgacagcatcgtcgaagcccacaaatacggcgtccccgtatacgtaacggaaaacggcatcgcagacagcaaagacatcctaaggccctactacatcgcctcccacataaaaatgacggaaaaggccttcgaagacggctacgaggtaaaaggctacttccactgggccctaacagacaacttcgaatgggccctaggattccgcatgcgcttcggactctacgaagtcaacctaatcacaaaggaacgaataccaagagagaaaagcgtcagcatcttcagggaaatagtcgcaaacaacggcgtcaccaaaaagatcgaagaggagctacttagaggt

SEQ ID NO: 58848 - RNA, 1536 nt, synthetic construct
  misc_feature 1..1536: note = derived and/or modified sequence opt11 from anti-influenza_Chain
  source 1..1536: mol_type = other RNA
atgaaacgaaaagtcaagaaaatggccgccatggcaacctccatcatcatggccatcatgatcatcctacatagcatcccagtcctcgcagggagaatcatatacgacaacgaaaccggaacccacggcggatacgattacgaactctggaaagactacggcaacacaatcatggaactaaacgacggaggcaccttcagctgccaatggtccaacatcggaaatgcactgttccgaaaaggccgcaaattcaactccgataaaacataccaagagctcggcgacattgtagtagaatacggctgcgactacaacccaaacggcaactcgtacctatgcgtctacggctggacacgcaaccccttggtagaatactatatcgtagagagctggggcagctggcgcccaccaggcgccacacccaaaggcacaatcacccaatggatggccggcacgtatgaaatatacgaaacaacacgcgtcaaccaaccatccatcgacggcaccgcaacatttcaacaatactggagcgtacgaacaagcaaaagaacgagcggcaccatatcagtaaccgaacactttaaacaatgggaacgcatgggcatgcgaatgggcaagatgtacgaagtagccctcaccgtagaaggatatcaaagctcaggctacgcaaatgtttacaaaaacgaaatacgcataggagcaaacccaaccccagcccccagccagagcccaatccggcgcgacgccttcagcatcattgaagccgaggaatacaactcgaccaacagctcgaccctccaagtcataggcaccccaaacaacggccgcggcatcggctacatcgagaatggaaacacagtaacttactccaacatagatttcggatccggagccaccggcttctccgccacagtagccacagaagtaaacacctcaatccaaataagatcagacagccccaccggaaccctactcggcacactatacgtcagctcaaccgggagctggaacacataccaaacagtaagcacaaacatcagcaagatcacaggcgtacacgacatagtcctagtattctcgggcccagtaaacgtcgataacttcatcttcagccgctcctcgcccgtaccggcaccaggcgacaacacgcgtgacgcctactccataatacaagccgaagactacgacagctcgtacggcccaaacctccaaatcttcagcctacccggcggcggctccgcgatcggatacattgaaaacggctacagcacaacttacaaaaacatagacttcggagacggcgccaccagcgtcacagcacgcgtcgccacacaaaacgcaacaacaatacaagtccgcctgggcagcccatcaggcacactcctaggcaccatctacgtcggaagcacgggctcgttcgacacctacagagacgtctcggccaccatctccaacaccgccggcgtcaaagacatcgtcctcgtattcagcggaccggtcaacgtggactggttcgtcttctcaaagtcaggcaca

SEQ ID NO: 58849 - RNA, 1536 nt, synthetic construct
  misc_feature 1..1536: note = derived and/or modified sequence opt11 from anti-influenza_Chain
  source 1..1536: mol_type = other RNA
atgaaacgtaaggtcaagaaaatggccgcgatggcaacctccataataatggccatcatgatcatcctccacagcatccccgtcctcgcaggccgcataatatacgacaacgagaccggcacccacggcggatacgactacgaactatggaaagactacggcaacacaataatggagctcaacgacggcggcaccttcagctgccagtggagcaacatcggaaacgccctcttccgaaaaggcaggaaattcaactccgacaaaacctaccaagaactaggagacatagtcgtggaatacggatgcgactacaaccccaacggaaactcctacctatgcgtatacggatggacacgcaaccccctggtcgaatactacatcgtcgaatcatggggcagctggcgcccacccggagcgacacccaaaggcaccatcacacaatggatggcgggcacgtacgagatctacgaaacgaccagagtcaaccaaccctcaatcgacggcaccgctaccttccaacaatactggtccgtgcgcaccagtaaacggacatcaggaaccataagcgtcaccgagcacttcaaacaatgggaacgcatgggcatgcgcatgggcaagatgtacgaagtagccctgaccgtcgaaggataccagtcatcaggctacgccaacgtctacaaaaacgaaatccgcatcggcgccaacccaaccccagctccctcccagagcccaatccgccgcgacgcctttagcataatagaagccgaagaatacaactcaaccaactcctcaaccctccaagtcatcggaacacccaacaacggccgtggcatcggttacatcgaaaacggaaacacagttacgtactctaacatagacttcggctcaggcgcaacgggattctcagccaccgtcgccaccgaagtcaacacctcgatacaaataagaagcgacagcccaaccggaactctactaggcaccctatacgtgagctcaacaggcagctggaacacctaccaaaccgtaagcacaaacataagcaagataacaggcgtgcacgacatagtccttgtgttctcaggacccgtcaacgtcgacaactttatcttcagccggagctcacccgtaccagcccccggagacaatacacgcgacgcatactctatcatacaagccgaagactacgactcatcatacggaccaaacctccaaatcttctccctacctggaggcggcagcgcaatcggatacatcgaaaacggctatagcacgacctacaaaaatatcgacttcggggacggagcaacctccgtcaccgcccgcgtagccacccaaaacgccacgaccatccaagttcgactaggctcacccagcggcaccctactcggaaccatctacgtcggcagcacgggctcgttcgacacctaccgcgacgtctcagccaccatctcgaacacggccggagtcaaagacattgttctcgtattctcaggacccgtaaacgtggactggttcgtgttctccaaatccggaacc

SEQ ID NO: 58850 - RNA, 1539 nt, synthetic construct
  misc_feature 1..1539: note = derived and/or modified sequence opt11 from anti-influenza_Chain
  source 1..1539: mol_type = other RNA
atctgcataggctaccacgccaacaactcaaccgaacaagtagacaccatcatggagaaaaacgtcaccgtgactcacgctcaagacatacttgagaagacccacaacggaaaactatgcgacctagacggagtcaaaccactcatactgagagactgctccgtagccggctggctgctgggcaaccccatgtgcgacgagttcatcaacgtcccagaatggagctacatcgtcgaaaaagccaaccccgccaacgacctgtgctaccccgggaacttcaacgactatgaagaactcaaacacctcctctcccgaatcaaccacttcgagaaaatacagatcatccccaaatcatcctggtctgaccacgaagcaagctccggcgtatcctccgcatgcccctaccaaggcaccccatccttcttcaggaacgtagtctggctcatcaagaaaaacaacacataccccactatcaaaagatcctacaacaacacaaaccaagaagacctactaatcctctggggaatccaccactccaacgacgcagccgaacaaaccaaactataccaaaaccccaccacctacataagcgtcggaacctccaccctcaaccaacgcctagtcccaaaaatcgccaccagatcaaaagtaaacggacaaaatggacgaatggacttcttctggacaatcctcaaacctaacgacgccatcaacttcgaaagcaacggaaacttcatagccccagaatacgcctacaaaatagtcaagaaaggatacatcccagaggcccccagagacggacaggcctacgtccgaaaagatggagaatgggtcctcctctcaacattcctaagatccgacaaaacccatacctgcccaccctgcccggcccccgaactcctaggaggaccctccgtcttcctcttcccacccaaacccaaagacaccctcatgatcagccgcacccccgaagtaacctgcgtagtcgtcgacgtgtcccacgaagaccccgaagtcaaattcaactggtacgtagacggcgtcgaagtccacaacgcaaaaactaaaccccgcgaagaacaatacaactctacctaccgcgtcgtctccgtcctcaccgtcctccaccaagattggctcaacggcaaagaatacaaatgcaaagtctctaacaaagccctgcccgcaccaatcgaaaagaccatctcgaaagccaaaggccaacctcgcgaaccacaagtctacacactcccaccctcgcgagaagaaatgaccaaaaatcaagtgtcactaacctgcctcgtcaaaggattctacccatcagacatcgcagtcgaatgggaatccaacggccaacccgaaaacaactacaagaccactccacccgtcctagactcagacggatccttcttcctctactccaaactcaccgtagacaaatcccgctggcaacaaggcaacgtcttctcatgctcagttatgcacgaagccctacacaaccactacacccaaaaatccctaagcctcagccccggcaaa

SEQ ID NO: 58851 - RNA, 1539 nt, synthetic construct
  misc_feature 1..1539: note = derived and/or modified sequence opt11 from anti-influenza_Chain
  source 1..1539: mol_type = other RNA
atctgcatcggttaccacgccaacaactcaaccgaacaagtcgacaccatcatggaaaagaacgtaacagtaacccacgcacaagacatcctcgaaaagacacacaacggcaaactatgcgacctcgacggcgtcaaacccctaatcctccgcgactgctcagtcgccggctggctgctcggcaaccccatgtgcgacgagttcatcaacgtccccgaatggtcctacatcgtcgagaaagcaaaccccgcgaacgacctatgctaccccggcaacttcaacgactacgaagaactaaaacacctactgtcacgcatcaaccacttcgagaaaatccaaatcatcccaaaatcgtcctggagcgaccacgaagcctcctcaggcgtaagctccgcctgcccataccaaggaaccccctccttcttccggaacgtcgtatggctcatcaagaaaaacaacacctatcccactatcaaacgcagctacaacaacaccaaccaagaagatctcttaattctctggggcatccaccactcaaacgacgcagcagaacaaacaaaactgtaccaaaaccccacgacctacataagcgttggcacctctacccttaaccagcgcctagtccccaaaatcgcaacacgctccaaagtcaacggccaaaacggacgcatggacttcttctggaccatcctcaaacctaacgacgccattaacttcgaatccaatggcaacttcatcgcccccgaatacgcctacaaaatagtaaagaaaggctacatccccgaagcaccccgcgacggccaggcatacgtccgcaaagacggcgaatgggtcctcctctccactttcctccgatcagacaaaacccacacatgcccaccctgccccgcccccgaactactaggcggccccagcgtattcctcttcccacccaaacccaaagacaccctaatgatcagccgaacacccgaagttacctgcgtcgtagtcgacgtctcacacgaagaccccgaagtaaaattcaattggtacgtcgacggagtagaagtacacaacgccaaaaccaaaccccgagaagaacaatacaactcgacctaccgagtcgtctccgtcctaaccgtcctacaccaagactggctaaacggcaaagaatacaaatgcaaagtaagcaacaaagccctacccgcacccatagagaaaaccatcagcaaagctaaaggccaaccccgcgaacctcaagtctacaccctacccccatcccgcgaagaaatgaccaaaaaccaagtgagcctaacatgcctcgtaaaaggattctacccctccgacatcgcagtcgaatgggagtccaacggccaacccgaaaacaactacaagaccaccccacccgttctcgactcggacggctccttcttcctctactccaaactcaccgtcgacaagagccggtggcaacaaggaaacgtatttagctgctcagtaatgcacgaagcactgcacaaccactacacccagaaatccctgtcactaagccccggcaaa

SEQ ID NO: 58852 - RNA, 1593 nt, synthetic construct
  misc_feature 1..1593: note = derived and/or modified sequence opt11 from anti-influenza_Chain
  source 1..1593: mol_type = other RNA
accctatgcatcggctaccacgccaacaacagcaccgacaccgtagacacagtactcgagaaaaacgtcaccgtgacacattccgtcaacctcctcgaagacaaacacaacggcaaactctgcaaactccgcggcgtcgccccacttcacctgggaaaatgtaacatcgccggctggatactaggcaaccccgaatgcgaatccctctccaccgcctcctcctggagctatatcgtagaaaccagctcaagcgacaacggaacctgctaccccggggacttcatcgactacgaagaactacgggaacaactctccagcgtatcctccttcgagcgcttcgaaatcttcccaaaaacctcctcctggcccaaccacgactcgaacaaaggcgtcaccgcagcctgcccacacgccggagcaaagagcttctacaaaaacctaatctggctcgtaaagaaaggcaactcctaccccaaactctcaaaatcatacataaacgacaaaggcaaagaagtactcgtcctctgggggatacaccaccccagcacaagcgccgaccaacagtccctttaccagaacgccgacgcctacgtcttcgtcggaacaagccgatacagtaagaaattcaaacccgaaatcgccatccgccccaaagtccgcgatcaagagggtcgaatgaactactactggaccctagtagaacccggcgataaaatcaccttcgaagcaaccggcaacctggtagtacccaggtacgcgttcgcaatggagcgcgacgccggcagcggcatcatcatcagcgacactcccgtccacgactgcaacaccacatgccaaacaccaaaaggggccatcaacacctccctacccttccaaaacatccacccaatcaccatcggcaaatgccccaaatacgtcaaatccacaaaacttcgcctggcaaccggcctccgcaacgtccccagcatacaatcccgaggactcttcggcgcaatcgcaggcttcatcgagggcggctggactggcatggtcgacggctggtacggttaccaccaccaaaacgaacaaggcagcggctatgcagccgacctaaaatccactcaaaacgccatcgacgaaatcaccaacaaagtcaactccgtcatcgaaaagatgaacacacaattcaccgccgtcggaaaagagttcaaccacctagaaaaacgcatagaaaacctaaacaagaaaatcgatgacgggttccttgacatatggacctataacgccgaactcttggtcctactcgaaaacgaacgcacactagattaccacgactccaacgtgaaaaacctatacgaaaaagtccgctcacaactcaaaaacaacgctaaagaaatcggcaacggctgcttcgagttctaccacaaatgcgacaatacctgcatggaatcggtcaaaaacggcacctacgactatcccaaatactcagaggaggctaaactaaaccgcgaagaaattgacggcgtaaaactagagtcaacgcgcatctaccaaatcctcgcaatttacagtacagtagcctcatccctagtcctggtagtctcactgggcgca

SEQ ID NO: 58853 - RNA, 1593 nt, synthetic construct
  misc_feature 1..1593: note = derived and/or modified sequence opt11 from anti-influenza_Chain
  source 1..1593: mol_type = other RNA
accctctgcatcggctaccacgccaacaactctaccgacaccgtagacacagtgctagaaaagaacgtcaccgtcacccacagcgtaaacctcctcgaagacaaacacaacggcaaactatgcaagctaagaggggtcgcaccattacacctgggcaaatgcaacatagcaggttggatcctcggcaacccagaatgcgaatccctaagcacagcatcgtcctggagctgcatagtggaaacatcctccagcgacaacggaacctgctaccctggcgactttatcgactacgaagaactacgcgaacaactctcatcagtcagcagcttcgaacgcttcgaaatcttccccaaaacctcaagctggcccaaccacgactcaaacaaaggcgtcacagctgcatgcccccacgccggcgccaaatccttctacaaaaacctgatctggctcgtcaagaaaggcaacagctaccccaaactcagtaaaagctacataaacgacaaaggcaaagaagtcctagtactatggggcatacaccacccgagcacctcagccgaccaacagagcctctaccaaaacgcagacgcatacgtcttcgtaggcaccagccgatactcaaagaaattcaaacccgaaatcgcaatccgacccaaagtacgagaccaagaaggcagaatgaactactactggacgctcgtagaaccgggagacaaaatcaccttcgaagcaaccggaaacctagtcgtaccccggtacgcattcgccatggaacgcgacgccggctccggcatcatcatcagcgacacccccgtccacgactgcaatacgacgtgccaaactcccaaaggcgccataaacaccagcctccccttccaaaacatccacccaatcaccatcggcaagtgccccaaatacgtaaaatcaacaaaactacgcctcgccaccggcctccgcaatgtaccgtcgatacaaagccgcggcctattcggcgcaatcgctggcttcatcgaaggcggctggaccggaatggtcgacggatggtacggctaccaccaccaaaacgaacaagggtccggatacgcagccgacctcaagagcacccaaaacgccatcgacgaaatcacaaacaaagtcaacagtgtcatagagaaaatgaacacccaattcaccgccgtcggaaaagagttcaaccacctggaaaaacgtatcgaaaacctaaacaagaaaatagacgacggcttcctcgacatctggacctacaatgccgaactcctagtcctactcgaaaacgaaagaacactcgactaccacgactccaacgtaaagaacctctacgaaaaagtacgctcacaactcaaaaacaacgcaaaagaaatcggaaacggctgcttcgagttctaccacaaatgcgacaatacctgcatggaatccgttaaaaacggcacctacgactaccccaaatactcggaagaagcaaaactcaaccgcgaagaaatcgacggcgtaaaactagaatcaacgcgaatctaccaaatcctagccatctactctaccgtagcctccagcctcgtcctagtagtctcactaggcgcc

SEQ ID NO: 58854 - RNA, 1593 nt, synthetic construct
  misc_feature 1..1593: note = derived and/or modified sequence opt11 from anti-influenza_Chain
  source 1..1593: mol_type = other RNA
acactgtgcattggataccacgccaacaactcaaccgatacagtcgatacggtactcgagaaaaacgtcaccgtcacacacagcgtaaacctcctagaagacaaacacaacggaaaactatgcaaactccgaggcgtagcaccccttcacctaggcaaatgcaacatcgccggctggatcctcggcaaccccgaatgcgaatccctatccacagccagctcctggagctacatagtggaaaccagctccagcgacaacggaacctgttaccccggagacttcatagactatgaggaactaagagaacaactatcctcagtctcctcgttcgaaagattcgaaatcttcccaaacacaagctcctggcccaaccacgactccaacaaaggcgtcacagccgcctgcccacacgcaggggccaagagcttctacaaaaacctgatctggctagtcaagaaaggcaactcataccccaaactctccaaaagctacatcaacgacaaaggcaaagaagttcttgtcctatggggcatacaccaccccagcacaagcgccgaccaacaaagcctctaccaaaacgccgacgcctacgtcttcgtcggcacctcccgctacagcaaaaagtttaaaccagaaatcgcaatccgaccaaaagtccgagaccaagaaggccgaatgaactactactggacgctcgtcgaaccaggcgacaaaatcaccttcgaagccaccggcaaccttgtcgtgccccgctacgcgttcgcaatggaacgtgacgctggaagcggaataatcatctccgacaccccagtacacgactgcaacacaacctgccaaacccccaaaggcgcaatcaacacctccctcccattccagaacatccaccccatcacaataggcaaatgccccaaatacgtaaaatccaccaaactaagactcgccacaggcctacgcaacgtcccttctatccaatcccgtggactcttcggcgcaatcgccggcttcatcgaaggaggctggacaggcatggtagacggctggtacggataccaccaccaaaacgaacaaggatccggctacgccgcagacctcaaaagtacacagaacgccatcgacgaaataaccaacaaagtaaactccgtgatagagaaaatgaacacacaattcaccgcagtcggaaaagagttcaaccaccttgaaaaacgcatcgaaaatctcaacaagaaaatcgacgacggattcctcgacatctggacgtacaacgcagaactgctagtcctactcgaaaacgaacgcacactcgactaccacgactccaacgtcaaaaacctatatgaaaaagtaagaagccaactcaaaaacaacgcgaaagaaatcggcaacggctgcttcgagttctaccacaaatgtgacaatacctgcatggaatccgtcaaaaacggcacctacgactacccaaaatactcagaggaggcaaaactcaaccgcgaagaaatagacggcgtaaagctagaaagcacccgcatctaccaaatcctagcaatatactcaaccgtcgcctccagcctcgtcctagtcgtatccctaggagcc

SEQ ID NO: 58855 - RNA, 1593 nt, synthetic construct
  misc_feature 1..1593: note = derived and/or modified sequence opt11 from anti-influenza_Chain
  source 1..1593: mol_type = other RNA
accctctgcatcggctatcacgcaaacaactccaccgacaccgtcgacactgtcttagagaaaaacgtaacagtcacccactccgtaaacctcctcgaagacaaacacaacggaaaactctgcaaactacgcggagtcgcacccctacacctaggcaaatgcaacatcgccggctggatcctaggcaaccccgaatgcgaaagcctctcgacagcttccagctggagctacattgtagaaacctcctcaagcgacaacggaacatgctatcccggcgactttatagactatgaagaactccgagaacagctctcctccgtaagctccttcgaacgctttgaaatcttcccaaaaaccagcagctggccaaaccacgactcgaacaaaggagtcaccgccgcctgcccccacgccggcgccaagagcttctacaaaaatctcatatggctcgtaaagaaaggcaactcctaccctaaactatcaaaatcatacataaacgacaaaggcaaagaagtccttgtcctctggggcatccatcacccgtcaacctcagccgaccaacaatcactctatcaaaacgccgacgcctacgtattcgtaggcacctcacgatactccaagaaattcggccccgaaatagcaatccgcccaaaagtccgcgaccaggagggccgaatgaactactactggacactcgttgagcccggcgacaaaataaccttcgaagcaacaggcaacctagtcgtcccccgatacgcattcgcgatggagcgagacgccggaagcgggataatcatcagcgacacaccagtacacgactgcaacacaacctgccagaccccaaaaggcgccatcaacacttcccttcccttccaaaacatccaccccataaccatcggcaaatgcccgaaatacgtcaaatccacaaaactccgtctcgccaccggccttcgcaacgtcccaagcatacaatcccgcgggctattcggcgctatcgccggattcatcgaaggcggctggacgggcatggtagacggctggtacggatatcaccaccaaaacgagcaaggaagtggctacgccgccgacctaaaatccacccaaaacgccatagacgaaataaccaacaaagtaaactccgtcatcgagaaaatgaacacccaattcaccgccgtcggcaaagaatttaaccacctcgaaaaacgaattgaaaatctcaacaaaaagatcgacgacggattcctcgacatctggacctacaacgccgaactcctagtactactcgaaaacgaacgtacgctagactaccacgactccaacgtaaagaacctctacgaaaaagtacgctcccagctgaaaaacaacgccaaagaaatcggtaacggatgcttcgagttctaccacaagtgcgacaacacatgcatggaatcagtcaaaaacggcacttacgactaccccaagtactccgaagaagccaaactaaaccgcgaagaaatagacggcgtcaaacttgaaagcacaagaatttaccaaatactagccatctactcaaccgtcgcatcaagcctagtcctcgtcgtcagcctaggcgcc

SEQ ID NO: 58856 - RNA, 1593 nt, synthetic construct
  misc_feature 1..1593: note = derived and/or modified sequence opt11 from anti-influenza_Chain
  source 1..1593: mol_type = other RNA
accctctgcatcggctaccatgcaaacaacagcaccgacaccgtagacacagtcctagaaaagaacgtaaccgtcactcactccgtcaacctactagaagacaaacacaacggcaaactctgcaaactccgcggcgtcgcacccctccatctagggaaatgcaacatagccggctggatcctaggcaaccccgaatgcgaatccctcagcacagcctcaagctggtcctacatagtagaaacaagctcatccgacaacggaacctgctaccccggcgacttcatagactacgaagaactcagagaacagctctcaagcgtctcctccttcgaacgttttgaaatattcccaaaaacctcctcctggcccaaccacgactccaacaaaggcgtcaccgccgcctgcccccacgccggcgccaaatccttctataaaaacctcatctggctcgtaaagaaaggcaactcgtaccccaaactatcgaaatcctacatcaatgacaaaggaaaagaagttctagtactctggggtatccaccaccccagcaccagcgccgaccaacaatcgctataccaaaacgcagacgcctacgtcttcgtcgggacatcacgatacagcaagaaattcaaacccgaaatcgccatacgacctaaagtccgcgaccaagaaggacgcatgaactactactggacactcgtcgaaccaggcgacaaaatcaccttcgaagccaccggaaacctcgtcgtcccacgatacgccttcgcaatggaacgcgacgccggatccggcataatcatctcagatacccccgtacacgattgcaacacaacctgccaaaccccgaaaggagcgatcaacacatccctccccttccaaaacatacaccccatcacgataggcaagtgcccaaaatacgtaaaaagcacaaaactcagactagccacaggactccgaaacgttccgtccatccaatcacgcggcctcttcggcgcaatcgccggattcatagaaggaggctggaccggcatggtcgacggatggtacggttaccaccaccaaaacgaacaaggaagcggatacgcagccgacctaaaatcaacccaaaacgccatagacgaaataacaaacaaagtcaacagcgtcatcgagaaaatgaacacccaattcaccgcggtcggcaaagagttcaaccacctcgaaaaacgaatcgaaaacctcaacaagaaaatcgacgacggcttcctagacatctggacctacaacgcagaactcctcgtcctactcgaaaacgaacgcaccctcgattaccacgacagcaacgtcaaaaacctctacgaaaaagttcgcagccaactcaaaaacaatgccaaagaaatcggcaacgggtgcttcgagttctaccataaatgcgacaacacatgcatggaatcagttaaaaacggcacctatgactaccccaagtactccgaagaagccaaactaaaccgagaagaaatcgacggagtaaagctcgaatccacacgtatctaccagatcctcgccatctactccacagtcgcctccagcctcgtcctcgtagtcagcctaggagcc

SEQ ID NO: 58857 - RNA, 1593 nt, synthetic construct
  misc_feature 1..1593: note = derived and/or modified sequence opt11 from anti-influenza_Chain
  source 1..1593: mol_type = other RNA
accctgtgcataggctaccacgccaacaactcaaccgacaccgtagacaccgtactcgaaaagaacgtaacagtcacccactccgtaaacctcctcgaagacaagcacaacggaaaactctgcaaactacgaggggtcgcacccctacacctcggaaaatgcaacattgccggctggatcctaggcaaccccgagtgcgaatccctatccaccgcaagttcctggtcctgcatcgtagaaaccagctcctccgacaacggcacatgctacccgggagacttcatagactacgaagaactacgcgaacaactaagctccgtaagctcattcgaacgcttcgaaatcttcccgaaaaccagctcctggccgaaccacgacagcaacaaaggggtaacagccgcatgcccgcacgcgggcgccaaatccttctacaaaaacctcatctggctcgtcaagaaaggaaacagctacccaaaactaagcaaaagctacataaacgacaaaggaaaagaggtactcgtcctatggggcatccaccacccctccaccagcgcagaccaacaatcactataccaaaacgcagacgcctacgtattcgtcggaacctcacgatacagcaagaaattcaaaccagagatcgccatccgacccaaagtccgagaccaagaaggccgcatgaactactactggaccctcgtcgaacccggggacaaaataaccttcgaagccaccggtaatctcgtagtcccccgttacgccttcgccatggaacgcgacgccggctcaggcatcataatctcggacaccccagtccacgactgcaacacaacctgccaaaccccgaaaggcgccatcaatacatccctcccctttcaaaacatacacccaataaccataggcaaatgtccaaaatacgtcaaatccacaaaactccgcctcgccacaggcctccgcaacgtcccctccatccagtccagaggtctctttggagccatagccggcttcatcgaaggaggctggacaggcatggtcgacggttggtacggataccaccaccaaaacgaacagggctcgggttacgcagccgacctaaaatccacacaaaacgcaatcgacgaaatcactaacaaagtcaactccgtcatcgaaaagatgaacacacaattcaccgccgtcggcaaagagttcaatcacctagaaaagcgaatagaaaacctaaacaagaaaatagacgacggattcctagacatctggacgtacaacgcagaactcctcgtgctcctcgaaaacgaacgaaccctcgactaccacgactcaaatgtcaaaaatctctacgaaaaagtacgatcacagctcaaaaacaatgccaaagaaataggaaacggctgcttcgagttctaccacaaatgcgacaatacctgcatggaaagcgtcaaaaacggaacctacgactacccaaagtactccgaagaagccaaactcaaccgagaagaaatagacggcgtaaaacttgaatcaacccgcatctaccaaattctagccatatacagcaccgtagcctcctccctcgtcttagtcgtcagcctcggcgcg

SEQ ID NO: 58858 - RNA, 1593 nt, synthetic construct
  misc_feature 1..1593: note = derived and/or modified sequence opt11 from anti-influenza_Chain
  source 1..1593: mol_type = other RNA
accctctgcatcggctaccacgcaaacaactccaccgacaccgtcgacaccgtcctcgaaaagaacgttaccgtaacacacagcgtcaacctgctcgaagacaaacacaatggcaaactttgcaaactgcgcggagtcgcacccctacacctcggcaaatgcaacatagccgggtggatactcggaaaccccgaatgcgaatccctctcaaccgcctcctcctggtcctacatcgtagaaacctccagcagcgacaacggaacctgctaccccggcgacttcatcgactacgaagaactcagggaacaactttcatccgtctccagcttcgaacgattcgaaatcttccccaacacaagcagctggcccaaccacgacagcaacaaaggagtgacagccgcctgcccccacgccggggcaaagagcttctacaaaaacctgatctggctcgtaaagaaaggcaactcctacccaaaactctccaaaagctacatcaacgacaaaggtaaagaagtactcgtactctggggcatccaccaccccagcacgtccgcggaccagcagtccctataccaaaacgcagacgcctacgtctttgtcggaacctcacgctactccaagaaatttaaaccagaaatcgcaatccgcccgaaagtaagggaccaagagggacgaatgaactactactggaccctagtcgaaccgggcgacaaaatcacattcgaagccacaggaaacctggtagtcccccgctacgcgttcgcaatggagcgggacgccggatccggcatcatcatatcagacacaccagtccacgactgcaacaccacgtgccaaacaccaaagggcgcaattaacacatccctacctttccaaaatatccacccaatcaccatcggcaaatgcccaaaatacgtcaaaagcacaaaactccgactagccacaggcctgcgcaacgtcccctccatccaaagccgcggcctcttcggtgccatcgccggattcattgaaggcggctggacaggaatggtagacggctggtacggctaccaccaccaaaacgagcaaggatcaggctacgccgccgacctaaaaagcacacaaaacgccatcgacgaaataaccaacaaggtcaacagcgttatagagaaaatgaacacacaattcaccgcagtcggcaaagagttcaaccacctagaaaaacgcatcgagaacctcaacaaaaagatcgacgacggcttcctcgacatctggacctacaacgccgaactattagtactcctcgaaaacgaacgcacactcgactatcacgactcaaacgtcaaaaacctctacgaaaaagttagaagccaactcaaaaacaacgccaaagaaatcggcaacggctgcttcgagttctaccacaaatgcgacaacacttgcatggaatcagtcaaaaacggcacctatgactacccaaaatactcagaagaagccaaactaaaccgcgaagaaatcgacggagtcaaactagaaagcacccgcatctaccagatcctcgccatatactcaacagtggccagcagcctagtcctagtcgtctccctcggcgcg

SEQ ID NO: 58859 - RNA, 1593 nt, synthetic construct
  misc_feature 1..1593: note = derived and/or modified sequence opt11 from anti-influenza_Chain
  source 1..1593: mol_type = other RNA
acgctctgcatcggataccacgccaacaactcaacagacactgtagacaccgtcctagagaaaaacgtaaccgtcacacacagcgtcaacctgctcgaagacaagcacaacggcaaactatgcaaactccgaggtgtggctcccctgcacctcggcaaatgcaacatcgccggctggatcctgggcaaccccgaatgcgaaagcctatccacggcctcctcctggagctacatcgtcgaaacctcatcctccgacaatggaacctgctacccaggcgacttcatcgactacgaagaactcagagaacaactctccagcgtatcctcattcgaacgattcgaaatattcccgaaaacatcctcatggcccaaccacgactccaacaaaggcgtaacagcggcctgcccccacgccggcgccaagagcttctacaaaaacctaatctggctcgtcaagaaaggcaactcataccccaaactatcaaaatcatacataaacgacaaaggaaaagaagtcctagtcctctggggcattcaccacccatccacatccgccgaccaacaatccctctaccaaaacgccgacgcatacgtcttcgtcggcacctcacgatattccaagaaattcggccccgagatagccatacgacccaaagtccgcgaccaagaaggccgcatgaattactactggaccctcgtcgagccaggagacaagataacattcgaagcaaccggcaacctcgttgtaccccgatacgccttcgccatggaacgagacgcaggcagcggcatcataatatcggacacccccgtacatgactgcaacacaacctgccaaacccccaaaggcgccatcaacaccagcctccccttccaaaacatccaccccatcaccatcggcaaatgcccaaaatacgtcaaaagcaccaaactacgcctcgctaccggcttacgaaacgtcccatcaatacaatcaagaggcctattcggcgcaatcgcaggcttcatcgaaggaggatggacaggcatggtagacggttggtacggataccaccaccaaaacgaacaaggctccggctacgcagccgacctcaaatccacccaaaacgccatagacgaaataaccaacaaagtaaacagtgtcatcgagaaaatgaatacccaattcaccgccgtcggcaaagagttcaaccatctggaaaaacgaatagaaaacctaaacaagaaaatcgacgacggcttcctcgacatatggacctacaacgcagaactcctcgtcctcctcgaaaacgaacgcaccctagactaccacgactccaacgtcaaaaacctctacgaaaaagtccgatcacaactcaaaaacaacgccaaagaaataggcaacggctgcttcgagttctaccacaaatgcgacaatacctgcatggaatcagtcaaaaacggcacctacgattatcccaaatactccgaagaagccaaactaaaccgcgaagaaatcgacggagtcaaactggagtccacccggatctaccaaatcctcgccatatactcaactgtcgcatcctccctcgttctcgttgtctccctaggcgcc

SEQ ID NO: 58860 - RNA, 1605 nt, synthetic construct
  misc_feature 1..1605: note = derived and/or modified sequence opt11 from anti-influenza_Chain
  source 1..1605: mol_type = other RNA
gccaacgccgacaccctatgcatcggataccacgccaacaactcaaccgacaccgtagacaccgtactcgagaaaaacgttaccgtcacccacagcgtaaacctactggaagacaaacacaacggcaaactctgcaaactccgaggcgtcgcccctcttcacctcggaaaatgcaacatagccggttggatcctaggcaaccccgaatgcgaatcactgagcacagcctcaagctggagctacatagtagaaacctccagctccgacaacggaacatgctacccaggcgacttcatcgactacgaagaactccgagaacaactctcaagtgtcagctcattcgaacgatttgaaatattcccaaaaacctcctcctggcccgaccacgacagcaacaagggcgtcactgcagcctgcccccacgccggggccaaaagtttctacaaaaacctcatctggctcgtcaaaaagggtaacagctaccccaaactatcaaaatcctacataaacgacaaaggaaaagaagtcctggtactatggggaatccaccacccctccacgtccgccgaccaacagtcactataccaaaacgccgacgcctacgtatttgtcggcacctcaaggtacagcaagaaattcaaacccgaaatcgcaatccgcccaaaagtacgcgaccaagaaggaaggatgaactactactggacccttgtcgaacccggcgataaaatcaccttcgaagccaccgggaacctcgtagtcccccgctacgccttcgcgatggaacgcaacgcaggcagcgggatcataataagcgacacccccgtccacgactgcaacacaacctgccaaaccccaaaaggagcaataaacacctccctacccttccaaaacatccacccaattacaataggcaaatgcccaaaatacgttaagtccacaaaactccgcctagccacaggccttcgcaacgtcccgtccattcaatcccgcggactcttcggcgccatcgccggcttcatcgaaggcggctggaccggcatggtcgatggctggtacgggtaccaccaccaaaacgaacaaggcagcggctacgccgccgacctgaaatccacccaaaacgcaatcgacaagatcactaacaaagtcaactccgtaatagagaaaatgaacacccaatttacagccgtcggcaaagaatttaaccacctcgagaaaagaatagaaaacctaaacaagaaagtcgacgacggattcctagacatctggacctacaacgccgaactgttagtcctcctcgaaaacgaacgcaccctcgactaccatgactccaacgttaaaaacctctacgaaaaagtacgaagccaactcaaaaacaacgccaaagaaatcggaaacggatgcttcgagttctaccacaaatgcgacaatacctgcatggagtccgtcaaaaacgggacgtacgactaccccaaatactccgaagaagccaaactaaaccgcgaagaaatcgacggggtcaagctagaatccacgcgcatctatcagatcctggccatatactcaacagtcgcctccagcctagtactggtagtatcactcggtgca

SEQ ID NO: 58861 - RNA, 1605 nt, synthetic construct
  misc_feature 1..1605: note = derived and/or modified sequence opt11 from anti-influenza_Chain
  source 1..1605: mol_type = other RNA
gcaaacgccgatacactctgcatcggatatcacgcaaacaactccaccgacaccgtggacaccgtcctggaaaaaaacgtgaccgtaacacactccgtaaacctgcttgaagacaaacacaacggcaaactctgcaaactacgcggcgtcgctccactccacctcggcaaatgcaacatagcaggctggatactcggcaacccagaatgcgaaagccttagcaccgcctcctcatggtcatacatcgtagaaacaagctccagcgacaacgggacctgctaccccggcgatttcatcgattacgaagaactacgcgagcaactctccagcgtcagctcattcgaacgcttcgaaattttccccaaaacaagctcctggcccaaccatgacagcaacaagggcgtcaccgccgcttgcccccgagccggcgccaagggcttctacaaaaacctaatctggctcgtcaaaaaaggcaactcataccctaaacttaacaaatcctacataaacgacaaaggcaaagaagtcctagtactatggggaatccaccaccccagcaccaccgcagaccagcagtcactctaccaaaacgccgacacctatgtcttcgtaggcacctcccgctactccaagaaattcaaacccgaaatagaaatccgccccaaagtcagagatcaagaaggccgaatgaactactactggaccctcgtagaacccggtgacaaaatcaccttcgaagccactggcaaccttgtcgtcccacggtacgcattcgccatggaacgaaacgcaggtagcggcatcatcatatcagacaccccagtgcacgactgcaacacaacctgccaaacacccaaaggagcaatcaataccagcctccctttccaaaacatccaccccatcaccattggcaaatgcccaaaatacgtcaaaagcaccaaactacgcctagccaccggcctccgcaacgtaccctccatccaatcgcgcggcctcttcggggccatagccggattcatcgaaggcggatggaccggcatggtagatggctggtacggctaccaccaccaaaacgaacagggatccggatacgcagccgacctgaaaagcacacaaaacgccatagacaaaataacaaacaaggtcaactccgtaatagaaaagatgaacacccaattcaccgccgtagacaaagaattcaaccacctcgaaaaacgcatcgaaaacctcaacaaaaaggtcgatgacggcttcctcgacatctggacatacaacgcagaactccttgtactactcgaaaacgaacgcaccctcgactaccacgactccaacgtcaaaaatctgtacgaaaaagttcgaaaccaactaaaaaacaacgccaaagaaatcggcaacgggtgcttcgaattctatcacaaatgcgacaacacctgcatggaatccgtcaagaacggaacgtacgactaccccaagtacagcgaagaagccaaactcaatcgcgaagaaatcgacggagtcaaactcgaatccacccgcatctaccaaatcctcgccatctactcaaccgtggcatcgtcactagtcctagtagtctccctcggcgct

SEQ ID NO: 58862 - RNA, 1605 nt, synthetic construct
  misc_feature 1..1605: note = derived and/or modified sequence opt11 from anti-influenza_Chain
  source 1..1605: mol_type = other RNA
gccaacgccgacaccctctgcataggataccatgccaacaactcaaccgacaccgtggacaccgtactcgagaaaaacgttacagtaacacacagtgtaaacctactggaagacaaacataacggcaaactttgcaaactacgaggcgttgccccactacacctaggcaagtgcaacatcgccggatggatcctcggaaacccggaatgcgaatccctatccacggcctcctcatggagctacatcgttgaaacatccagctccgacaacggaacctgctacccaggcgacttcatcgactacgaagaactccgcgaacaactcagctcagtctccagcttcgaacgattcgaaatcttcccgaagacctccagctggccagaccacgacagcaacaaaggcgtcaccgccgcatgcccacacgccggcgcaaaatctttctataagaacctaatctggctcgtcaagaaaggtaacagctaccccaaactatcaaaatcctacatcaacgacaaaggcaaagaagtgctcgtcctctggggcatacaccacccctccacgtccgcagatcaacaatccctataccaaaacgccgacgcctacgtattcgtcggcacatcccgctacagcaagaaattcaaacccgaaatcgccatccgaccaaaagtccgagaccaagaaggccgaatgaactactactggaccctcgtagaaccaggagacaaaatcacctttgaagccaccggaaacctagtcgtccccaggtacgccttcgccatggaacgaaacgccggctccggaatcattatatccgacacccccgtccacgactgcaacacaacctgccaaacccccaaaggcgcaatcaacacatcactacccttccaaaacatccaccccatcaccattggaaaatgccccaaatacgtaaaatcaaccaaactcagactcgccaccggcctacgaaacgttccatccatccaatcccgtggactcttcggcgcgatagcaggatttatcgaaggcggatggaccggcatggtcgacggatggtacggataccaccaccagaacgaacagggatctggctacgcagccgacctcaaatccacccaaaacgctatcgacaaaataaccaacaaagtaaactcggtcattgaaaagatgaacacgcaattcaccgccgtcggcaaagagttcaaccacctcgaaaaacgcatcgaaaacctcaacaagaaagtagatgacggcttcctagacatatggacatacaacgctgaactcctcgtacttctcgaaaacgaacgaaccctcgactaccacgactcgaacgtcaaaaacctatacgaaaaagtaagatcacaactcaaaaacaacgcaaaagaaatcggaaacggctgctttgagttctaccacaaatgcgacaatacctgcatggaaagcgtaaagaacggcacttacgactacccgaaatacagcgaagaagcaaaactaaaccgcgaagagatagacggcgtgaagctcgaatccacacgcatatatcagatcctcgcgatctactcaacagtagcctcatccctagtcctagtcgtatccctcggcgcc

SEQ ID NO: 58863 - RNA, 1605 nt, synthetic construct
  misc_feature 1..1605: note = derived and/or modified sequence opt11 from anti-influenza_Chain
  source 1..1605: mol_type = other RNA
gccaacgccgacaccctatgcataggctaccacgccaataactcaaccgacacagtagacaccgtactcgaaaagaacgtaaccgtaacccacagcgtcaacctcctagaagacaaacacaacggaaaactctgcaaactccgcggagtagccccactccacctcggcaaatgcaatatcgccggctggatcctcggaaacccagaatgcgaatccctctccaccgcctcaagctggagctatatagtcgaaacatccagcagcgacaacggaacctgctaccccggcgacttcatcgactacgaagaactccgcgaacaactctcaagcgtatcctccttcgaacgcttcgaaatatttcccaaaacgtcctcctggcccaaccacgacagcaacaaaggcgtcacagcagcatgcccgcgagcaggggccaaaggcttctacaaaaatctcatctggctcgtaaagaaaggcaacagctacccaaaactaaacaaatcctacatcaacgacaaaggcaaagaagtcctcgttctctggggcatacaccacccctccacaaccgccgaccaacaaagcctctaccaaaacgccgacacttatgtcttcgtcggaacctccagatactccaagaaattcaaaccggaaatcgaaatacgcccaaaagtacgcgaccaagaaggaagaatgaactactactggaccctagtggaaccgggcgacaaaataacattcgaagccaccggcaacctcgtcgtaccccggtacgcgttcgcaatggaacggaacgcaggcagtggaatcatcatcagcgacacccccgtgcacgactgcaacacaacctgccaaacccccaaaggagccatcaacacttcactccccttccaaaacatccaccccataaccatcggcaaatgccctaaatacgtcaaatccaccaaactcagactagctaccggcctacgcaacgtcccctccatccagagccgcggcctattcggagcaatcgccggctttatagaaggaggatggacaggtatggtcgacggatggtacggataccaccaccagaacgaacagggctccggatacgccgccgacctgaaatccacacaaaacgcaatagacaaaataacaaacaaagtaaactccgtaatcgagaaaatgaacacccaattcaccgcggtagacaaagagttcaaccacctggaaaaacgaatcgaaaacctaaacaagaaagtcgacgacgggttcctcgacatatggacctacaacgccgaactcctagtcttactagaaaacgaacgcaccctagactaccacgactccaatgtcaaaaacctctacgaaaaagtgcggaaccaactcaaaaacaacgccaaagaaatcggcaacggatgcttcgagttctaccacaaatgcgacaacacatgtatggaaagcgtcaaaaacggaacctacgactaccccaaatactcagaagaagccaaactgaatcgagaagaaatcgacggcgtaaaactcgaatccacccgcatataccaaatactagcgatctactcaacagtcgcttcctcactcgtcctagtagtatcactaggcgca

SEQ ID NO: 58864 - RNA, 1644 nt, synthetic construct
  misc_feature 1..1644: note = derived and/or modified sequence opt11 from anti-influenza_Chain
  source 1..1644: mol_type = other RNA
caaaaactccccggcaacgacaacagcacagccaccctctgtctcggccaccacgccgtccccaacggaaccatcgtcaaaaccatcaccaacgaccaaatagaagtcaccaacgccacagaactcgtacaatcgtcatccaccggcgaaatctgcgactccccacaccaaatactagacggcgaaaactgcaccctaatcgacgcactccttggtgacccgcaatgcgacggcttccaaaacaagaaatgggacctcttcgtcgaacgatccaaagcctactccaactgttacccctacgacgtcccagattacgcctccctacgcagcctcgtagcctccagcggcaccctcgagttcaacaacgaatcctttaactggaccggagtcacccaaaacggaacctcatcagcctgcatccgacgctccaacaactcattctttagccgactcaactggctaacccacctcaaattcaaataccccgccctcaacgtcaccatgcccaacaacgaaaaattcgacaaactgtacatctggggcgtacaccaccccggcaccgacaacgaccaaatattcccctacgcgcaagcctccggacgcattaccgtatccacaaaacgctcacaacaaacagtcatccccaacatcggttcccgcccccgggtaagaaacatccccagccgtatctcaatctactggaccatagtaaaaccaggagacattctactcatcaactccaccggcaacctcatcgcgccccgcggctacttcaaaatccgctccggaaaatccagcatcatgcgatccgacgcccccataggcaaatgcaactcagaatgcatcacccctaatggatcgatccccaacgacaaacccttccaaaacgtcaaccgcatcacctacggcgcatgcccacgttacgtaaaacaaaataccctcaaactagccaccggaatgcgcaacgtacccgaaaaacaaacacgtggcatattcggcgccatcgctggcttcattgaaaacggctgggaaggcatggtcgacggctggtacggcttccgccaccagaactccgaaggcatcggacaagccgcagacttaaaatcgactcaagccgccatagaccaaatcaacggcaaactcaaccgactcataggaaaaaccaacgaaaaatttcaccaaatagaaaaagagttctccgaagtcgaaggacgcatccaagacctcgaaaaatacgtcgaagacaccaaaatcgacctctggtcttacaacgcagaactactcgtcgccctcgaaaaccagcataccattgacctcaccgactccgaaatgaacaaactcttcgagaaaacaaagaaacaactccgcgaaaacgcagaagacatgggcaacggttgcttcaaaatctaccacaaatgcgacaacgcatgcatcggctccatccgaaacggcacatacgaccacgacgtctaccgcgacgaagcactcaacaaccgcttccaaataaagggcgtggaactcaaatcgggctacaaagactggatcctctggatctccttcgccatctcctgctttctcctctgcgttgccctactcggcttcatcatgtgggcctgccaaaaagggaacatccgctgcaacatc

SEQ ID NO: 58865 - RNA, 1644 nt, synthetic construct
  misc_feature 1..1644: note = derived and/or modified sequence opt11 from anti-influenza_Chain
  source 1..1644: mol_type = other RNA
cagaaactccccggcaacgacaactccaccgccaccctctgtctcggacaccatgccgtccccaacggcaccatcgtcaaaaccatcactaacgaccaaatcgaagtcaccaacgccacagaactcgtccagtcttcatccaccggcgaaatatgcgactcgccacaccaaatactagatggcgaaaactgcaccctcatcgacgcactgctcggcgacccccaatgcgacgggttccaaaacaagaaatgggacctatttgtggaacgatccaaagcctattctaactgctacccctacgacgtacccgactacgcatccttacgatccctcgtcgcctccagcggcacactcgaatttaacaacgagagcttcaactggacgggagtaacacaaaacggaacctcctccgcctgcatccgccggtccaacaactcattcttcagccggctcaactggctcacacacctcaaattcaaataccccgcccttaacgtcaccatgcctaacaacgaaaaattcgacaaactctacatttggggcgtccaccacccaggaaccgacaacgaccaaatcttcccatacgcccaagccagcggacgaatcaccgtttccacaaaacgatcacaacagacagtaatccccaacatcggaagccgcccccgagtacgcaacatcccttcccgaatctccatatattggaccatcgtcaaacccggcgatatcctactcataaacagcacaggaaacctaatcgcaccgcgcggatacttcaaaatacgatcaggcaaaagctcaataatgcgaagcgatgcccccatcggcaaatgcaacagcgaatgcatcacccccaacggctccatccccaacgacaaacccttccaaaacgtcaaccggatcacatacggcgcctgcccccgctatgtcaaacaaaacaccctcaaactagccaccggcatgcgcaacgtccccgaaaaacagacacgcggcatcttcggagcaatcgccggattcatcgaaaacggatgggaaggaatggtagacggctggtacggattccgacaccagaactcagaaggcatcggccaggccgccgacctcaaaagcacacaagcagccatagaccaaataaacggcaagctcaatcgcctaattggcaaaacaaacgaaaaattccatcaaatagaaaaagagttctccgaagtagaaggacgaatccaagacctagaaaaatacgtcgaagacacaaaaatcgacctctggtcctacaacgccgaactcctagtcgccctagaaaaccaacacacaatcgacctaaccgactcggaaatgaacaaactcttcgaaaagaccaagaaacaactacgagaaaacgccgaagacatgggcaacggctgctttaaaatctaccacaaatgcgacaacgcatgcatcggctccatccgcaacggaacctacgaccacgacgtctatagggacgaagccctcaacaaccgatttcaaatcaaaggcgtagaactaaaaagcggatacaaagactggatcctctggatctcattcgcaatctcatgcttcctactctgcgtcgcactcctaggattcataatgtgggcatgccaaaaaggaaacatccgctgcaacata

SEQ ID NO: 58866 - RNA, 1647 nt, synthetic construct
  misc_feature 1..1647: note = derived and/or modified sequence opt11 from anti-influenza_Chain
  source 1..1647: mol_type = other RNA
atgctcaccttccaccgcataattcgcaaagggtggatgttcctcctcgccttcctccttaccgccctactattctgccccacaggccaaccagccaaagccgccgcacccttcaacggcaccatgatgcagtacttcgaatggtacctacctgacgacggaaccctatggaccaaagtcgcaaacgaagctaacaatcttagcagcttaggcatcaccgcgctctggctccctccagcctacaagggtacctcccgaagcgacgtcggatacggagtttatgacctctacgaccttggcgaatttaaccaaaaaggcgcagtacgaaccaaatacggaaccaaagcccaatacctgcaggccatacaagccgcccacgcggccggcatgcaagtctacgcggacgtcgtattcgaccacaaaggcggcgcagacggaaccgaatgggtcgacgcagtcgaagtcaacccctccgaccgcaaccaagaaatctccggcacctaccaaatccaagcctggaccaaattcgacttccccggccgcggaaacacatactcatccttcaaatggcgctggtaccacttcgatggcgtagactgggacgaaagtagaaagctatcccgcatatacaaattccgaggaatagggaaagcatgggactgggaagtcgacacagaaaacggcaactacgactacctaatgtacgctgacctcgacatggaccacccagaagtcgtaacagaattaaaaagctggggaaaatggtacgtcaacaccacaaacatcgacggcttccgcctagacgccgttaaacacatcaaattctcattcttccccgactggctaagtgacgtccgctcacaaaccggcaaaccactcttcacagtaggagaatactggagctacgacataaacaaactccacaactacatcatgaaaaccaacggcaccatgtccctcttcgatgcaccactccacaataaattctacaccgcctccaaaagcggcggcactttcgacatgcgaacactcatgaccaacacactcatgaaagaccaacccactctagcagtcactttcgtcgacaaccacgacacagaacccggccaagccctgcaatcatgggtcgacccctggttcaaaccccttgcctacgcattcatcctaacccgacaagaaggatacccatgcgtcttctacggcgactactacggaatcccccaatacaacatccccagcctaaaatcgaagatcgaccccctcctaatagcccgcagagactacgcctatggtacccaacacgactacctagaccactccgacatcatcgggtggacccgcgaaggagtaacagaaaaacccggctccggcctcgccgccctcataaccgacggacctggcggatcaaagtggatgtacgtcggaaaacaacatgcaggaaaagtattctatgacctcaccggcaaccgcagcgatacagtcaccatcaacagcgacggctggggcgagttcaaagtaaacggagggtcagtctcagtatgggtcccacgcaaaacgaccgtctcaaccatcgcctggtcaatcacaaccagaccatggaccgacgagttcgtccgctggaccgaaccccgcctagtagcctggccc

SEQ ID NO: 58867 - RNA, 1647 nt, synthetic construct
  misc_feature 1..1647: note = derived and/or modified sequence opt11 from anti-influenza_Chain
  source 1..1647: mol_type = other RNA
atctgtatcggctaccacgcaaacaactccaccgaacaagtcgacaccataatggagaaaaacgtcaccgtgacccacgctcaagacatcctcgagaaaacccacaacggcaaactctgcgacctcgacggagtcaaacccctaatcctacgcgactgttcagtagcaggctggctcctaggaaaccccatgtgcgacgagttcatcaacgttccagaatggtcatacatcgtcgaaaaagccaacccagccaacgacctctgttaccccggcaactttaacgactacgaagaactcaaacacctcctaagccgcataaaccacttcgagaaaatccaaatcataccaaaatcctcatggtccgaccacgaagcctccagcggtgtctcgtccgcttgcccctaccaaggaaccccatcattcttccgcaacgtcgtttggctaatcaagaaaaacaatacatacccaaccatcaaaagatcatacaacaacaccaaccaagaagacctcctcatcctttggggcatccaccactccaacgacgccgcagaacaaaccaaactctaccaaaaccccaccacgtacatctctgtcggaacctcaacactaaaccaaagactcgtcccaaaaatcgccacccgatcaaaagtcaacggccaaaacgggcgaatggacttcttctggaccattctcaaacccaacgacgccataaacttcgaatccaacggcaacttcatcgcaccagaatacgcctacaaaattgtcaagaaaggagacagcgccatagtcaaatccgaagtcgagtacggcaactgcaacacaaaatgccaaacaccaatcggcgcaataaactcatccatgccctttcacaacattcaccccctaacgatcggcgaatgccccaaatacgtcaaatccaacaaactggtccttgccaccggcctccgcaactccccactacgcagcgacaaaacccacacatgccctccctgccccgcccccgaactcctcggaggcccctcagtatttctcttcccacccaaacccaaagacacactcatgatctcccgtacccccgaagtaacctgcgtcgttgtcgacgtctcccacgaagaccctgaagtcaaatttaactggtacgtcgacggcgtcgaagtacacaacgccaaaacaaaaccccgcgaagaacagtacaactcaacataccgcgtcgtcagcgtcctaaccgtactgcaccaagactggctcaacggcaaagaatacaaatgcaaagtctccaacaaagccctaccagcacccatcgaaaagaccatctcaaaagccaaaggccaaccccgagaaccccaagtttacaccctaccaccctcccgcgaagaaatgaccaaaaaccaagtctccctcacgtgcctcgtcaaaggcttctaccccagcgacatagccgtcgaatgggaatccaacggccaacccgaaaacaactataaaacaacgccacccgtgctcgactcagacggctcattcttcctatactccaaacttaccgtagacaaatcccgctggcaacaaggtaacgtattctcatgctccgtcatgcacgaagccctccacaaccattacacacagaaatcactctcactctcacccggcaaa

SEQ ID NO: 58868 - RNA, 1647 nt, synthetic construct
  misc_feature 1..1647: note = derived and/or modified sequence opt11 from anti-influenza_Chain
  source 1..1647: mol_type = other RNA
atctgcatcggataccacgccaacaactccaccgaacaagtcgacaccatcatggaaaagaacgtcaccgtaacccacgcacaagacatcctagagaaaacccacaacggcaaactatgcgacctagacggcgtcaaacccctaatactccgcgactgcagcgtagccggatggctcctcggaaaccccatgtgcgacgagttcatcaacgtccccgaatggtcatacatagtcgaaaaagcaaaccccgccaacgacctatgttacccaggcaacttcaacgactacgaagaactcaaacaccttctctcccgcatcaaccacttcgagaaaatccaaataatacccaaatctagctggtccgaccacgaagcaagctccggagtctcatccgcatgcccctaccagggaaccccctcattcttccgaaacgtcgtatggctcatcaagaaaaacaacacctacccaactatcaaacgctcatacaacaacacaaaccaagaagacctcctcatcctatggggaatacaccactcaaacgacgccgccgaacaaacaaaactctaccaaaaccccacgacctacatctccgtaggcacttcaacactcaaccaaagactcgtacccaaaatcgccacccgatccaaggtcaacggacaaaacggccgcatggacttcttctggacaatcctaaaaccgaacgacgcaatcaacttcgaatcaaacggcaacttcatcgccccggaatacgcttacaaaatcgtcaagaaaggcgactccgcaatcgtcaaaagcgaagtagaatacggcaactgcaacaccaaatgccaaacccccatcggcgctatcaactcctccatgccttttcacaacatccaccccctcacaatcggcgaatgcccgaaatacgtaaaatcaaacaaactcgtactcgccacaggcctacgaaactcgcccctacgctcagacaagacgcacacctgtccgccctgccccgcccccgaattactaggcggaccctccgtattcctcttcccgccaaaacccaaagacaccctcatgatatcccgcacacccgaagtaacctgcgtcgtcgtcgacgtctcacacgaagacccagaagtaaaattcaactggtacgtcgacggagtcgaagtccacaacgcaaagaccaaaccccgcgaagaacaatacaattcaacctaccgcgtggtctccgtcctaaccgttctgcaccaagactggctcaacggtaaagaatacaaatgcaaagtctctaacaaagccctacctgccccaatagaaaagaccatatccaaagcaaaaggacaacccagagaaccccaagtatacaccctacctccctcccgcgaagaaatgaccaaaaaccaagtctcccttacatgcctcgttaaaggattctacccctccgacatcgccgtcgaatgggaatccaacggtcaacccgaaaacaattacaaaaccacccctcccgtcttagacagtgacggctctttcttcctttacagcaaactcactgtcgacaaatcccgttggcagcaaggcaacgtattctcctgctcagtcatgcatgaagcactacataaccactacacccaaaaatccctctcactatcccccggcaaa

SEQ ID NO: 58869 - RNA, 1647 nt, synthetic construct
  misc_feature 1..1647: note = derived and/or modified sequence opt11 from anti-influenza_Chain
  source 1..1647: mol_type = other RNA
atgctcacattccaccgaatcatccgcaaaggctggatgttcctcctagccttcttgctcacagccctactattctgcccaacaggtcagccagcaaaagccgcagcacccttcaacggtacgatgatgcaatacttcgaatggtacctcccggacgacggaacactatggaccaaagtagccaacgaagccaacaacctatcatccctaggtattaccgccctctggttaccacccgcatacaaagggacgtcccgatccgacgtcggatacggcgtctacgacctgtacgacctcggcgagttcaaccaaaaaggcgccgtccgaaccaagtacggcaccaaggcccaatatctacaggccatccaagcggcccacgcagccggcatgcaagtgtacgcagacgtcgtattcgaccacaaaggaggggccgacggcacagaatgggtagacgccgtagaagtcaacccctccgaccgaaaccaagaaatatcaggcacataccaaatacaagcatggaccaaattcgatttccccggacgtggcaacacatactcgtccttcaaatggagatggtaccacttcgacggcgtagactgggacgaatcacgcaaactcagccggatctacaaattcagaggcatcggaaaagcgtgggactgggaagtcgacaccgaaaatggcaactacgattacctaatgtacgccgacctagacatggaccacccagaagtcgtcaccgaactcaaaagctggggaaaatggtacgtaaacaccaccaacatcgacggcttccgactcgacgcagtaaaacacatcaaattctcattcttccccgactggctctccgacgtcagatcccaaactggaaaaccactatttaccgtcggggaatactggagctacgacatcaacaaactccacaactatatcatgaaaacgaacgggaccatgtccctattcgacgcacccctacacaacaaattctacactgcctcaaaatccggcggtaccttcgacatgagaacactaatgacaaacacactaatgaaagaccaacccacactcgccgtcaccttcgtcgacaaccatgacaccgaacccggccaagccctacaatcctgggtcgacccatggttcaaaccactcgcctacgctttcatcctcacgcgccaagaaggctacccctgcgtgttctacggcgactactacggaatcccccaatacaacatcccaagcctaaaatcaaaaatcgaccccctcctcatcgcaagaagagactacgcctacggcacccaacacgactatctcgaccacagcgacatcatcggatggacacgcgaaggcgtcacggaaaaaccaggctccggcctggccgctctaatcacagacggccccggcggcagcaaatggatgtacgtaggcaaacaacacgcaggcaaagtcttctacgacctaaccggcaaccgctccgacaccgtaaccataaactcggacggctggggagaatttaaagtgaacggcggatccgtatccgtctgggtcccacgaaaaaccaccgtctccacaatcgcctggtcaattaccacccgcccatggacagacgagttcgtccgatggaccgaaccccgcctcgtagcctggccc

SEQ ID NO: 58870 - RNA, 1650 nt, synthetic construct
  misc_feature 1..1650: note = derived and/or modified sequence opt11 from anti-influenza_Chain
  source 1..1650: mol_type = other RNA
gaccagatctgcataggctaccacgcaaacaactcaacggaacaagtcgacacaataatggagaaaaacgtgaccgtcacccatgcccaagacatactcgagaaaacacacaacggcaaactatgcgacctggacggcgtaaaaccactcatcctaagggactgctctgtcgccggctggctcctgggcaacccgatgtgcgacgaatttatcaacgtccccgaatggtcctacatagtcgaaaaagccaacccaaccaatgacctatgctaccccggctccttcaacgactacgaagaactcaaacacctcctgtcacgcatcaaccacttcgagaaaatacaaatcatccccaaatcgagctggagcgaccacgaagcctcctcaggggtaagcagtgcctgcccctacctcggctccccctccttcttccgaaacgtcgtctggttaatcaagaaaaactccacgtaccccacaatcaagaaatcctacaacaacaccaaccaagaagacctcctcgtcctatggggcatccaccacccaaacgacgccgccgaacaaacacgcctttaccagaaccccacaacctacatctccatcggaaccagcacactcaaccaacgcctcgtccctaaaatcgccaccagatcaaaagtcaacggtcagtccggccgcatggagttcttctgggccatactcaaacccaacgacgccatcaacttcgaatcgaacggaaacttcatcgccccggaatacgcctacaaaatcgtaaagaaaggcgacagcgcgatcatgaaaagcgaactcgaatacggaaactgcaacaccaaatgccagaccccgatgggagccataaattcctcgatgccattccacaacatccacccactaacaataggcgaatgccccaaatacgtcaaatcaaaccgcctcgtactcgccaccggcctcagaaactcaccccaaagagaatcccgaagaaagaaacgaggcctgttcggcgccatcgcaggattcattgaaggagggtggcaaggcatggtcgacggatggtacggctaccatcacagcaacgaacaaggatctggctacgccgcagacaaagaatccacccagaaagccatcggcgtcaccaacaaagtcaacagcataattgacaaaatgaacacccaatttgaagctgtcggccgagagttcaacaacctcgaacgccgcatcgaaaacctcaacaagaaaatggaagacggattcctagacgtctggacctacaatgccgaactcctcgtactcatggaaaacgaacgcaccctcgacttccacgactcaaacgtgaaaaatctatacgacaaagtcagactacagctacgagacaacgccaaagaactaggaaacggctgtttcgagttctaccacaaatgcgacaacgaatgcatggaatctatccggaacggaacctacaaccctcaatactcagaagaagcgcgcttaaaacgcgaagagatcagcggcgtcaaactagaatccataggcacctaccaaatcctaagcatttacagcaccgtcgctagctcgctagcactagccataatgatagctggcctatccctctggatgtgctccaacggatcactacagtgcagaatatgcata

SEQ ID NO: 58871 - RNA, 1650 nt, synthetic construct
  misc_feature 1..1650: note = derived and/or modified sequence opt11 from anti-influenza_Chain
  source 1..1650: mol_type = other RNA
gaccaaatctgcataggctaccacgccaacaatagcaccgaacaagtcgacaccataatggaaaagaacgtcacggtcacacacgcacaagacatcctcgaaaaaacccacaacggaaagctatgcgacctcgacggcgtcaaacccctcatactacgcgactgctccgtcgctggatggctactaggaaaccctatgtgcgacgaattcatcaacgtgcccgaatggtcctacatcgtcgaaaaggccaaccccaccaacgacctctgttatccaggatcattcaacgactacgaagaacttaaacacttactcagccggatcaaccacttcgaaaaaatccaaatcatccccaaatcatcgtggtccgaccacgaagcctccagcggcgtatcctcagcatgcccatacctaggcagcccatcattcttccgcaacgtcgtctggctcatcaaaaaaaactccacctaccccacaatcaaaaaatcctacaataacaccaaccaagaagacctactcgtcctctggggcatacaccacccaaacgacgcagccgaacaaacccgcctctatcaaaaccccactacctacataagcatcggaacctccaccctgaaccaacgactcgtccccaaaatcgcaacccgcagcaaagtcaacggccaatcaggcagaatggaattcttctgggcaatactgaaaccaaatgatgccatcaacttcgaatcaaacggtaatttcatcgcacccgaatatgcctacaaaatagtgaagaaaggcgacagcgcgatcatgaaaagcgaactcgagtacggcaactgcaacacgaaatgccaaacccctatgggcgcaatcaacagcagcatgcccttccacaatatccacccactcacaatcggggaatgccccaaatatgtcaaatcaaaccgcctcgtactagccaccggcctacgcaactccccgcaacgagaatcccgcagaaaaaagagaggactcttcggcgcaatcgcaggcttcatcgaaggcggctggcaaggcatggtcgacggctggtacggctaccaccacagcaacgaacaaggctccggctacgccgcagacaaggagagcacccaaaaagcaataggcgtcaccaacaaagtaaactcgatcatcgacaaaatgaatacacaatttgaagccgtcggcagagaattcaacaacctcgaacgcagaatagaaaacctcaacaaaaaaatggaagacgggttcctcgacgtctggacctacaacgccgaactcctcgtactcatggaaaacgaacgcaccctagacttccacgactccaacgtcaaaaacctgtacgacaaagtccgtctacaactccgagacaacgccaaagaacttggcaacggctgcttcgaattctaccacaaatgtgacaacgaatgcatggaaagcatccgcaatggaacctacaaccctcagtactccgaagaagcccgccttaaacgagaagaaataagcggagtcaaactcgaatccataggcacctaccaaatcctctccatctactccaccgtcgcatcttccctggcactcgcaataatgatagccggcctatctctatggatgtgctccaacggctccctccaatgccgcatctgcatc

SEQ ID NO: 58872 - RNA, 1656 nt, synthetic construct
  misc_feature 1..1656: note = derived and/or modified sequence opt11 from anti-influenza_Chain
  source 1..1656: mol_type = other RNA
atgaacatccaaatcctcgctttcatcgcctgcgtactcaccggcgccaagggagacaaaatatgcctcggccaccacgccgtagccaacggaaccaaggtcaacaccctaacagaaaaaggaatcgaagtcgtaaacgctacagaaacagtcgaaaccgcagacgtcaagaaaatatgcacgcaaggcaaaagagccaccgacctcggccgctgtggactactcggaaccctcataggaccccctcaatgcgaccaattcctggagttcagctcagacctcatcatcgaacgccgcgaaggcaccgacgtttgctacccaggccgctttacaaacgaagaatcgctccgccaaatactccgccgctcaggtggaatcggcaaagaatccatgggtttcacatactcaggcatccgcaccaacggcgccgcaagcgcctgcacccgaagcggatcctccttctacgccgaaatgaaatggctactatcaaactccgacaactccgcattcccacaaatgactaaggcctacagaaacccacgcaataaacccgccctaatcatctggggcgtccaccactcggaatccgccagcgaacaaaccaagctctacggctcaggcaacaaactcatcaccgttcgctcctccaaataccaacaatcattcaccccctcacccggcacccgacgcatcgacttccactggctcctcctcgaccccaacgacacagtaactttcactttcaacggcgcctttatcgcacccgatcgggcatcattcttccgcggcgaatcacttggagtccaaagcgacgcacccctcgattcctcgtgccggggcgactgcttccacagtggcggaaccatagtcagctccctcccattccaaaacataaactcccgaaccgtcggacgatgcccacgctacgtcaaacaaaaatccctcctcctcgcaaccggcatgcgcaacgtcccagaaaaaccaaaaccccgaggcctattcggagccatcgccggattcatcgaaaacggctgggaaggactcatcaacggatggtacggcttccgacaccagaacgcccaaggagaaggcacagcagccgactacaaatccactcaatccgccatagaccaaatcacaggaaaactaaatcgcctaataggaaaaaccaatcagcaattcgaactcatcgacaacgagttcaacgaaatagaacagcaaatcggcaacgtaattaactggacgcgcgacgcaatgaccgaaatctggtcctataacgctgaactcctagtagcaatggaaaaccaacacaccatcgacctcgcagactccgaaatgtcaaaactctatgaaagagtcaagaaacagctccgtgaaaacgccgaggaagacggcaccggctgcttcgagatattccacaaatgcgacgaccaatgcatggaatccatacgaaacaacacctacgaccacacacagtaccgcacagagtccctacaaaaccgcatccaaatcgaccccgtcaaacttagcagcggatacaaagacatcatcctatggttcagcttcggcgccagctgcttcatccttcttgccatagccatgggcctagtcttcatctgcatcaaaaacggcaacatgcaatgtaccatatgcatc

SEQ ID NO: 58873 - RNA, 1656 nt, synthetic construct
  misc_feature 1..1656: note = derived and/or modified sequence opt11 from anti-influenza_Chain
  source 1..1656: mol_type = other RNA
atgaacacccagatcctcgccttcatagcctgcgtactaaccggagtcaaaggcgacaagatatgcctaggccaccacgccgtagctaacggcaccaaggtgaacaccctcaccgaaaaaggcatcgaggtagtcaacgcaactgaaaccgtcgaaaccgctgacgtaaagaaaatctgcacccaaggcaaacgcgcaaccgacttaggtagatgtggcctcctaggaaccctcataggaccaccccaatgcgaccaattcctagagttctcctcagacctcatcatcgaacgcagagaaggtacagacgtatgctaccccggtcgcttcacaaacgaggaaagcctccgccaaatactccgccgatccggaggcatcggtaaagaatccatgggcttcacatactccggcatccgcaccaacggagccacatccgcatgcaccagatccggctcgtcattctatgccgagatgaaatggctcctcagcaactcagataacagcgccttcccccaaatgaccaaagcataccgaaacccccgtaacaaacccgccctcatcatctggggcgtacaccactccgagtccgtctccgagcaaactaaactctacggatcaggaaacaaactcattaccgtccgatcaagcaaataccaacagtcattcacccccagcccaggcgcccgccgaatagacttccactggctcctcctcgatccgaacgacaccgtgaccttcacattcaacggagcattcatcgcgcccgatcgagccagcttcttcaggggcgaatccctaggcgtccaaagcgacgtcccgctcgactccagctgccgaggtgattgcttccactcaggcggaacaatagtctcaagcctccccttccaaaacattaactctcgcaccgtcggaaaatgcccccgctacgtcaagcaaaaatccctcctcctggccactggcatgcgcaacgtacccgaaaaacccaaaccccgcggactattcggcgcaatcgcaggcttcatcgaaaacggctgggaaggcctaataaacggatggtacggcttccgccaccaaaacgcccaaggagaaggaaccgccgccgactacaaatcaacccaaagcgccatcgaccagataaccggcaaactcaaccgcctcataggcaaaaccaaccaacaattcgaactcatcgacaacgagttcaacgaaatcgaacaacagatcggtaacgtaatcaactggacccgcgacgccatgaccgaaatttggtcctacaacgcagaactcctcgtcgccatggaaaaccaacacacaatcgacctagcagactctgaaatgtccaaactctacgaacgcgtcaagaaacaactacgagaaaatgccgaagaagatggcaccggctgcttcgaaatattccacaaatgcgacgaccaatgcatggaatccatccgtaacaacacatacgaccacacacaatatcgcaccgagtcactccaaaatcgcatccaaatcgatcccgtcaaactcagctccggctataaagacatcatcctctggttcagtttcggcgccagctgcttcctcctacttgccatcgccatgggcctcgtctttatctgcatcaaaaacggcaacatgcaatgcacaatctgcatc

SEQ ID NO: 58874 - RNA, 1656 nt, synthetic construct
  misc_feature 1..1656: note = derived and/or modified sequence opt11 from anti-influenza_Chain
  source 1..1656: mol_type = other RNA
atgaacatacaaatactcgcattcatagcctgcgtccttaccggggccaaaggcgacaaaatatgtctcggacaccacgctgtcgcaaatggcacaaaagtcaacaccctgactgaaaagggaatcgaagtcgtcaacgcaacggaaaccgtcgaaaccgccaacatcaagaaaatctgcacccaaggcaaaagaccaaccgacctgggccaatgcggcctcctaggcaccctaataggaccaccacaatgcgaccaattcctcgagttttccagcgatctcataatcgagagacgagaaggcacagacgtctgctacccaggcaaattcaccaacgaagagtcactacgccagatcttacgccgctcaggaggaatcggtaaagagagcatgggcttcacttacagcggaatcagaaccaacggcgccacaagcgcctgcacacgcagcggcagcagcttctacgccgaaatgaagtggctcctctcaaactcggacaacgccgcattcccacagatgaccaaaagctaccgaaacccccggaacaaacccgcactcataatatggggcgtccaccacagcgaatcagtaagcgaacaaaccaaactatacggcagcggcaacaaactcataaaagtccgctccagcaaataccaacaatccttcacaccaaaccctggagccaggcgaatagacttccactggttactactcgacccaaacgacaccgtcaccttcaccttcaacggcgccttcatcgcaccggacagagccagcttcttccgcggagaatccatcggagtacaaagcgacgcaccactcgacagctcgtgcggaggcaactgcttccacaacggaggtaccattgtctcaagcctgcccttccaaaacataaacccacgcaccgtcggcaaatgcccccgatacgtcaaacagaaaagcctcctcctcgccacaggtatgcgaaacgtcccagaaaaaccaaagaaaagaggcctttttggcgcaatcgccgggtttatagaaaacggctgggagggcctcatcaacggatggtacggcttcaggcaccaaaacgcacaaggcgagggcaccgccgcagactacaagtctacacaatcagctatcgaccaaatcaccgggaagctcaaccggctcatcggaaaaaccaaccaacagttcgaactaatcaacaacgagttcaacgaagtcgaacaacagatcggcaacgtcatcaactggacccaagacgccatgaccgaagtatggtcgtacaacgcagaactactcgtagccatggaaaaccaacacaccatcgacctcaccgacagcgaaatgtccaaactctacgagcgcgtccggaaacaactacgagaaaacgcagaagaagacggcaccggatgcttcgaaatattccacaaatgcgacgaccactgcatggagagcatccgaaacaacacctacgaccacacacaataccgcacagagtcactacagaaccggattcagatagaccccgtcaagctgagcggcggatataaagacatcatcctctggttctcgttcggcgcctcatgctttctcctactcgcaatagcgatgggcctagtgttcatatgcatcaaaaacggaaacatgcagtgcaccatatgcatc

SEQ ID NO: 58875 - RNA, 1656 nt, synthetic construct
  misc_feature 1..1656: note = derived and/or modified sequence opt11 from anti-influenza_Chain
  source 1..1656: mol_type = other RNA
gaccagatatgcatcggataccacgccaacaactccaccgaacaggtagacacaataatggagaaaaacgtcaccgtcactcacgcccaaaacatcctcgagaaaacacacaacggcaaactctgcgacctagacggcgtcaaacccctcatcctcagagactgcagcgtcgcaggctggctcctcggtaacccaatgtgcgacgagttcctaaatgtgcccgaatggtcctacatagtggagaaaatcaaccccgccaacgacctttgctacccaggcaactttaacgactacgaagaactcaaacacctcctatcacgaatcaaccacttcgaaaagatacaaataatcccaaaatcatcctggtccgaccacgaagctagctccggcgtctcctccgcctgcccataccaaggccgcagctcattcttccgcaacgtcgtctggctaattaagaaagacaacgcctaccccaccataaaacgcagctacaacaatacaaaccaagaagacctactcgtgctatgggggatacaccacccaaacgacgccgccgaacaaacccgactataccaaaacccaacaacatacatctctgtcggcacttcaaccttaaaccaacgactcgtccccaaaatcgccacccgttccaaagtcaacggccagtccggaagaatggagttcttctggaccatcctcaagcccaacgacgccatcaacttcgaatcaaacggcaacttcatcgcacccgaaaacgcctacaaaatcgtcaagaaaggagactcaacaatcatgaaaagcgaactcgaatacggcaactgcaacaccaaatgccagacacccatcggcgcaatcaacagcagtatgccattccataacatccacccccttacgatcggagaatgcccaaaatacgtcaaatccaacaaactcgtcctcgcaaccggcctccgcaactcgccccaaggcgaacgccgccgcaagaaacgcggcctcttcggagcaatagccggcttcatcgaaggcggctggcaaggcatggtagacggatggtacgggtaccaccactccaacgaacaaggatccggttacgccgccgacaaagaaagcacccaaaaagcaatcgacggcgtaacaaataaagtaaattcaatcatagacaaaatgaacacacagttcgaagcggtgggacgcgagttcaacaacctagaacgccggatcgaaaacctgaacaagaaaatggaagacggcttcctcgacgtgtggacatacaacgccgaactcctcgtcctcatggaaaacgaacgaaccctagacttccacgactccaacgtcaaaaacctctacgacaaaatccgtctccaactgcgagacaacgccaaagaactcggcaacggctgcttcgagttctaccaccgttgtgacaacgaatgcatggaatcagtacgaaacggaacatacgactacccccaatactccgaagaagcccgccttaaacgagaagaaatatccggagtaaaactagaaagcatcggaacatatcaaatactatcaatctactccacagtcgcctcctccctcacactcgccatcatggtagccggactctccctatggatgtgctcaaacggctccctccaatgccgaatatgcatc

SEQ ID NO: 58876 - RNA, 1656 nt, synthetic construct
  misc_feature 1..1656: note = derived and/or modified sequence opt11 from anti-influenza_Chain
  source 1..1656: mol_type = other RNA
gaccaaatatgcatcggataccacgcaaataacagcacagaacaagtcgacacgataatggagaaaaacgtcaccgtaacacacgcccaagacatcctagaaaagacccacaatggaaaactatgcgacctcgacggcgtcaaacctctaatcctccgcgactgctccgtggcaggctggctcctgggaaaccccatgtgcgacgaattcataaatgtaccagaatggtcctacatcgtggaaaaggccaaccccacaaacgacctgtgctacccagggtcattcaatgattacgaagagctcaaacacctactctctcgcatcaaccacttcgaaaagatccaaatcatcccaaaatcctcctggtctgaccacgaagcgagctccggcgtttcctcagcctgcccctacctcggctccccctcctttttccgcaacgtcgtctggctaataaaaaaaaattccacctacccaaccatcaaaaaatcctacaacaacactaaccaagaagacctcctcgtactctggggcatacaccaccctaacgacgccgccgaacaaactcgcctctaccaaaaccccaccacttacatctccataggcacttctaccctcaatcaaagacttgtgcctaaaatcgccacgcgatcaaaagtcaacggccaatcaggccgcatggaattcttctggaccatacttaaccccaacgacgccataaacttcgaaagcaacggcaattttatcgcccccgaatacgcctacaaaatagtaaaaaaaggcgactcagccatcatgaaaagcgaactagaatacggcaactgcaacacaaaatgccaaacacccatgggcgcgatcaactcctcaatgccattccacaacatccaccccctcacaatcggcgaatgccccaaatacgtcaaatccaaccgcctagtcctcgccacgggcctgcgcaacagcccccaacgcgaatccagacggaaaaaacgcggcctcttcggtgccatagccggcttcatagaaggaggctggcaagggatggtcgacggctggtacggctatcaccactcaaacgaacaaggtagcgggtacgcggccgacaaagaaagcacacaaaaggccatagacggtgtaaccaacaaagtcaactcgatcatcgacaaaatgaacacacaattcgaagcagtgggacgagaattcaacaacctcgaaagacgaatagaaaacctcaacaaaaaaatggaagacggcttcctcgacgtctggacctacaatgcagagctcctggtactaatggaaaacgagcgaaccctcgacttccacgacagcaacgtaaaaaacctatacgacaaagtccgcctccaactccgcgacaatgccaaagaacttggtaacggctgcttcgaattctatcacaaatgcgacaacgaatgcatggaatccattcgcaacgggacctataactacccccaatactccgaagaagcccggctcaaacgagaagaaataagcggcgtcaaactcgagagcataggcacctaccaaatcctctcaatctacagcaccgtcgcctccagcctcgcactagccataatgatggcaggcctcagcctgtggatgtgctccaacggcagtctccaatgccgcatatgcatc

SEQ ID NO: 58877 - RNA, 1656 nt, synthetic construct
  misc_feature 1..1656: note = derived and/or modified sequence opt11 from anti-influenza_Chain
  source 1..1656: mol_type = other RNA
atgaacatccaaatacttgccttcatcgcctgcgtattaaccggagccaagggcgacaaaatctgcctcggacaccacgccgtagccaacggcacaaaagtcaacaccctaacagagaaagggatcgaagtcgtaaacgccacagagaccgtcgagaccgcagacgtcaagaaaatatgcactcaaggcaaacgcgccaccgacctcgggcgatgcggactcctaggcaccctaatcggaccaccccagtgcgaccaattcttagagttctcctcagacctaataatagaacgccgagaaggcaccgacgtttgctaccccggacgcttcaccaacgaagaatccctacgccaaatcctccgccgctccggaggaatcggcaaagaaagcatgggcttcacctactccggcatccgcaccaacggagcagccagcgcatgcacccgatccggctcctccttctacgcagaaatgaaatggctactctccaactcagataactccgcattcccccagatgacaaaagcctaccgcaacccccgcaacaaacccgccctcatcatatggggtgtacaccactccgaatcagcctccgaacaaaccaagctctacgggtccggtaacaaactaataactgtccgcagctccaagtaccaacaatccttcaccccctccccaggcacccgccgaatcgacttccactggctattactcgaccccaacgacaccgtaacattcaccttcaacggcgccttcattgccccagaccgagcatctttcttccgaggcgaatcattaggagtccagtctgacgccccactcgactcaagctgccgcggcgactgcttccacagcggcggcaccatcgtctcctcgctaccgttccaaaacatcaactcccgcaccgtaggacgctgcccacgctacgtcaaacaaaaatcactcctactcgccactggaatgcgaaacgtacccgaaaaaccaaaaccacgaggactgttcggcgccatcgcaggcttcatcgaaaacggatgggaaggcctaatcaacggatggtacggtttccgccaccaaaacgctcaaggggaaggcaccgcagcagactataaatccacccaatccgccatcgaccaaatcaccgggaaacttaaccgactcatcggcaaaaccaaccaacaattcgaactaatagacaacgaatttaatgagatcgaacaacaaatcgggaacgtcataaactggactcgcgacgccatgacagaaatctggtcctacaacgcagaacttctcgtcgccatggagaaccaacacaccatcgacctcgccgactccgaaatgtccaaactatacgaacgagtcaaaaagcaactacgcgaaaacgcagaggaagacggcactggctgcttcgaaatcttccacaaatgcgatgaccaatgcatggaatcaatccggaacaacacctacgaccacacccaataccgaactgagtccctccaaaaccggatccaaatcgatccagttaaactctcctccggatacaaggacattatactatggttctccttcggcgcctcatgctttatcctactcgcaatcgcaatgggcctagtgttcatatgcatcaaaaacggaaacatgcaatgcaccatctgcatc

SEQ ID NO: 58878 - RNA, 1656 nt, synthetic construct
  misc_feature 1..1656: note = derived and/or modified sequence opt11 from anti-influenza_Chain
  source 1..1656: mol_type = other RNA
atgaacacccagatcctagccttcatcgcctgcgtcctcaccggcgtaaaaggcgacaaaatctgcctcggccaccacgcagtcgcgaacggaacgaaagtcaacacactaaccgaaaaaggaatcgaagtcgtcaacgctaccgaaacagtcgaaaccgccgacgttaagaaaatctgcactcaaggcaaacgagcaaccgacctgggcagatgcggcctcctaggcacactcatcggccccccccaatgcgaccaattcctcgagttctctagcgaccttatcatcgaacgcagagaaggcacagacgtctgctaccccggccgcttcacaaacgaggaatcactccgccaaatactccgccgctcgggcggcattggaaaagaatctatgggatttacctattccggaatccgcacaaacggcgcaacatccgcatgcacacgctccggatcctcattctacgccgaaatgaaatggctactatcaaactctgacaacagcgccttcccccaaatgactaaagcctaccgcaacccccgaaacaaaccagcactcatcatctggggagtccaccactccgaatcggtctccgaacaaaccaaactctacggctccggcaacaaactaatcaccgtccgatcatccaaatatcaacaatcattcacccccagcccaggcgcaagacgaatagacttccactggctacttctagaccccaatgacaccgtgaccttcactttcaacggcgccttcatcgcccccgaccgcgcatcattcttccgcggcgagtcactaggagtacaatccgacgtcccactcgacagttcctgccgcggagattgcttccactccgggggcaccatcgtatcatccctccccttccagaatataaactctcgcaccgtcggcaaatgccccagatatgtcaaacaaaaatccctcctcctggcaaccggcatgaggaacgtcccagaaaaacccaaaccccgcggcctattcggagccatcgctggttttattgaaaacggctgggaaggactcataaacggctggtacggtttccgacaccaaaacgctcaaggagagggaacagcagcggactacaaatctacccaatcggcgatcgaccaaatcaccggcaaactcaaccgactcatcggcaaaaccaaccaacaattcgaactcatcgacaacgaattcaacgagatagaacaacaaatcggcaacgtcatcaactggacacgcgacgccatgaccgaaatctggtcatacaacgccgaactcctagtagccatggaaaaccagcacaccatagacctcgccgactcagaaatgtccaaactctacgaacgagtcaaaaaacagctacgcgaaaacgccgaagaagacggcactggttgcttcgaaatctttcacaaatgcgacgaccaatgtatggaatccatacgcaacaacacctacgaccacacccaataccgcaccgaatccctccagaaccgcattcaaatcgaccccgtaaaactatcctccggatacaaagacatcatcctatggttctcctttggcgcctcctgcttccttttattagccatagccatgggcctcgtattcatatgcatcaaaaacggaaacatgcaatgcacgatctgcatc

SEQ ID NO: 58879 - RNA, 1656 nt, synthetic construct
  misc_feature 1..1656: note = derived and/or modified sequence opt11 from anti-influenza_Chain
  source 1..1656: mol_type = other RNA
atgaacatccaaatcctcgccttcatagcctgcgtcctcactggcgccaagggcgacaaaatctgcctcggccaccacgccgtcgccaacggaactaaagtcaacaccctcaccgaaaaaggcatcgaggtcgtaaacgcaaccgaaacagtcgaaacagccaacatcaagaaaatctgcacccaaggcaaacgcccgacagacctaggccaatgcggactcctaggaactcttatcggacccccacaatgcgaccaattccttgagttctcctccgacctaattatcgaacgcagggaaggcaccgacgtttgctacccaggcaaattcaccaacgaagaatccctccgccaaatactacgccgctccggcggcatcggcaaagaatcaatgggattcacctactccggcattcgaaccaacggcgccacctcggcatgcacacgcagcggaagctcattctacgccgaaatgaaatggctcctatcaaactcggacaacgctgccttcccacaaatgaccaaaagctaccgcaacccccgcaacaaacccgcgctcataatctggggcgtacaccactcagagagcgtatcagaacaaaccaaactctacggtagcggaaacaaactaataaaagtacgctcctccaaataccaacaatcctttacccccaacccaggcgcccgccgcatagacttccactggctcctcctcgatcccaacgacacagtcacattcacattcaacggcgccttcatcgcaccagaccgcgccagcttcttccgaggcgagagcataggcgtccaaagcgacgctcccctagacagctcctgcgggggaaactgcttccacaatggcgggacaatagtctcctcactcccgttccaaaacatcaatccccgcaccgtcggcaaatgcccccgctacgttaaacagaaaagcctcctactcgccacaggcatgcgcaatgtacccgaaaaacccaagaaacgcggcctattcggcgccatagcaggcttcatcgaaaacggatgggaaggcctcatcaacgggtggtacggattcagacaccaaaacgcacaaggcgaaggaaccgccgccgactacaaatccacccaatcagcaatagaccaaatcactgggaaactcaacagactcataggcaaaaccaaccaacaattcgagctaatcaacaacgagttcaacgaagtcgaacaacaaataggaaacgtcataaactggacccaagacgccatgaccgaagtctggtcctacaacgcagaactcctcgtcgcaatggaaaaccaacacaccatcgacctcaccgactccgaaatgtcaaaactctatgaacgcgtccgaaaacaactccgagaaaacgcagaagaagacggcaccggctgcttcgagatcttccacaaatgcgacgatcactgcatggaatcaatccgcaacaacacatacgaccacacgcaatatagaacagaatccctccaaaaccgcatccaaatagacccagtcaagctcagcggcggctacaaagacatcattctctggttctcgttcggagcctcctgcttcctccttctagccatagccatggggctagtgttcatctgcatcaaaaacggaaacatgcaatgcaccatatgcatc

SEQ ID NO: 58880 - RNA, 1656 nt, synthetic construct
  misc_feature 1..1656: note = derived and/or modified sequence opt11 from anti-influenza_Chain
  source 1..1656: mol_type = other RNA
gaccaaatctgtatcggctaccacgccaacaacagtactgaacaagtcgacaccatcatggagaaaaacgtaaccgtcacgcacgcccaaaatatactcgaaaagacccacaacggcaaactgtgcgacctcgacggagtaaaacccctcatcctccgcgactgctccgtcgccggttggctactcggcaaccccatgtgcgacgagttcctcaacgtcccagaatggtcctacatcgtcgaaaagatcaaccctgcaaacgacctctgctacccaggcaacttcaacgactatgaagaactcaaacacctactctccagaattaaccacttcgagaaaatacaaataataccaaagtcatcttggtccgaccacgaagcctcgtcgggcgtatccagcgcatgcccctaccaaggacgctcatcattcttccgaaacgtcgtctggctaataaagaaagacaacgcataccccaccataaaacgatcctacaacaacaccaaccaagaagacctcctagtcctctggggcatacaccaccccaacgacgccgccgaacaaacacgactgtaccaaaatccaaccacatacatatccgtcggcacgtccacactcaaccaaagactcgtcccaaaaatagccacccgaagcaaagtcaacggacagagcggacgcatggaatttttctggacaatactcaaaccgaacgacgctatcaacttcgaatcaaacggcaacttcatagcccccgaaaatgcatacaaaatcgtcaaaaagggcgactccacaataatgaaatcagaactagaatacggcaactgcaacaccaaatgccaaacccccatcggcgcaatcaactcatccatgccattccacaacatacaccccctcaccatcggcgagtgccccaaatacgtaaagtccaacaaactcgtactagccaccggactccgcaactccccacaaggagaacgacgccgcaagaaacgaggcctcttcggcgccattgccggcttcatagaaggcggctggcagggaatggtggacggatggtatggttaccaccacagcaacgaacagggctccggctacgccgccgacaaagaaagtacccaaaaagccatcgacggcgtcaccaataaagtcaactccatcatcgacaagatgaacacacaattcgaagccgtaggtcgggagttcaacaacctcgaacgtcgaatcgaaaacctcaacaagaaaatggaagacggattcctagacgtgtggacatacaacgccgaactcctcgtactgatggaaaacgagcgcacactagacttccacgactcaaacgtcaaaaacctgtacgacaaaatcagactgcaactccgagacaatgctaaagaactaggcaacggatgcttcgagttctaccaccgctgcgacaacgaatgcatggaatccgtccgaaacggaacctatgactacccacaatacagcgaagaagcccggctaaaacgcgaagaaatctccggcgtcaaactcgaaagcataggcacctaccaaatcctatccatctactccacagtcgcctccagcctaacactagccataatggtcgctggactatccctatggatgtgcagcaacggctccctccaatgccgcatctgcatc

SEQ ID NO: 58881 - RNA, 1656 nt, synthetic construct
  misc_feature 1..1656: note = derived and/or modified sequence opt11 from anti-influenza_Chain
  source 1..1656: mol_type = other RNA
gaccaaatctgcatcggataccacgccaacaactccaccgaacaagtagacaccataatggagaagaacgtaaccgtgacgcatgcacaagacatactggaaaaaacccacaacggcaaactatgcgacctagacggcgtaaaacccctcatcctcagagactgctccgtagccggatggctcctcggtaaccccatgtgcgacgaattcatcaacgtcccagaatggtcctacatagtcgaaaaagccaacccaaccaacgacctctgctaccctggctccttcaacgactacgaagaactcaaacacctcctctcccgcatcaaccacttcgaaaaaatccagatcatacccaaatcatcctggtcagaccacgaggcgtcatccggcgtatcatccgcatgcccatacctcggatcaccctcattcttccggaacgtcgtgtggctaataaaaaaaaactccacctacccaaccattaagaagagctacaacaacacgaaccaggaagacctcctcgtactatggggcatacatcaccccaacgacgcagcagaacaaacccgtctataccaaaacccaaccacatacatctccatcggtacaagcacgctaaaccagcgcctcgtacccaagatagccacccggtccaaagtcaacggacaatccggccgcatggaattcttctggaccatcctcaaccccaacgacgccataaacttcgaatcaaacggcaacttcatcgcccctgaatacgcctacaaaatagtcaagaaaggcgactccgccatcatgaaaagcgaactcgaatacggcaactgcaacaccaaatgccaaacacccatgggcgcaatcaactcctccatgccgttccacaacatacacccactaaccatcggagaatgcccaaaatacgtaaaatcgaaccgtctcgtcctcgcaaccgggctacgaaactccccccaaagagaatccagacgaaaaaaacgcggcctcttcggcgcaatcgccggtttcatagaaggaggctggcaaggcatggtcgacggctggtacggctaccaccactcaaacgagcaaggctccggatacgcagccgacaaagaatccacccagaaagcaatcgacggcgtcaccaacaaagtcaacagcataatcgacaaaatgaacacacaattcgaggctgtaggccgcgaattcaacaacctcgaacgccgcatagaaaatctcaacaaaaaaatggaagacggcttcctagacgtatggacttacaacgcagaactactagtcctcatggaaaacgaacgcaccctggacttccacgacagcaacgtgaaaaacctctacgacaaagtccgactacaactccgagacaacgccaaagaactcggcaacggctgcttcgaattctaccacaaatgcgacaacgaatgcatggaatcgatcagaaacggcacatacaactacccccaatactccgaggaagcccgcctaaaacgcgaagaaatctccggtgtcaaactcgaatcaatcggcacataccaaatcctaagcatctactccactgtcgccagctcactagcgctggcaatcatgatggcaggcctatccctatggatgtgctcgaacggaagcctccaatgccgaatatgcatc

SEQ ID NO: 58882 - RNA, 1680 nt, synthetic construct
  misc_feature 1..1680: note = derived and/or modified sequence opt11 from anti-influenza_Chain
  source 1..1680: mol_type = other RNA
atgagcaacatggacatagactcaatcaacaccggaacaatcgacaaaaccccggaagaactcacgccaggcacgagcggcgcaacccgcccgataatcaaaccagcaaccctagccccaccctccaacaaacggacgagaaacccctcccccgaacgcacaacaacctcctccgaaaccgacataggccgcaaaatccagaagaaacaaacaccaaccgaaataaagaaatccgtctacaaaatggtcgtaaaactgggcgagttctacaaccaaatgatggtcaaagcaggccttaacgacgacatggaacgcaacctaatacaaaacgcgcaagcagtagaacgaatcctactcgccgcaaccgacgacaagaaaaccgaataccaaaagaaacgcaacgcccgagatgtcaaagagggcaaagaagagatagaccacaacaaaaccggtggcaccttctacaaaatggtacgagacgacaaaaccatctactttagcccaataaaaataaccttcctaaaagaagaagtaaaaacaatgtacaaaacaacgatgggcagcgacggcttctccggactcaaccacatcatgatcggacactcccaaatgaacgacgtatgcttccaacgcagcaaaggactaaaacgcgttggcctcgacccatccctcatttcaaccttcgccggctccaccctcccccgacgaagcggcaccacaggcgtagcaataaaaggaggcggcacgctggtcgacgaagccatccgcttcatcgggcgcgccatggccgaccgcggactcctccgcgacatcaaagcaaaaacagcctacgagaaaatactcctaaacctgaaaaacaaatgctccgcaccccaacaaaaagccctagtcgaccaagtcatcggcagccgaaaccccggcatagcagacatcgaagacctcaccctcctcgcccgctccatggtagtagtccgcccatcagtcgcaagcaaagtagtcctaccaataagcatatacgccaaaatcccccaactggggttcaacaccgaagaatactccatggtcggctacgaagccatggcactctataacatggcgacacccgtctccatcctgcgaatgggagacgacgcgaaagacaaatctcaactcttcttcatgtcatgcttcggcgcagcatacgaagacctgagagtcctgagcgccctcaccggaactgagttcaaacccagatcagcactcaaatgcaaaggcttccacgtgccagccaaagaacaggtcgaaggcatgggggccgccctcatgagcattaaactccaattctgggcccccatgaccagaagcggaggcaacgaagtatccggcgagggcggctccggacaaatatcctgcagccccgtcttcgcagtagaacgccccatcgccctctccaagcaagcagtcaggcgcatgcttagcatgaacgtagaaggccgggacgccgacgtcaaaggcaacctactaaaaatgatgaacgactccatggccaagaaaacatccggcaacgcattcataggcaagaaaatgttccaaatctcagacaaaaataaagtaaacccaatagaaataccaatcaaacaaacaatccccaactttttcttcggccgggacaccgccgaggactacgacgacctagattac

SEQ ID NO: 58883 - RNA, 1680 nt, synthetic construct
  misc_feature 1..1680: note = derived and/or modified sequence opt11 from anti-influenza_Chain
  source 1..1680: mol_type = other RNA
atgaacacgcaaatcctggcactgatcgcatatatgttaatcggcgccaaaggcgacaaaatatgccttggacaccacgccgtcgccaacggcacaaaagtcaacacactaacagagcgcggaatcgaagtagtcaacgccaccgaaacagtcgaaacagtcaacatcaagaaaatatgcacccaaggaaaaagacccaccgatctcggccaatgcggactactaggaacactcatcggcccgccccaatgcgaccagttcctcgagttcgacgccgacctcataatcgaacgcagggaagggacagacgtctgctaccccggaaaattcactaacgaagaatcactacgacaaatactccgcggctcagggggaatagacaaagaatccatgggattcacctacagcggcatccgcaccaacggcgtcaccagcgcctgccgacggagcggctcctctttctacgccgaaatgaaatggctcctctccaactccgacaacgccgccttcccccaaatgacaaaaagctaccgtaaccccaggaacaaaccggcactcataatctggggcgtccaccattccggctctgccacagagcaaaccaaactctacggaagcggcaacaaactcatcaccgtaggatccagcaaataccaacagtccttcacaccatcccccggtgcacgaccccaagtaaatggccagagcggacgcatcgacttccactggctcctcctagaccccaacgacaccgtcacattcacattcaacggtgccttcatcgcccccgaccgcgcctcattcttccgaggagaatcactcggggtccaatccgacgtcccgctcgacagcggctgcgaaggcgactgcttccactcccgaggcacaatagtcagcagcctcccattccaaaacatcaacccacgcaccgtgggcaaatgcccacgctacgtaaaacaaacaagcctgctactagccaccggcatgcgcaacgtacccgaaaatcccaaaaccagaggcctcttcggggccatagccggcttcatagaaaacggctgggagggtctcattgacggctggtacggcttccgccaccaaaacgcccaaggagaaggcacggcagcagactacaagtccacacaaagcgcaatcgatcaaataacaggaaaactgaaccggctcatagacaaaacaaaccaacaattcgaacttattgacaacgagttctccgaaatcgaacagcaaataggcaacgtcatcaactggacacgtgacagcatgaccgaagtctggtcatacaacgccgaactcctcgtcgccatggaaaaccagcacaccatcgacctagccgactccgaaatgaacaaactatacgaacgcgtccgcaaacaactgcgcgaaaacgccgaagaagacggcaccggatgcttcgaaatatttcacaaatgtgacgaccaatgcatggaatccatccgcaacaacacctacgaccacacacaatacagaacagagtcccttcaaaaccgaatccaaatcgaccccgtgaaactcagctccgggtacaaagacataatcctatggttctccttcggcgcatcatgcttcctcctactagccatagccatgggcctagtcttcatctgcatcaaaaacggaaacatgcggtgcacaatctgcatc

SEQ ID NO: 58884 - RNA, 1680 nt, synthetic construct
  misc_feature 1..1680: note = derived and/or modified sequence opt11 from anti-influenza_Chain
  source 1..1680: mol_type = other RNA
atgaacacacaaatactagccctaatcgcatgcatgctcatcggcgccaagggagacaaaatctgcctaggccaccacgcagtcgccaacggcacgaaagtaaacacactgaccgaacgaggaatcgaagtcgtcaatgctaccgaaacagtcgaaacagccaacatcaagaagatttgcacacagggcaaacgacccacggacctgggccaatgcgggctcctcggcaccctcatcggcccaccgcagtgcgaccaattcctagagttcgacgcagacctaatcatagaacgccgcgaaggcaccgacgtctgctaccctggaaagttcaccaacgaagaatcgctacgccaaatacttcgcggatcaggcgggatagacaaagaatccatgggattcacatacagcggcatacgcaccaacggcgccacctccgcctgccgacgcagcggaagctcattctacgccgaaatgaaatggcttctcagcaacagcgacaacgccgcattcccacaaatgaccaagagctaccggaacccccgcaacaagcccgcactaatcatatggggcgtccaccacagcggaagcgcgacagagcaaaccaaactatacggctcgggcaacaaactcatcaccgtgggctcctcgaaataccaacaatcattcacaccctcccccggcgcacgcccacaagtaaacggccaaagcggccgcatcgatttccactggctactgctagacccgaacgacacggtcacattcacattcaacggcgcattcatcgcaccggaccgcgcctcattctttcgaggaggatccctaggagtccaaagcgacgtgccgctcgactccggctgcgaaggagactgcttccacagcggcgggaccatcgtaagcagcctcccattccaaaacatcaacccacgcaccgtgggcaagtgcccccgatacgtcaaacaaaccagcctcctcctcgccacaggcatgcgcaacgtcccagaaaacccgaagacccgaggcctattcggcgccatagcggggttcatcgaaaacggctgggaaggcctaatcgacggctggtacggattcagacatcaaaacgcacagggcgaagggacagctgcagactacaaatccacccaaagcgccatcgaccagataaccggaaaacttaacaggctaatagacaaaaccaaccaacagttcgagctcatagacaacgagttcaacgaaatagaacaacaaataggcaacgtcatcaactggacccgagactccatgaccgaagtctggtcatacaacgccgaactcctagtcgccatggaaaaccaacacaccatcgaccttgcagattccgaaatgaacaaactctacgagcgagtacgcaaacaactaagagaaaacgccgaagaagacgggaccggatgcttcgaaatcttccacaagtgcgacgatcagtgtatggaatcaatccgaaacaacacctacgatcacacacaataccgcacagaatccctccagaaccgaatccagatcaacccggtcaaactatcctcgggatacaaagacatcatcctctggttctcgttcggagcctcatgcttcctcctcctagcaatcgccatgggccttgtcttcatatgcataaagaacggaaacatgaggtgcaccatctgcatc

SEQ ID NO: 58885 - RNA, 1680 nt, synthetic construct
  misc_feature 1..1680: note = derived and/or modified sequence opt11 from anti-influenza_Chain
  source 1..1680: mol_type = other RNA
atggaacgcatcgtactcctcctcgcaatagtatcccttgtcaaatccgaccagatctgcatcggctaccacgccaacaacagcacagagcaagtcgatacaatcatggagaaaaacgtcaccgtcacccacgcacaagacatactagagaaaacccacaacggaaaactctgcgacctagacggggtaaaaccactaatcctacgcgactgctcagtagccggctggctcctcggaaacccaatgtgcgacgaatttctcaacgtccccgaatggtcctacatcgtcgagaaaatcaacccggcgaacgacctatgctacccaggcaacttcaacgactacgaagaactaaaacacctcctatcacggataaaccacttcgaacgtatccaaataatccccaaatcatcgtggtcagaccacgaagcctcctccggcgtaagctccgcctgcccataccagggccgatcatccttcttccgcaacgttgtatggctcatcaagaaaaacaacgcatacccaaccatcaaacgatcttacaacaacaccaaccaggaagacctcctagtactctggggcatccaccatcccaacgacgcagcagaacaaacccgcctttaccaaaacccaaccacatacatatcagtgggaaccagcaccctcaaccaacgcctcgtccccaaaatagcaacccgtagcaaagtcaacggccaaagcgggcgcatggagttcttctggaccatactaaaacccaacgacgccatcaacttcgagagcaacggcaacttcatcgccccagaaaacgcctacaaaaactgccaaaaaggcgacagcaccataatgaaaagcgaactcgaatatggcaactgcaacacaaaatgccaaacccccatcggcgcaatcaattcatccatgcccttccacaacatacacccactcacaataggcgaatgcccaaaatacgtaaaatccaaccggctcgtactggcaacaggactacgaaactcaccccaaggcgaacgccgaagaaagaaacgcggactattcggcgcaatcgccggtttcatcgagggcggctggcaaggaatggtcgacggctggtacggctaccaccactcaaacgaacaaggatccggttacgccgccgataaagagtccacccaaaaagcaatagacggcgtaacaaacaaagtcaactcaatcatcgacaaaatgaacacccaattcgaggccgtcggacgcgagttcaacaacctagaacgacgaatcgaaaacctaaacaagaaaatggaagacggcttcctcgatgtgtggacatataacgcagaactcctagtactcatggaaaacgaacgcaccctagactttcacgacagcaacgtcaaaaacctatacgataaagtacgcctccaactacgagacaacgcaaaagaactaggaaacggatgcttcgaattttaccaccgatgcgacaacgaatgtatggaatccgtacgcaatggcacctacgactacccacaatactcggaagaagcccgactgaaacgcgaagaaatatccggggtaaaattagaatctataggcacctaccaaatactatccatctactctactgtagcatcatccctcgccctagcgatcatggtcgccggcctgtcactctggatgtgctcaaacgga

SEQ ID NO: 58886 - RNA, 1680 nt, synthetic construct
  misc_feature 1..1680: note = derived and/or modified sequence opt11 from anti-influenza_Chain
  source 1..1680: mol_type = other RNA
atgagcaacatggacatcgacagcataaacacaggcaccatcgacaaaacacccgaagaactaaccccaggaacaagcggcgcaaccagaccaataataaaacccgccacactcgcaccgcccagcaacaaacgcaccagaaacccgagcccagaaagaaccacaacctccagcgaaacagacatagggcgaaaaatacagaagaaacaaaccccaaccgagataaagaaaagtgtctacaaaatggtagtcaaactcggcgagttctataaccaaatgatggtaaaagctggcctaaacgacgacatggaacgaaacctcatccaaaatgcacaagcagtcgaacgcatactactcgccgccaccgacgacaagaaaaccgaatatcaaaagaaaagaaacgcccgcgatgtaaaagaaggtaaagaagaaattgaccacaacaaaaccgggggcacattctacaaaatggtccgagacgataaaacgatctatttctcgcccatcaaaatcacattcctcaaagaagaggtcaaaacaatgtacaaaaccacaatgggctccgacggcttctccggactaaatcacataatgataggccactcccaaatgaacgacgtatgtttccagcgaagcaaaggcctaaaaagagtagggctagaccccagcctaataagcaccttcgccggaagcaccctgccccgacgctccggaacaaccggggtcgccatcaaaggcggaggaaccctcgtcgacgaagcaatccgcttcatcggaagggcaatggcagaccgcggactcctcagggacatcaaagcgaaaacagcctacgagaaaatactactgaacctcaaaaacaaatgcagcgccccgcaacagaaagccctcgtcgaccaagtcattggctcgagaaacccaggaatcgccgacatcgaagatctcacactcctggccagaagcatggtagtcgtcagaccctcagtcgcgagcaaagtcgtactccccatcagcatctacgcaaagataccacagctgggattcaacacagaagaatactcaatggtaggctacgaggcgatggccctctacaacatggccactccggtaagcatcctacgaatgggcgacgacgccaaagacaaatcccaacttttcttcatgagttgcttcggcgcagcatacgaggacctgcgagtactatccgcccttaccggcaccgagttcaagccgaggagcgcactcaaatgcaaaggattccacgtaccagcaaaagaacaagtcgaaggaatgggtgccgcattaatgtccataaaactacaattctgggcaccaatgacccgaagcggcggaaacgaagtatccggagaagggggatccggacaaatatcctgcagccccgtcttcgccgtcgagaggcccatcgcactcagcaaacaagccgtccgccgcatgcttagcatgaacgtcgaaggacgcgacgccgacgtaaagggaaacctcctcaaaatgatgaacgactctatggccaagaaaactagcggcaacgccttcatcggaaagaaaatgttccaaatcagcgacaaaaacaaagtgaaccccatagaaattcccatcaaacaaacgatcccaaacttcttcttcggacgagacacagcagaagactacgacgacctcgactac

SEQ ID NO: 58887 - RNA, 1680 nt, synthetic construct
  misc_feature 1..1680: note = derived and/or modified sequence opt11 from anti-influenza_Chain
  source 1..1680: mol_type = other RNA
atgaatacacaaattctcgccctaatcgcctacatgctcatcggagctaaaggcgacaaaatatgcctcggccaccatgccgtagccaacgggaccaaggtaaacaccctcaccgaacgagggatcgaagtggtaaacgcaaccgaaaccgtagagacagtcaacataaagaaaatctgcacccaaggcaaacgccccacagacctaggccaatgcggcctcctcggcaccctaataggcccaccacaatgcgaccaattcctagagttcgacgccgacctaatcatagaacgacgagaaggaaccgacgtctgctaccccggcaaattcaccaacgaagaaagcctacgacaaatactccgaggatcaggcggcatcgacaaagaatccatgggattcacatactcaggaatccgcacaaacggcgtgacctcagcgtgtcgcagatccgggagctcattctacgccgaaatgaaatggctactaagcaacagcgacaacgcagccttcccacaaatgaccaaaagctaccgcaacccacgaaacaagcccgccctaatcatatggggcgtacaccactccggcagcgccacagaacaaaccaaactctacggcagcggaaacaagctaatcaccgtcggatcatcaaaataccaacaatcattcaccccatctccaggcgcccgcccccaagtcaacggacaatccggccgaatcgactttcactggctcctactcgaccccaacgacaccgtaaccttcaccttcaacggcgccttcatagcaccagaccgcgcatcattcttccgcggcgagtcactcggcgtacaatccgacgtccccctagactccggatgcgaaggagactgcttccactcaagagggacaatagtaagcagcctccccttccaaaacatcaacccccgaaccgtcggcaaatgcccaagatacgtaaaacaaacctccctgctcctcgccaccggaatgcgcaacgtaccagaaaacccaaaaacaagaggcctattcggcgccatagcaggtttcatagagaacggctgggaaggcctaatcgacggatggtacggcttccgccaccagaacgcacaaggagaaggcaccgccgccgactataaatcgactcagtccgccatagaccaaatcaccggaaaactaaaccgactaatcgacaaaaccaaccaacagttcgagctcatagacaacgagttcagcgaaatcgaacagcagatcgggaacgtcatcaactggacccgtgacagcatgaccgaagtctggtcatacaacgccgaactcctagtagcaatggagaatcaacacaccatcgacctcgcagactccgagatgaacaaactttacgaacgtgtccgcaaacaactcagagaaaacgccgaagaagacggcacaggatgcttcgaaatcttccacaaatgcgacgaccaatgcatggaatctatacgcaacaatacatacgaccacacccaataccgcacggaatccctccaaaatagaatacaaatcgaccccgtcaaactaagctccggctacaaggacatcatcctctggttctccttcggagccagctgcttcttacttctcgccatcgccatgggactcgtcttcatctgcatcaaaaacggcaatatgagatgcacgatctgcata

SEQ ID NO: 58888 - RNA, 1680 nt, synthetic construct
  misc_feature 1..1680: note = derived and/or modified sequence opt11 from anti-influenza_Chain
  source 1..1680: mol_type = other RNA
atgaacacgcaaatactagccctcatcgcgtgcatgctaataggtgcgaaaggcgacaaaatatgcctcggacaccacgcagtcgccaacggaaccaaagtcaacaccctcaccgaacgaggcatcgaagtcgtcaacgccactgaaacagtcgaaaccgcaaacattaagaaaatatgcacacagggaaaacgccctacagacctcggacaatgtggcctcctaggtaccctcatcggcccaccccaatgcgaccagttcctcgagttcgacgcagacctcatcatagaacgcagagaaggcaccgacgtttgctaccccggaaaattcacaaacgaggaatccctcagacaaatactacgaggatccggaggcatcgacaaagaaagcatgggattcacctactccggaatccgcaccaacggagccacctcagcctgcagacggtccggctcgtccttctacgccgaaatgaaatggctcctctctaactccgacaacgctgcattcccacaaatgaccaagagctaccgaaacccaagaaacaaacccgccctaatcatatggggcgtccaccactccggcagcgccaccgaacaaaccaaactctacggcagcggcaacaaactcatcacagtcggcagcagcaagtaccaacaatcattcaccccatcccctggcgcacggccgcaagtcaatggacaatcgggccgaatcgacttccactggctcctcctcgaccccaacgacacagtcaccttcacattcaacggcgccttcatcgccccagaccgggcctcattcttcagaggagggtccctaggcgttcaaagcgacgtccccctcgacagcggatgcgaaggcgactgcttccactcaggagggacaatcgtatcatccctacccttccaaaatataaacccccgcactgtcggaaaatgcccccgctatgtaaaacaaacaagtctcctcctcgccactggtatgagaaacgtcccagaaaaccccaaaacgagaggtctcttcggcgctatcgccggattcatagaaaacggctgggaaggactcatcgacggctggtacggcttccgccaccaaaatgcccaaggcgaaggtacagccgctgactacaaatccacacagagcgcaatcgatcaaataacaggcaaactcaaccgcctcatagacaagaccaatcaacaattcgaactcatcgacaacgagttcaacgaaatagaacaacaaatcggaaacgtcattaactggacccgcgactccatgacggaagtctggtcctacaacgccgaactactcgtcgccatggaaaaccaacacaccatagacctcgccgactccgaaatgaacaaactatacgaacgcgtacgcaaacaactacgagaaaatgcggaagaagacgggaccggctgcttcgaaatcttccacaaatgcgacgaccaatgcatggaatccatacgcaacaacacctacgatcatacacaatacaggaccgaatcgcttcaaaaccgaatccaaatcaaccccgtaaagctatccagcggctacaaagacataatactatggttcagcttcggcgcctcctgcttcctactcctcgccatcgcaatgggactcgtcttcatctgcatcaaaaacggcaacatgcgatgcaccatatgcatc

SEQ ID NO: 58889 - RNA, 1680 nt, synthetic construct
  misc_feature 1..1680: note = derived and/or modified sequence opt11 from anti-influenza_Chain
  source 1..1680: mol_type = other RNA
atggaacgaatcgtcctactcctcgcaatcgtctcccttgtcaaaagcgaccaaatctgcataggctaccacgccaacaatagcacagaacaagtagacactatcatggagaaaaatgtcacagtgacccatgcccaagacatcctagagaaaacgcacaacggaaaactatgcgacctggacggagtcaaacccctcatcctccgagactgctctgtcgccggctggctcctaggcaaccccatgtgcgacgagttcctcaacgtacccgaatggtcttacatcgtcgagaaaatcaaccccgccaacgacctatgctaccccggtaacttcaacgactacgaagaactaaaacacctactctctcgcatcaaccatttcgaaagaatccagatcatcccaaaatcctcctggagcgaccacgaagcctccagcggagtcagctccgcctgcccataccaaggccgatcttcattcttccgcaacgtcgtctggctgatcaagaaaaacaacgcataccccacaataaaacgctcctacaacaacacaaaccaagaagaccttctcgtcctctggggcatccaccaccctaacgacgccgccgaacaaacccgcctataccaaaacccaacaacatacatatcagtcggcaccagcaccttaaaccaacgcctcgtcccaaaaatagcaactcgaagcaaagttaacggccaatcaggtcgcatggagttcttctggacaatcctcaaacccaacgacgcaatcaacttcgaatccaacggaaatttcatcgcacccgaaaacgcatacaaaaattgccaaaagggagactcaaccataatgaaatcagaactcgaatacggcaactgcaacactaaatgtcaaacacccatcggcgcaatcaactcctccatgccattccacaacatccacccgctcaccataggagaatgccccaaatacgtcaaatcaaaccgactcgtcctagcaaccggactccgaaactccccacagggagaacgccgacgcaagaaacgaggtcttttcggagcaatagccggattcatcgaaggcggctggcaaggcatggtagacggctggtacggctaccatcactcaaacgaacaaggctccggctatgccgccgacaaagaatcaacccaaaaagccatagacggcgtcaccaacaaagtcaactccatcatagacaaaatgaacacacaattcgaagccgtcggcagagaatttaacaacctcgaacgacgcatcgaaaacctcaacaagaaaatggaagacggcttcctcgacgtctggacatataacgccgaactactcgtcctcatggaaaacgaacgcaccctcgacttccacgattcaaacgtcaaaaacctatacgacaaagtacgactccaactccgcgacaacgccaaagagctcggcaacgggtgcttcgagttctaccaccgatgcgacaacgaatgcatggaatccgtgcgcaacggcacctacgactacccccaatacagcgaagaagcacgcctcaaacgcgaagaaatatccggcgtaaaactagaatccataggaacataccaaatactatcaatctattccacagttgcctcctccctagcactcgccattatggtcgccgggctgagcctctggatgtgctctaacgga

SEQ ID NO: 58890 - RNA, 1686 nt, synthetic construct
  misc_feature 1..1686: note = derived and/or modified sequence opt11 from anti-influenza_Chain
  source 1..1686: mol_type = other RNA
atgccccgagccctccgtcgcgtcccaggttccagagtcatgctccgcgtaggcgtcgtcgtcgcagtactcgccctagtagcagccctcgcgaatttagccgtaccccgccccgcacgagccgctggaggcggctactggcacaccagcggcagagaaatacttgacgccaacaacgtgccagtacgcatcgccggaatcaactggttcggcttcgaaacctgcaactacgttgttcacggactctggtcacgcgactaccgatccatgctagaccaaatcaaatccctaggatacaacaccatccggctcccatactccgacgacatacttaaaccgggcaccatgcccaactccattaacttctaccaaatgaaccaagacctccaaggcctcacctcactacaggtaatggacaaaatagttgcatacgcaggccaaataggactccgcataatactagaccgccaccgccccgactgctccgggcagtccgccctctggtacacatcctctgtatcagaagccacatggatctccgacctccaagcccttgcccaacgctataaaggaaaccccacagtcgtaggcttcgacctccacaacgaaccccacgacccagcatgctggggatgcggagacccttccatcgattggcgcctcgcagcagaaagagccggaaacgccgttctctcagtcaacccaaacctactcatattcgtcgaaggtgtgcaatcctacaacggagactcctactggtggggcggcaacttacaaggcgccggccaataccccgtagtcctcaacgtacccaaccgcctcgtatactccgcccacgactacgctacctccgtctatccacaaacctggttcagcgacccaacattccccaacaacatgcccggcatctggaacaaaaactggggatacctcttcaaccaaaacatcgcacctgtatggctcggagagttcggcacaaccctacaatccaccacagaccaaacctggctcaaaacactcgtccaatatctccgacctaccgcccaatacggcgcagacagcttccaatggacattctggtcatggaacccagactccggagacaccggcggaatcttaaaagacgactggcaaacagtcgacaccgttaaagacggctatctcgcaccgatcaaatcatccatattcgaccccgttggcgcatccgccagcccctccagccaaccctcaccatccgtatcaccatctccctctccatccccatccgcctcccgcaccccgacccccacacccacaccaacagccagcccaacacccaccctcacacccaccgccacccccacaccaaccgcctcccccaccccatccccaaccgccgcctcaggagcacgctgtaccgccagctaccaggtcaactccgactggggcaacggcttcaccgtaacagtagccgtaaccaacagtggatctgtcgccaccaaaacttggaccgtctcctggacattcggaggcaaccaaacaataaccaactcctggaatgccgccgtcacccaaaacggccaatcagtcacagctcgcaacatgtcttacaacaacgtcatccaacccgggcaaaacacgacattcggctttcaagcctcctacaccggctccaacgccgccccaacagtcgcctgcgcagcatca

SEQ ID NO: 58891 - RNA, 1686 nt, synthetic construct
  misc_feature 1..1686: note = derived and/or modified sequence opt11 from anti-influenza_Chain
  source 1..1686: mol_type = other RNA
atggaacgcgtctggtggaaagaagcagtagtgtaccaaatctacccaaggtccttctacgacagcaacggcgacggcataggcgacatcagaggcataatagcaaaactcgactacctaaaagaacttggcgtcgacgtcgtctggctaagcccagtctacaagagccccaacgacgacaacgggtacgacatctccgattaccgagacatcatggacgagttcggcaccatggccgattggaaaacaatgcttgaagaaatgcacaaacgcggaatcaaactcgtcatggacctagtagtaaaccacacaagcgacgagcacccatggttcatcgaaagccgcaaaagcaaggacaacccgtacagagactactacatatggcgccccggcaaaaacgggaaagaaccaaacaactgggaaagtgtattctccggaagcgcatgggaatacgacgaaatgacaggcgagtactacctacacctgttcagcaagaaacaaccagacctcaactgggaaaaccccaaagtccgccgcgaagtctatgaaatgatgaaattctggctagacaaaggcgtcgacggattccggatggatgtgatcaacatgatcagcaaggtgcctgaactcccagacggcgaaccccaaagcgggaaaaagtatgccagcggaagccgctactacatgaacggcccaagagtccacgagttcctccaagaaatgaaccgagaagtcctcagcaaatacgacatcatgaccgttggcgaaacccccggcgtcacgcccaaagaaggcatcctatacaccgaccccagccgccgtgaactcaacatggtcttccaattcgaacatatggacctcgactccggccccggcggcaaatgggacataagaccatggagcctggcagacctcaagaaaaccatgaccaaatggcaaaaagaactcgaagggaaaggctggaactccctatacctaaacaaccacgaccaaccaagagcagtctcccggttcggcgatgacggcaaataccgcgtcgaaagcgcgaaaatgctcgccaccttcctacacatgatgcaaggcaccccatacatctaccaaggggaagagatcggcatgaccaacgtgcgcttcccaagcatcgaagactaccgggacatagaaacactaaacatgtacaaagaaagagtcgaagaatacggcgaagacccacaagaggtaatggagaaaatatactacaaaggacgcgacaacgcaagaaccccaatgcaatgggacgacagcgaaaacgccggattcacagccggaaccccctggatccccgtcaaccccaactacaaagaaataaacgtaaaagccgcactcgaagaccccaacagcgtcttccactactacaagaaactgatccaactccgaaaacaacacgacattatagtatacggcacctacgacctcatcctagaggacgacccctatatctaccgctacacacgaacactaggcaacgaacaactaatcgtaatcaccaacttctccgagaaaacaccggtcttccgcctccccgaccacataatctacaaaaccaaagaactcctaatctccaactacgacgtcgacgaggccgaagaactgaaagaaatccgcctaagaccctgggaagcccgcgtatacaaaatacgactaccc

SEQ ID NO: 58892 - RNA, 1686 nt, synthetic construct
  misc_feature 1..1686: note = derived and/or modified sequence opt11 from anti-influenza_Chain
  source 1..1686: mol_type = other RNA
atgccccgtgccctccgacgagtccccggctcacgagtaatgctccgcgtcggagtcgtcgtcgctgtccttgccctcgtcgccgcactagccaacctagcagtcccgcgaccagcccgcgcagccggcggaggatactggcacacaagcggacgagaaattctagacgcaaacaacgtacccgtcagaatcgctggcataaactggttcggcttcgaaacatgtaactacgtcgtacacggcctatggtcaagagactaccgcagcatgctagaccaaatcaaaagcctcggctacaacacaatccgtctcccctactctgatgacattctaaaacccgggacaatgcccaactccataaacttctaccaaatgaaccaagacttacaaggactcacatccctccaagtcatggacaaaatcgtagcatacgccggacaaatcggcctccgaatcatactcgaccggcatcgacccgactgctcaggccaatcagctttatggtacacctcgtcagtctcagaagccacctggatctccgacctccaagccctcgcacaacgctacaaaggaaatcccacagtcgtcggcttcgaccttcacaacgaaccacatgaccctgcctgctggggctgcggcgacccatccatagactggcgacttgccgccgaacgagcaggcaacgccgtcctatccgtcaaccccaacctcctcatattcgtagaaggagtacaatcctacaacggcgactcctactggtggggcggcaacctccaaggagcaggccaataccccgtcgtcctcaacgtccccaaccgacttgtctactcagcccacgactacgcaacctcagtatacccccagacatggttctccgatccaaccttccccaacaacatgccaggcatatggaacaaaaactggggttacctcttcaaccaaaacatcgctcctgtatggctcggagaatttggcacaacactacaatcaacaaccgaccaaacatggctaaaaaccctagtccaatacttacgtcccacagcccaatacggagccgactccttccaatggaccttctggagctggaaccccgactccggagatacaggcggcatcctcaaagacgactggcaaacagttgacaccgtgaaagacggctacctcgcccctatcaagtcctcaatattcgaccccgtcggcgcaagcgcctcaccctcctcccaaccatcaccctccgtctcaccatccccttcaccctcaccaagcgcctcacgaacccccacccctacccccacccctacagcctcaccgacccccaccctaactcccaccgcaacccccaccccaacggcctcaccaaccccaagccctaccgccgcctccggcgcacgctgcaccgcttcctaccaagtaaactcagactggggaaacggatttaccgtaaccgtcgccgtcacaaactcaggctccgtcgcaacaaaaacatggaccgtatcttggacattcggcggtaatcaaaccatcaccaacagctggaatgccgcagtcacccagaacggccagagcgtcactgcccgaaacatgtcctacaacaacgtcatacaacccggccagaacaccaccttcggattccaagcatcctacacgggcagcaacgccgcccctaccgtagcctgcgcagcaagc

SEQ ID NO: 58893 - RNA, 1686 nt, synthetic construct
  misc_feature 1..1686: note = derived and/or modified sequence opt11 from anti-influenza_Chain
  source 1..1686: mol_type = other RNA
atggaacgcgtctggtggaaggaggccgtcgtataccaaatctacccacgatcattctacgacagcaacggcgacggaatcggcgacatccgaggcatcatagccaaactcgactacctcaaggagctcggcgtagacgtagtttggctcagccccgtctataaaagccccaacgacgacaacggctacgacatatccgactaccgagacatcatggacgagttcggcacaatggccgactggaaaacgatgctcgaagaaatgcacaaaagaggcatcaaactcgtcatggacctagtcgtcaaccacaccagtgacgaacacccctggttcatagaatcccgaaaatcaaaggacaacccctaccgagactactacatctggcggccaggcaaaaacggcaaagaacccaacaactgggaatcagtcttctccggctcagcctgggagtacgacgaaatgaccggcgaatactacctacacctcttcagcaagaaacagccagacctcaactgggaaaacccgaaagtccgccgagaagtatacgaaatgatgaaattctggctagacaagggcgtagacggcttccgcatggacgtcataaacatgatcagcaaagtccctgaactccccgacggagaaccccagtccggcaagaaatacgcctccgggtcgcgttactatatgaacggaccccgcgtccacgagttccttcaagaaatgaaccgagaagtcctatcaaaatacgacatcatgaccgtcggggaaaccccgggagtaacccccaaagaaggcatactatacaccgacccaagccgccgcgaactcaacatggtattccaattcgaacacatggacctggactccggaccaggcggaaaatgggacatccgcccctggtcactggccgacctcaagaaaacaatgaccaaatggcagaaagaactagaaggcaagggctggaactccctctatctcaacaaccatgaccaacccagggccgtctccagattcggagacgacggcaagtaccgcgtcgaatccgccaaaatgctcgccacattcctacacatgatgcaagggacaccatacatataccaaggcgaagaaataggcatgaccaacgtccgattcccgtccatcgaagactaccgagacatcgaaacactcaacatgtacaaagaacgcgtagaagaatacggcgaagacccacaggaagtcatggaaaagatatactacaaaggcagagacaacgcacgcacccccatgcaatgggacgactccgagaacgcgggcttcacagccggaaccccttggatccccgtcaaccccaactacaaagaaatcaacgtaaaagcagccctcgaggacccaaacagcgtattccactactacaagaaactcatacaactccgcaaacaacacgacatcatagtctacggaacatacgacctcatcctagaagacgacccctacatctatagatacacaagaaccctaggcaacgaacaactaatagtcataaccaacttctccgagaaaacgcccgtgttccgactaccagaccacatcatatacaaaacaaaagaactcctcataagcaactacgacgtcgacgaagccgaagaactcaaggagatacgactacgaccatgggaagcacgcgtatacaaaatccgcctcccc

SEQ ID NO: 58894 - RNA, 1689 nt, synthetic construct
  misc_feature 1..1689: note = derived and/or modified sequence opt11 from anti-influenza_Chain
  source 1..1689: mol_type = other RNA
atggagaaaatagtcctacttttcgcgattgtctccctagtcaaatccgaccaaatatgcatcggctaccacgcgaacaactcgacagaacaagtcgacacaataatggaaaagaacgtaaccgtaacccacgctcaagacatactcgagaaaaagcacaacggaaaactatgcgacctagatggcgtcaaacccctaatcctccgcgactgctcagtcgcaggctggcttctcggcaaccccatgtgcgacgagttcatcaacgtccccgaatggtcgtacatcgtcgaaaaagccaaccccgtcaacgacctgtgctacccaggagacttcaacgattacgaagaactcaagcacctactatcacggatcaaccacttcgagaaaatccaaatcatacccaaaagctcctggagcagccacgaagcgtcactcggcgtctcatcggcctgcccgtaccaaggcaaaacctcattcttccgcaacgtcgtctggctaatcaagaaaaactctacctaccccacaatcaaacggtcctacaacaacaccaaccaagaagacctgctagtactctggggcatccaccacccaaacgacgccgccgaacaaacgaaactgtaccaaaacccaaccacttacattagcgtcggcacatccaccctcaaccaacgactcgtgccccgtatcgccacccgatccaaagtcaatggacaatccggccgcatggagttcttctggaccatcctaaaaccaaacgacgccataaacttcgaatccaacggaaacttcatcgcaccagaatacgcctacaaaatagtcaagaaaggcgactccacaataatgaaatcggaactcgaatacggcaactgcaacacaaaatgccaaacccccatgggagcaatcaactcatccatgccattccacaacatccaccccctaaccatcggagaatgccccaaatacgtcaaatccaaccgcctcgtcctcgccaccgggctccgcaacagcccccaacgcgaaactcgcggactcttcggcgccatagcgggctttatcgaaggaggctggcagggcatggtagacggttggtacggctaccaccactccaacgaacagggctcaggctacgccgcggacaaagaatccacacaaaaagccatcgatggcgtgaccaacaaagtgaactccatcatcgacaaaatgaacacacaattcgaagccgtaggcagagagttcaacaacctcgaaagacgaatcgaaaacctaaacaagaaaatggaagacggcttcctggacgtctggacatacaacgccgaactcctcgtactcatggaaaacgaaagaaccctagacttccacgacagcaacgtcaaaaacctatacgacaaagtacgcctacaactccgagacaacgccaaagaactggggaacggctgcttcgaattttaccacaaatgcgacaatgaatgcatggaaagcgtcagaaacggtacatacgactacccacaatacagcgaagaagcacgcctcaaaagggaagaaatctccggcgtgaaactcgaatccatcggaatataccagatactctccatctactcgaccgtcgcatccagtctagcactagccataatggtcgccggcctaagcctctggatgtgctccaacggaagcctccaatgccgcatctgc

SEQ ID NO: 58895 - RNA, 1689 nt, synthetic construct
  misc_feature 1..1689: note = derived and/or modified sequence opt11 from anti-influenza_Chain
  source 1..1689: mol_type = other RNA
atggaaaaaatcgtcctactattcgcgatcgtaagcctcgtcaaatccgaccaaatatgcatcggctaccacgcaaacaacagcaccgaacaagtagacaccataatggaaaagaacgtcaccgtaacccacgcccaggacatactcgagaagaaacacaacggcaaactctgcgacctagacggagtcaagcccctcatcctacgggactgctccgtcgcaggctggctactcggaaacccaatgtgcgacgaattcatcaacgtgccggagtggtcctacatagtagaaaaggccaaccccgtcaacgacctctgctacccaggcgacttcaatgactacgaagaactcaaacacctactaagtagaatcaatcatttcgaaaaaatacaaatcatccccaaatccagctggtcaagccatgaagcatccctaggcgtgagctcagcatgcccctatcaagggaaaacgagcttcttcagaaacgtggtatggctcataaaaaaaaacagcacctacccgacaatcaaacgcagctacaacaacaccaaccaagaagacctcctcgtcctatggggaatccaccacccgaacgacgccgcagaacaaaccaagctctaccaaaaccccacaacctacatcagcgtaggaaccagcacactcaaccaacgtctagtcccccgaatagctacgcgcagcaaagtgaacggccagtccggcaggatggaattcttctggaccatactaaaacccaacgacgccataaacttcgaatccaacggcaacttcatagcccctgagtacgcctacaaaatcgtcaaaaaaggagacagcacaataatgaaatccgaactcgaatacggcaactgcaacacaaaatgccaaacccccatgggagccataaacagctccatgccattccacaacatccaccccctcaccatcggcgaatgccccaaatacgttaaaagcaaccgactggtcctcgccacaggcctccgcaatagcccccaacgcgaaacacgcggactattcggagccatcgctggcttcatcgaaggcggatggcaaggcatggtcgacggctggtacgggtaccaccacagcaacgaacaaggcagcggctacgcggccgacaaagaaagcacccaaaaagcgatcgacggagtaaccaacaaagtcaacagcataatagacaaaatgaacacccaattcgaagctgtagggagagagttcaacaacctggaaagacgcatagaaaacctaaacaaaaaaatggaagacggcttcctcgacgtctggacatacaacgccgaactgctcgtactaatggaaaacgaacgcacactagacttccacgacagcaacgtcaagaacctctacgacaaagtacgactgcagctccgcgacaacgccaaagagctcggcaacggatgcttcgagttctaccacaaatgcgacaacgaatgcatggaatcagtacggaacggcacctacgactacccccaatactccgaagaagcccgcctgaaacgagaagaaatcagcggagtcaaactagaatccatcggcatctaccagatactaagcatatacagcaccgtcgcctccagcctggcactggcaataatggtagccgggctcagcctatggatgtgctccaatggcagtctacagtgcagaatctgc

SEQ ID NO: 58896 - RNA, 1692 nt, synthetic construct
  misc_feature 1..1692: note = derived and/or modified sequence opt11 from anti-influenza_Chain
  source 1..1692: mol_type = other RNA
atggaaaagatagtcctactcttcgcaatcgtctcactcgtcaaatccgaccaaatctgcataggttaccacgcaaacaactccacagaacaggtagacaccataatggagaaaaacgtcaccgtcacccacgcacaagacatcctagagaaaacacataatggaaaactctgctccctcaacggcgtaaaacccctcatcctccgcgactgcagcgtagctggatggctactcggaaaccccatgtgcgacgaatttctcaacgtcccagaatggtcctacatagtcgaaaaagactcccccatcaacgggctctgctaccccggagacttcaacgactacgaagaactaaaacatttactgtcctccaccaaccacttcgaaaagatacagatcataccacgcagcagctggtccgaccacgacgcctcctcaggcgtgtcctccgcatgcccctacaacggccgctcatccttcttccgaaacgtcgtctggctcataaagaaaaacaacgcctatcccacaatcaaaaggaactacaacaacacaaaccaagaagacctactcgtactctggggcatccaccacccgaacgacgccaccgaacaaaccaaactataccaaaaccccacaacatacgtctccgtaggtacctccaccctaaaccaaagatccgtcccagaaatcgccacccgacccaaagtaaacggccaatcgggccgcatcgagttcttctggaccatactcaaaccaaacgacgccatcaacttcgaatccaacggcaacttcattgcccccgaatacgcctacaaaatcgctaagaaaggagactcagccatcatgaaatccggcctagaatacggcaactgcaacacaaaatgccaaacaccaatgggagccatcaactcaagcatgccattccacaacatccaccccctaaccataggcgaatgcccgcggtacgtcaaaagcgaccgactcgtcctagcaacaggcctacgcaacgtcccccaacgagaaacacgcggattattcggcgccatcgccggcttcatcgaaggcggctggcaaggcatggtagacggatggtacggataccaccactcaaacgaacagggaagcggatacgctgccgacaaagaaagcacgcaaaaagccatcgatggaataaccaacaaagtcaactccataatagacaaaatgaacacccagttcgaagcagtcggcaaagagttcaacaacctcgaacgacgcatcgaaaacctcaacaagaaaatggaagacgggttcctagatgtctggacatacaacgccgaactcctggtactcatggaaaatgaacgcacactcgacttccacgacagcaacgtcaaaaatttatacgacaaagtccgcctacaactacgagacaacgccaaagaactaggcaacggctgcttcgagttctaccacaaatgcgatgacgaatgcatggaatcagtacgaaacgggacctacgactacccccaatactccgaagaagcccgactaaacagagaagaaataagcggcgtcaaactcgaaagcatcggcacataccaaatcctctctatatactccaccgtagcctcgtctctcgcgctcgcgatcatggtggcaggcctctcattctggatgtgcagcaacggttccctccagtgcagaatatgcatc

SEQ ID NO: 58897 - RNA, 1692 nt, synthetic construct
  misc_feature 1..1692: note = derived and/or modified sequence opt11 from anti-influenza_Chain
  source 1..1692: mol_type = other RNA
atggagaaaatagtactcctcttcgcaattgtcagcctcgtaaaatccgaccaaatctgtatcggataccacgccaataacagcaccgaacaagtcgacaccatcatggaaaagaatgtgaccgtcacccacgcacaagatatcctagagaaaacacataacggaaaactctgcagcctaaacggagtaaaacccctcatcctccgagactgctcagtagctggctggctactcggaaaccccatgtgcgacgaatttctaaacgtccccgaatggtcctacatcgtggaaaaagacagccccatcaacggcctttgctaccccggcgacttcaacgactacgaagaactcaaacacctactctcatccactaaccacttcgagaaaatacagatcatcccccgttcatcctggtcagaccacgacgcctcctcaggcgtgagcagcgcctgcccttacaacggacgctcctcattcttccgcaacgtcgtctggctaatcaagaaaaacaacgcctacccgaccataaaacgcaactacaacaacaccaaccaggaagatctactcgttctatggggcatacaccaccccaacgacgcgaccgaacaaaccaaactctatcaaaaccccactacctacgtcagcgtcggcacaagcacactaaaccagcgaagcgtccccgaaatcgcaacacgcccaaaagtcaacggccaatctgggcgcatcgaatttttctggaccatccttaaacccaacgacgccatcaacttcgaatcaaacggcaacttcatagcacccgaatacgcctacaaaatagccaagaaaggcgactcagcaatcatgaaatccggcctcgaatacggaaactgcaacaccaaatgccaaaccccaatgggtgccataaacagctccatgcccttccacaacatccatccactcaccatcggcgaatgcccaagatacgtaaaatccgacagactcgtcctcgccaccggcctcagaaacgttccacaacgcgaaacccgaggcctattcggagccatcgccgggttcatcgaaggcggctggcaaggaatggtagacggctggtacggataccaccactccaacgaacaaggatcaggatacgctgcggacaaagaatccacccaaaaagccatcgacggcataacaaacaaagtaaacagcatcattgacaaaatgaacactcagttcgaagcagtcggcaaagagttcaacaacctcgaacgaagaatagaaaatctcaacaagaaaatggaagacggcttcctcgacgtctggacctacaacgcagaactcctcgtactcatggaaaacgaacgcaccctcgacttccacgattcaaacgtcaaaaacctctacgacaaagtccgcctccagctccgagacaacgccaaagaactcggaaacggctgcttcgagttctaccacaaatgcgacgacgaatgcatggaatcagtccgtaacggcacctacgattaccctcaatacagcgaagaagcccgcctcaaccgtgaagaaatctccggcgtcaaactagaaagcattggcacttaccaaatcctctcgatatactccacagtagcaagctccctagccctagccataatggtcgccggactctctttctggatgtgcagcaacggatcactacaatgccgcatctgtatc

SEQ ID NO: 58898 - RNA, 1695 nt, synthetic construct
  misc_feature 1..1695: note = derived and/or modified sequence opt11 from anti-influenza_Chain
  source 1..1695: mol_type = other RNA
atggaaaaaatcgtcctcctcttcgccatcgtctcccttgtcaaatccgaccaaatatgcatcgggtaccacgcaaacaactccaccgaacaagtcgacacaatcatggagaaaaacgtaaccgtaactcacgcccaagacatcctcgaaaaaaaacacaacggcaaactatgcgacctcgacggagtcaaacctctgatcctccgcgactgctccgtcgcagggtggctactaggcaacccaatgtgcgacgaattcattaatgtccccgaatggtcatacatcgtagagaaagcgaaccccgtcaacgacctatgttaccccggggacttcaatgactatgaagagctcaaacacctactatcccgcataaaccacttcgaaaaaatccaaatcatccctaaatcatcctggtcatctcacgaggcctccttaggcgtgtccagcgcctgcccgtaccaaggcaagtcctcattcttccggaacgtcgtctggctcatcaaaaaaaactctacataccccaccataaaacgaagctacaacaacaccaaccaagaagacctactcgtcctctggggaatacaccaccccaacgacgcagccgaacaaacaaaactctaccaaaaccccacgacctacatctcagttggcacatccaccctcaaccaacgtctcgtcccacgtatagcaacacgaagcaaagtcaacggacagagtggacgtatggaattcttctggaccatcctaaaacccaacgacgcgatcaacttcgaaagcaacggaaacttcatagcccccgaatacgcatacaagatcgtaaaaaaaggcgattctaccatcatgaaatccgaactagagtacggcaattgcaacaccaaatgccaaactcccatgggcgcgatcaactcctccatgccattccacaacatacaccccttgaccataggcgaatgccccaaatacgtcaaaagcaaccgactcgtcctcgccaccggtctacgcaactccccacaacgagagcgccgccgaaaaaaacgcggcctcttcggagccatagccggatttatcgagggcggctggcaaggcatggtcgacggctggtacggctaccaccatagtaacgaacaaggctccggctacgccgccgacaaagaatccacgcagaaagctatcgacggagtcaccaacaaagtaaactcaatcatcgacaagatgaacacccaatttgaagcagtcggccgagaattcaacaacctcgaacgacggatcgaaaacctcaacaaaaaaatggaagacggattcctcgacgtctggacatacaacgccgaactccttgtgctaatggagaacgaacgcaccctagacttccacgacagcaacgtaaagaacctctacgacaaagtccggctccaactccgcgacaatgccaaagagctcggcaacgggtgcttcgaattctaccacaaatgtgacaacgaatgcatggagtccgtacgcaacggcacgtacgactacccccaatactccgaggaagcccgactcaaacgcgaagaaatcagcggcgtcaaactcgaatccataggaatataccaaatactctccatctacagcacggtagcatcctccctagcactagcaataatggtagcaggcctctccctctggatgtgctccaacggctccctccaatgccgc

SEQ ID NO: 58899 - RNA, 1695 nt, synthetic construct
  misc_feature 1..1695: note = derived and/or modified sequence opt11 from anti-influenza_Chain
  source 1..1695: mol_type = other RNA
atggagaaaatcgtactcctcttcgccatcgtaagcttggtaaagtcagaccaaatctgcatcggctaccacgcaaacaactcaaccgaacaagtcgacaccatcatggaaaaaaacgtcaccgtaacccacgcccaagacatcctggaaaagacacacaacggaaaactctgcgacctcgacggagtcaagcccctcatcctccgagactgttccgtcgccggctggcttctcggcaaccccatgtgcgacgaattcatcaacgtacccgaatggtcgtacatcgtagaaaaagctaacccagtgaacgacctgtgctaccctggcgacttcaacgactacgaagaactcaaacacctcctctcacgcataaaccacttcgaaaaaatccaaatcatccccaaatcctcatggtcatcccacgaagctagcctcggagtctcctccgcttgcccataccaaggcaagtcctccttcttccgcaacgtcgtctggctcattaagaaaaactccacctaccccacaatcaaaagatcctacaacaacacaaaccaagaagacctcctcgtcctatggggaatccaccaccccaatgacgccgccgaacaaacaaaactctatcaaaaccccacaacctacatcagcgtgggcacatccacactcaaccaacgactcgtaccacgcatcgccacccgctccaaggtcaatggtcaatcaggccgaatggaattcttctggaccatcctcaaacccaacgacgccataaacttcgaaagcaacggcaacttcatcgcccccgaatacgcatacaaaattgtaaaaaaaggcgacagcactataatgaaatctgaactcgaatacggcaactgcaacaccaaatgccaaacaccaatgggcgcaatcaactcatccatgcctttccacaacatccatccactaaccatcggggaatgccccaaatacgtaaaatccaacagactcgtcctcgccaccggcctccgtaactcaccccaacgcgaaagacgccgaaaaaaaagagggctcttcggagccatcgccggcttcatcgaaggaggctggcaaggaatggtcgacggatggtacggctaccatcactcaaacgaacagggcagcggctacgccgcagacaaagaatccacccaaaaagccatcgacggcgtaaccaacaaagtgaactccatcatagacaaaatgaacacacaattcgaagctgtcggccgagaattcaacaatctggagcgacgaatcgaaaacctaaacaaaaaaatggaagacggcttcctcgacgtctggacctacaacgccgaactcctggtcctaatggaaaacgaaagaacactcgacttccacgactcaaacgtcaaaaacctctatgacaaagtcagactccaactccgagacaacgcaaaagaactcggcaacggatgcttcgaattctatcacaaatgcgacaacgagtgcatggaaagcgtccgcaacggcacctacgactacccccaatactccgaagaagcccgcctgaaacgagaagaaataagcggcgttaagctagaaagcatcggcatctaccaaatactctccatctactccaccgtcgcgagctccctcgccctcgcaataatggtcgcaggactctccctctggatgtgctcgaacggatccctacaatgccga

SEQ ID NO: 58900 - RNA, 1695 nt, synthetic construct
  misc_feature 1..1695: note = derived and/or modified sequence opt11 from anti-influenza_Chain
  source 1..1695: mol_type = other RNA
atggaaaagatagtcctactcctcgccatcgtatccctagtcaaaagcgaccaaatctgcatcggctaccacgctaacaactccaccgaacaagtcgacacaatcatggagaaaaacgtcaccgtgacacacgcccaagacatactagagaaaacccacaacggcaaactatgcgacctcgacggagtaaaacccctgatcctacgagactgcagcgtcgccggctggctcctcggcaacccaatgtgcgacgagttcatcaacgtcccggaatggtcctacatagtagaaaaagcaaacccagccaacgacctctgctaccccggcaacttcaacgactacgaagaactcaaacacctcctctcccgaatcaaccacttcgagaaaattcaaatcataccaaaatcgagctggagtgatcacgaagcctccagcggagtctcctcagcatgcccctaccaaggcaaaagctccttcttccgaaacgtggtctggctaataaagaaaaacagcagctacccgaccatcaaacgatcctacaacaacacgaaccaagaagacctcctcgtcctctggggcatccaccaccccaacgacgcagcggaacagacgagactgtaccagaaccccacaacatacatctccgtcggcacatccaccctaaaccaacgactcgtacccaaaatcgcgacccgctccaaagtgaacgggcaaagcggcaggatggaatttttctggacaatactcaaacctaacgacgccatcaacttcgaatcaaacggaaacttcatagcacccgaatatgcatacaaaatcgtcaagaaaggcgactccgccatcatgaaatccgaactagaatacgggaattgcaacacaaaatgccaaacccccatgggagcaatcaactcctccatgccgttccacaatatccacccactaaccatcggcgaatgcccaaaatacgtcaaaagcaacagactcgtactagccacaggcctccgaaactcaccccagcgagaacgccgccgcaagaaacgcggactattcggagccatcgcaggcttcatcgaaggaggctggcagggcatggtcgacggctggtacggctaccaccactccaacgaacaaggctccggctacgccgccgacaaagaatcaacccaaaaagccatcgacggcgtcaccaacaaagtcaactccatcatcgacaaaatgaacacccaattcgaagccgtcggacgggagttcaacaatctcgaacgacgcatagaaaacctcaacaagaaaatggaagacggattcctcgacgtatggacctacaacgccgaactactcgtactcatggaaaacgagcgaaccttagacttccacgactcaaacgtcaaaaacctatacgacaaagtccgcctccagctccgcgacaacgccaaagaactcggcaacggctgctttgaattttaccacaaatgcgacaacgaatgcatggaaagcgtccgcaacggtacgtacgactacccccaatattccgaagaagcccgcctaaaacgcgaagaaatctcgggcgttaaactagaatcaatcggaatataccaaatactctcaatctactccactgtcgcatctagtctggccctagccataatggtagccggactctccctatggatgtgctctaacggctctctgcaatgccga

SEQ ID NO: 58901 - RNA, 1695 nt, synthetic construct
  misc_feature 1..1695: note = derived and/or modified sequence opt11 from anti-influenza_Chain
  source 1..1695: mol_type = other RNA
atgtccgaccgcagacaaaaccgcaagacccccgacgaacaacgaaaagcaaacgcactcatcatcaacgaaaacatcgaagcgtacatcgcaatctgcaaagaagtcggcctcaacggcgacgaaatgctaatactagagaacggaatcgcaatcgagaaagcgatcaggatctgctgcgacggcaagtaccaagagaaaagagaaaagaaagccagggaagcccaacgggccgacagcaacttcaacgccgatagcataggcatacgactggtaaaacgagcgggctcaggcacgaacataacctaccacgccgtcgtagaactcacctcaagaagccgtatagtacagatactcaaatcacactggggcaacgaattaaaccgagcaaagatcgcaggaaaacgcctaggctttagcgccctattcgctagcaacctcgaagcaatcatataccaacgcggacgcaacgcagcacgaaggaacgggagcgcagaactgttcacattaacacaaggagcagggatcgaaacccgatacaaatggataatggaaaaacacataggcatcggagtcctaatagccgacgctaaaggactcatcaacggcaaaagagagggaaaaaggggcgtcgacgcgaacgtgaaactacgcgccggcacaaccggaagcccattagaacgcgccatgcagggcatcgaaaagaaagcattcccaggaccactccgagcccttgcccggagagtggtcaaagccaactacaacgacgcacgcgaagccctaaacgtaatcgcagaagcaagcctactcctgaaaccacaaatcactaacaaaatgaccatgccctggtgcatgtggctagcagcccgcctcaccctaaaagacgagttcgccaatttctgcgcctacgcaggtcgacgagcgttcgaagtgttcaacatcgcaatggagaaaatcggcatatgctcattccagggaaccatcatgaacgacgacgaaatcgaaagcatagaagataaagcgcaagtacttatgatggcgtgcttcggcctcgcctacgaagacttcagcctagtatcagcaatggtatcacaccccctcaaactacgaaaccgaatgaaaataggcaacttcagggtcggcgagaaagtctccaccgtcctatctccactactcaggttcacacgctgggcagagttcgcgcaacgattcgcactccaagcaaacacctcacgagaaggtgcacaaatctccaacagcgccgtattcgccgtcgaacgcaaaataaccaccgacgtgcaaagagtcgaagaactcctcaataaagtccaagcacacgaagacgaaccacttcaaaccctctacaagaaagtacgcgaacaaatatcaataataggccgaaacaaaagcgaaatcaaagagttcctcggcagctcaatgtacgacctaaacgaccaagagaaacaaaacccaatcaatttcaggtccggagcccacccgtttttctttgagttcgacccagactacaaccccatcagagtaaaaagacctaaaaagccaatagccaagcgcaacagcaatatctcaagactagaagaagaaggaatggacgaaaacagcgaaatcggccaagccaaaaagatgaaaccactcgaccagctcacatccacaagctccaacatcccagggaaaaac

SEQ ID NO: 58902 - RNA, 1695 nt, synthetic construct
  misc_feature 1..1695: note = derived and/or modified sequence opt11 from anti-influenza_Chain
  source 1..1695: mol_type = other RNA
atgaaagtcaaactcctcgtcctactctgcacattcaccgccacctatgccgacacaatctgcatcggctaccacgccaacaactccaccgacacagtcgacaccgtactcgagaaaaacgtaaccgtcacccactccgtaaacctcctcgaaaacagccacaacggaaaactgtgcctactaaaaggcatcgcaccccttcagctcggcaactgctcagtcgccggctggatactcggaaacccagagtgcgaactactcataagcaaggaatcatggtcatacatcgtcgaaaaaccgaacccagaaaacggcacatgctaccccggccacttcgccgactacgaagaactccgcgaacaactatcaagcgtcagctcctttgaacgattcgaaatcttccctaaagaatcatcctggcccaaccacaccgtaacaggcgtctccgcctcctgcagccacaacggagagtcctccttctaccgcaacctcctatggctcaccggcaaaaacggactttaccctaacctatcaaaatcctacgcaaacaacaaagaaaaagaagtcctcgtcctatggggcgtacaccacccgcccaatatcggagaccaaaaagcactctaccacaccgaaaacgcatacgtatccgtcgtatcatcccactacagcagaaaatttacacccgaaatcgcaaaacgcccaaaagtgagagaccaagaaggccgcatcaactaccactggacactactcgaacctggcgacaccataattttcgaagccaacggaaacctgatagcgccccgatacgcattcacactgagccgcggcttcggcagcggcataatcaactcgaacgcgcccatggacaaatgcgatgctaaatgccagaccccgcaaggcgccatcaactcgtccctgccttttcagaacgtgcaccccgtgaccataggagagtgccccaaatacgtccgctcagccaaactccgaatggtcacaggcctacgtaacatacccagcatccaatcacgcggcctcttcggcgccatcgccggcttcatcgaaggcggctggaccggcatggtcgacggctggtacggctaccaccaccaaaacgagcaaggatccggatacgccgctgaccaaaaatcgacacaaaatgccattaacggaatcaccaacaaagtaaactccgtaatcgagaaaatgaacacccaattcaccgcggtgggaaaagagttcaacaaactcgaacgacgcatggaaaacctcaacaaaaaggtcgacgacgggttcatcgacatatggacgtataacgccgaactcctagtccttctagaaaacgaacgaacgctagacttccacgactcaaacgtcaaaaacctatacgaaaaagtaaaaagccagctcaaaaacaacgccaaggaaatcggcaacggatgcttcgagttctaccacaaatgcaacgacgaatgcatggaatcggtcaaaaacggcacctacgactaccccaaatactccgaagaaagcaaacttaaccgagagaagatcgacggcgtaaaactcgaatccatgggtgtctaccaaatcctagccatctactcaacagtcgccagctccctcgtcctcctcgtatcgctgggagccatcagcttctggatgtgctcaaacggctcgcttcaatgccggatctgtatc

SEQ ID NO: 58903 - RNA, 1695 nt, synthetic construct
  misc_feature 1..1695: note = derived and/or modified sequence opt11 from anti-influenza_Chain
  source 1..1695: mol_type = other RNA
atgaaagtcaagctcctcgtcctcctatgcaccttcacagccacatacgccgacaccatctgcatcggctaccacgccaacaacagcaccgacacggtagacactgtcctagagaaaaacgtcacagtcactcacagcgtcaacctcctcgaaaactcccacaacggtaaactctgcctactcaaaggcatagcacccctacaactaggtaactgctccgtagccggctggatcctcggcaacccagaatgcgaactcctgatctcaaaagaatcctggtcctacattgttgaaaaacccaatccggaaaatggtacatgctatccaggtcactttgcagactatgaagaactccgagaacaactatctagcgtctcctcattcgaacgcttcgaaatcttccctaaagaatcgtcatggcccaaccacacagtaaccggcgtcagcgcctcctgctcccacaacggagaatcgtccttctaccgaaatctcctatggctaaccggcaagaacgggctctaccctaacctaagcaaaagttacgccaacaacaaagaaaaagaagttctcgtactatggggagttcaccacccacccaatattggagaccagaaaacactctaccacactgaaaacgcctacgtctccgtagtatcgtcccactacagtcgaaaattcacacccgaaatcgcaaaacgacccaaagtgcgtgaccaagaaggacgcatcaactattactggaccctcctcgaaccaggcgacaccataatcttcgaagccaacggaaacctcatagcgccccgctacgcgttcgccctatctcgaggcttcggctccgggatcatcaactccaacgcacccatggacaaatgcgacgcaaaatgccaaacaccacaaggcgcaatcaattcctctctccccttccaaaacgtgcaccccgtcaccatcggagaatgccccaaatacgtccgcagcgcaaaactccgaatggtcaccggcctaagaaacatccccagcattcaatcacgaggcctattcggcgctatcgccggattcatcgaaggcggatggaccggcatggtcgacggctggtacggctaccaccaccaaaatgaacaaggaagcggttacgccgcagaccaaaaatccacacaaaacgccatcaacggcatcaccaacaaagtcaacagtgtcatagagaaaatgaacacccaattcacagccgtcggcaaagagttcaacaaactcgaacgccgaatggaaaacctcaacaaaaaggtcgatgacggcttcatagacatctggacctacaacgccgaactcctcgtcttactcgaaaacgaacgcaccctcgacttccacgactccaacgtcaagaacctctacgaaaaagtcaaaagccaactcaaaaacaacgccaaggaaatcggcaacggatgcttcgagttctaccacaaatgcaacgacgaatgcatggaatctgtcaaaaacggcacgtacgactacccaaagtactcggaagaaagcaaactcaaccgagagaaaatcgacggtgtcaaactcgaatccatgggggtataccaaatcctcgccatctactcaacagtcgcctccagcctcgtcctactcgtcagcctgggagccatcagcttctggatgtgcagcaacggctccctccaatgccgaatctgcata

SEQ ID NO: 58904 - RNA, 1695 nt, synthetic construct
  misc_feature 1..1695: note = derived and/or modified sequence opt11 from anti-influenza_Chain
  source 1..1695: mol_type = other RNA
atgaaagtcaaacttctcgtcctactctgcaccttcaccgccacctacgccgacaccatctgcatcggctaccacgccaataactccacagacacagtcgacacagtcctagaaaagaacgtgaccgtcacacactccgtcaacctgctcgaaaacagtcacaatggcaagctatgcctgcttaagggcatagcacccctccaactcggaaactgctcggtcgccggttggatcctcgggaacccagaatgcgaactcctcatctcaaaagaatcctggtcttacatagtcgaaaaacccaacccagaaaacggcacatgttaccccggacactttgccgactacgaagaactgcgagaacaactctccagcgtcagctcattcgaacgcttcgaaatcttccccaaagaatcctcatggcccaaccataccgttacaggcgtcagcgcatcctgcagccacaacggcgaatcttctttctatcggaacctactatggctcacgggcaagaacggcctctacccaaacctttccaaatcgtacgccaacaacaaagaaaaagaagtactcgtactatggggagtccaccacccacccgacatcggagaccagaagaccctataccacaccgaaaacgcctacgtctccgttgtatcatcccactactcccgaaaattcacccccgaaatcgccaaacgccccaaagtccgggaccaagaaggccgcatcaactactactggacgctgctcgaacccggcgacaccatcatcttcgaagccaacggaaacctcatagcaccccgctacgccttcgccctctcccgaggcttcggatccggtatcatcaactcaaacgcacccatggacaaatgcgacgctaaatgccaaacaccccaaggcgcaatcaactcctcactacccttccaaaacgtccaccccgtcaccataggcgaatgcccaaaatacgtccgctccgcaaaacttcgcatggtcactggactccgcaacatcccctccatccaatcccgcggactattcggcgccatagcaggcttcatcgaaggcggctggaccggcatggtcgacggatggtacggttaccaccaccagaacgagcaaggctccggatacgcggcagaccaaaaatccacacaaaacgccatcaatggcatcacaaacaaagtaaactccgtcatcgagaaaatgaacacccaattcaccgcagtcggcaaagagttcaacaaacttgaacgccgcatggaaaacctcaacaagaaagtagacgacggcttcatcgacatatggacatacaacgccgaactcctagtcctcctagaaaacgaacgaaccctcgacttccacgactccaacgtgaaaaacctctacgaaaaagtaaaatcccaactcaagaacaacgccaaagaaatcggcaacggatgcttcgagttctaccacaaatgcaacgacgaatgcatggaatccgtcaaaaacggaacctacgactacccaaaatactccgaagaatcaaaactaaacagagagaaaatagacggcgtaaaactcgaatccatgggcgtctaccaaatcctcgctatctactccaccgtcgcctcctccttagttctcctcgtctccctaggcgccatctcgttctggatgtgctccaacggctccctccaatgcagaatatgcatc

SEQ ID NO: 58905 - RNA, 1695 nt, synthetic construct
  misc_feature 1..1695: note = derived and/or modified sequence opt11 from anti-influenza_Chain
  source 1..1695: mol_type = other RNA
atgaaggtaaaactgctcgtcctcctatgcaccttcacagcaacctacgccgacaccatatgcatcggctaccacgcaaacaactcaacagacacagtagacaccgtactcgagaaaaacgtcaccgtcacccactccgtcaacctcctcgaaaactcccacaacggaaaactatgcctgctcaaaggcatagctccccttcaactcggcaactgctccgtagccggctggatcctcggcaacccagaatgcgaactactcatctccaaggaaagctggagctacatcgtcgaaaaaccaaacccagagaacggaacctgctaccccggacacttcgccgactacgaagaactacgagaacagctctcaagcgtcagctcattcgagcgcttcgagattttcccaaaagaaagctcttggccaaatcacaccgttaccggcgtctccgcaagctgctcccacaacggagaatcctcattctacaggaacctactatggctcaccggcaaaaacggactctaccccaacctcagcaaatcctacgccaataacaaagaaaaagaagtcctggtactctggggagtccatcacccacccaacatcggagatcaaaaagccctataccacaccgagaacgcctacgtttccgtcgtcagcagccactacagccgcaaattcaccccagaaatcgcaaaacgtcccaaagtacgagaccaggaaggtcgcatcaactattactggaccctcctcgaaccaggcgacaccatcatattcgaagccaatggcaacctaatcgctccccgctacgccttcgccctctccagaggcttcgggtccggaatcatcaacagcaacgcccccatggataaatgcgacgccaagtgccaaaccccgcaaggagccatcaacagctccctacccttccaaaacgtacacccagtcaccataggcgaatgcccaaaatacgtccgatccgccaaactacgaatggtcacagggctccgcaacataccatcaatccaatcacgcggactattcggcgcaatagccgggttcatagagggcggctggaccggcatggtcgacggttggtacggctaccaccaccaaaacgaacaaggctccggatacgcagcagaccaaaaatcgacacaaaacgcgatcaacggaatcaccaacaaagtcaactcagttatcgagaaaatgaacacacaattcacagccgtcggcaaagagttcaacaaactcgaacgccgaatggaaaacctcaacaagaaagtcgacgatggattcatcgacatctggacatacaacgccgaactactcgtactcctcgaaaacgaacgcacactagacttccacgactccaacgtcaaaaacctctacgaaaaagtaaaaagccaactcaaaaacaacgccaaagaaatcggaaacggatgtttcgagttctaccacaaatgcaacgatgaatgcatggagtcagtcaaaaacggcacctacgactaccccaaatactcagaggagtccaaactaaatcgcgagaaaatcgacggagtaaagctcgaatccatgggcgtataccaaattctagccatatacagcacagtcgcaagcagcctagtactgctagtatcgctcggcgccatcagcttctggatgtgcagcaacggctccctacaatgccgaatctgcata

SEQ ID NO: 58906 - RNA, 1695 nt, synthetic construct
  misc_feature 1..1695: note = derived and/or modified sequence opt11 from anti-influenza_Chain
  source 1..1695: mol_type = other RNA
atgaaagcaaaactcctagtactactctgcaccttcacagccacctacgccgacaccatctgcatcggctaccacgccaacaactccaccgacaccgtagacaccgtcctagaaaagaacgtgaccgtaacccacagcgttaacctcctcgaagactcacacaacggaaaactctgcctcctcaaaggcatcgcacccctccaactcggaaactgctccgtcgccggctggatactaggcaaccccgaatgcgaactcctaatcagcaaagaatcctggtcatacatcgtcgaaacccccaacccagaaaacggcacttgctaccccggctacttcgccgattacgaagaactccgcgaacaactatcctctgtatcctctttcgaacgcttcgaaatattccccaaagaatcctcctggcccaaccacacagtcaccggcgtatcagccagctgttcccacaacggaaaatcctcgttttaccgcaacctcctttggttaaccggcaaaaacggcctctacccaaacctctccaaatcctacgtaaacaataaagaaaaggaggtactcgtactatggggagtacaccatccacccaacatcggcaaccaaagagccctataccacaccgagaacgcctacgtctccgtagtcagttcacactactcccgccgcttcaccccagaaatcgccaaacgccccaaagtccgcgaccaagagggacgcatcaactactactggaccctcctcgaaccgggagacacaatcatcttcgaagccaacggcaacctcatagcaccctggtacgccttcgccctctcacgcggcttcggctcaggcattattacatccaacgccccgatggatgaatgcgacgccaaatgccaaacaccacagggcgccatcaactcatcgctccccttccaaaacgtccaccccgtcaccataggcgaatgccccaagtacgtccgctcagccaaactacgtatggtcaccggcctccgaaacataccctccatccaaagccgaggactattcggcgcgatagccggattcatagaaggaggatggacaggcatggtcgacggctggtacggctaccaccaccaaaacgaacagggctccgggtacgccgcagaccaaaaatcaacccagaacgccataaacggcataaccaacaaagtcaactccgtaatcgagaaaatgaacacacaattcaccgcagtaggcaaagaatttaacaaactcgaacgacgaatggaaaacctcaacaaaaaggtcgacgacgggttcctcgacatatggacttacaacgccgaactcctcgtcctcctagaaaacgaacgcaccctcgacttccatgactcaaatgtcaaaaacctctacgaaaaagtcaaatcccaactcaaaaacaacgccaaagaaatcggcaacggctgcttcgagttctaccacaaatgcaacaacgaatgcatggaaagcgtcaaaaacggaacatacgactacccaaaatacagcgaagaatcaaaactaaaccgagagaaaatcgacggcgtcaaacttgaatcaatgggcgtataccaaatactcgcaatctactcaacagtcgcctcctccctcgtgctcctcgtgtccctcggcgccatctcattctggatgtgctccaacggctcactacagtgccgcatctgtatt

SEQ ID NO: 58907 - RNA, 1695 nt, synthetic construct
  misc_feature 1..1695: note = derived and/or modified sequence opt11 from anti-influenza_Chain
  source 1..1695: mol_type = other RNA
atgaaggtcaaactcctggtcctgctatgcaccttcaccgccacctacgcagacaccatttgcatcggataccacgctaacaacagcaccgacacagtcgacaccgtcctagagaaaaacgtcacagtaacccactcagtcaacctgctagaagacagccacaacggaaaactatgcctcctaaaaggcatcgccccactccagctaggcaactgtagcgtcgccggctggatactcggcaaccccgaatgcgaactcttaatcagcagagaatcctggtcatacatcgtagaaaaacctaacccagaaaatggaacgtgctaccccggacactttgccgactacgaagaactcagagaacaactctcttcagtttccagcttcgaacgcttcgagatcttccccaaagaaagcagctggcccaaccacacgaccacaggagtttccgccagctgcagccacaacggagaatcgtcattctacaaaaacctcctctggctcacaggaaagaacgggctctaccccaacctctccaaatcctacgccaacaacaaagaaaaagaggtactcgtactctggggcgtacaccacccgccaaacatcggcgaccaaagagccctataccataaagaaaacgcatacgtctcagtcgtaagctcccactatagccgcaaattcacccccgaaattgccaagcgcccaaaagtacgcgaccaggagggacgaatcaactactactggacactactagaaccgggcgacaccataatctttgaagcaaacggcaacctgatcgctccacgatacgccttcgcactctcacgcggcttcggcagcggcatcatcaacagcaacgccccaatggacgaatgcgacgccaaatgccaaacaccccaaggcgctatcaactcgtctctccccttccaaaacgtccacccagtcacgatcggcgaatgccccaaatacgtccggagcgccaaacttcgcatggtcaccgggctacgcaacatccccagcatacaatcccgagggctattcggcgcgattgccggattcatcgaaggcgggtggaccggtatggtcgacggatggtacggctaccaccaccaaaacgaacaaggttccggctacgcagccgaccaaaagtccacccaaaacgcaataaacggaattacgaacaaagtcaacagcgtaatcgaaaagatgaacacccaattcacagccgtcggaaaagagttcaataaactggaaaggcgcatggaaaacctcaacaagaaagtcgacgacggattcatagatatatggacctacaacgccgaactcctagtcctactagaaaacgaacgaaccctcgacttccacgacagcaacgttaaaaacctctacgaaaaagtcaaatcccaactcaaaaacaacgctaaagaaataggcaacggctgcttcgagttctatcacaaatgcaacgacgaatgcatggaatcagtcaaaaacggaacctacgactaccccaagtattcggaagaaagcaaactcaacagagagaaaatagacggcgtaaaactagaaagcatgggcgtataccaaatcctagccatctactcgaccgtagcatcctccctcgtacttctagtctccctaggagccatctcgttctggatgtgcagcaacggatccctacaatgccggatctgcatc

SEQ ID NO: 58908 - RNA, 1677 nt, synthetic construct
  misc_feature 1..1677: note = derived and/or modified sequence opt11 from anti-influenza_Chain
  source 1..1677: mol_type = other RNA
gacaaaatatgcatcggataccaaagcaccaactccaccgaaacagtcgacacactgacaaaaacaaacgtccccgtaacccaagcaaaagaactactccacaccgaacacaacggcatgttatgcgcaaccaacctaggccaccccctaatcctcgatacctgcaccatagaaggactcatatacggcaacccatcgtgtgacctactcctcggcggccgagaatggagctacatcgtagaacgaccgagcgccgttaacgggatgtgctaccccggaaacgtcgaaaacctcgaagaactccgactactattcagctccgcctcctcctaccaaagagtccaaatcttcccagacacaatatggaacgtaacatacagcggcacatcatcagcatgctcaaactccttctaccggagcatgcgctggctcacccagaaagacaatacctacccagtccaagacgcacaatacaccaacaaccgaggcaaatcaatcctcttcatgtgggggatcaatcacccgccaaccgacaccgtacaaaccaacttatacacacgcaccgacaccacaacctccgtcacaacagaggacataaaccgagcattcaaaccggtaatcggcccacgacccctcgtcaacggactacaaggacgaatcgactactactggtccgtcctaaaaccaggacaaaccttaagagtccggtccaacggcaacctaatcgccccatggtacggccacatcctatcaggcgaatctcacggacgaatcctcaaaagcgacctcaacagcggtaactgcgtcgtacagtgccaaaccgaaaggggcggactaaacaccacactaccattccacaacgtctcaaaatacgcctttggcaactgccccaaatacgtaggagtcaaatccctcaaactagcagtaggtatgcgcaatgtaccggccagatcatcacgcggactcttcggcgcaatcgccggattcatagaaggaggctggccaggcctcgttgcaggctggtacggattccaacactccaacgaccaaggagtaggcatggccgccgatcgagactccacccaaaaagcaatcgacaaaatcacaagtaaagtcaacaacatcgtagacaaaatgaacaagcagtacgaaataatcgaccacgagttcagcgaaatagaaacccgtctaaacatgatcaacaacaaaatcgacgaccaaatacaggacatctgggcctacaacgcagaactattagtcctactcgaaaatcaaaagacactagatgaacacgacgcaaatgtcaacaacctctacaacaaagtaaaacgagcactaggttccaacgccatggaagacggaaaaggatgcttcgaactctaccacaaatgcgacgaccgatgcatggaaacaatcagaaacgggacctacaaccgaggcaagtacaaagaagaaagcaggttagaacgacagaaaatagaaggagtaaaactcgaatccgaaggaacctacaaaagtggacgactcgtcccacgcggatcccccggctccggctacatacccgaagcgcccagagacggccaagcatacgtacgcaaagacggcgaatgggtcctcctatcgaccttcctcggaaaacccatcccgaaccccctacttggactagacagcaccggc

SEQ ID NO: 58909 - RNA, 1677 nt, synthetic construct
  misc_feature 1..1677: note = derived and/or modified sequence opt11 from anti-influenza_Chain
  source 1..1677: mol_type = other RNA
gacaagatctgcataggataccaatctaccaactcaaccgaaaccgtcgacaccctcaccaagaccaacgtccccgtaacccaggccaaagaacttctgcacacagaacacaacgggatgctatgcgccaccaaccttggccatccactaatactagacacatgcaccatcgaagggctcatctacgggaaccccagctgcgacctcctactgggcggccgcgaatggagctacatcgtcgaaagaccatccgccgtcaacggcatgtgctaccccggaaacgtagaaaacctggaagaactccgactactattctcctccgcctcgtcctaccaacgagtccagatattccctgacaccatctggaacgtaacctactccggcacctcatcagcctgcagcaacagcttctaccgatccatgcggtggctcacccaaaaagacaatacatacccagtacaagacgcccaatacaccaacaacagaggcaaatccatccttttcatgtggggcatcaaccatccccctaccgacaccgtacaaaccaacctatacacaagaacagacaccaccacctccgtcaccacagaagacattaaccgcgcattcaaaccagtaataggaccccgacccctcgtcaacgggctccaaggccggatcgactactactggtcagttctaaaacccggccaaaccctccgcgtccggagcaacggcaacctaatcgccccctggtatggccacatcctctccggcgaatcccacggacgaatactaaaatccgaccttaactccggcaactgcgttgtccagtgccaaacagaacgaggcggcctcaataccaccctcccattccacaacgtatccaaatacgcattcggaaactgccccaagtacgtcggcgtcaaatcactaaaactcgccgtcggcatgcgcaacgtaccggcaagaagcagccgaggcctattcggcgccatcgcaggattcattgaaggcggttggccaggcctagtcgcaggctggtacggattccaacactcaaacgaccaaggcgtcggcatggcagccgacagagactcaacacaaaaggccattgacaaaatcaccagcaaggtcaacaacatcgtcgacaaaatgaacaaacaatacgaaataatcgaccacgagttctccgaaatcgaaactcgactcaacatgatcaacaacaaaatagacgaccaaatacaggacatctgggcatacaacgccgagcttctcgtcctactcgaaaaccaaaagaccctcgacgaacacgacgccaacgtcaacaacctctacaacaaagtaaaaagagccctcggaagcaacgccatggaagacggcaaaggctgcttcgagctgtatcataaatgcgacgaccgctgtatggaaaccatccggaacggaacctacaaccgcggcaaatacaaagaagaatcccgcctcgaaagacaaaagatcgaaggagttaaactcgaatccgagggcacctacaaatcaggccgcctagtccctcgagggtccccgggctcaggctacattcccgaagcgccccgagacggccaagcctacgtacgcaaagacggcgaatgggtcctcctctccaccttcctcggaaaaccgatcccaaaccccctcctaggcctagactcaaccggg

SEQ ID NO: 58910 - RNA, 1695 nt, synthetic construct
  misc_feature 1..1695: note = derived and/or modified sequence opt11 from anti-influenza_Chain
  source 1..1695: mol_type = other RNA
atgtccgacagacgccaaaaccgaaagaccccggacgaacaacgaaaagcgaacgccctcataatcaatgaaaacatcgaagcctacatagcaatatgcaaagaagtcggactaaacggagatgaaatgctgatcctcgaaaacgggatcgcaatagagaaagccatacgcatctgctgcgacggaaaataccaagaaaaacgcgaaaagaaagcaagagaggcgcagagagcagatagcaacttcaacgccgacagcataggcatacgactggtcaaacgagcaggaagcggaaccaacataacataccacgccgtcgtagagttaacatcacgctcccgcatcgtacaaatcctaaaaagtcactggggcaacgaactaaacagagcaaaaatcgcgggcaaacgactgggcttctccgcactattcgccagcaacctcgaagccatcatctaccaaagaggccgcaacgccgcccgcagaaacggatccgcagaactattcacgctcacgcaaggcgccggaatcgagacgcgatacaaatggatcatggaaaaacacataggcatcggagtactgatagcagacgcgaaaggactaatcaatgggaaaagggaaggaaaacgcggcgtcgacgcgaacgtaaaactccgcgcaggcacgacagggagcccactagaacgcgcgatgcaaggtatcgaaaagaaagccttcccaggaccgctcagagccctagcccgccgcgtcgtcaaagccaactacaacgacgcccgggaggcactgaatgtcatcgccgaggccagcctgctactaaaaccccaaataaccaacaaaatgaccatgccatggtgcatgtggctagcggcacgcctaaccctcaaagacgagttcgcaaacttctgcgcatatgcaggacgccgcgcgttcgaagtcttcaacatcgcgatggagaaaatcggcatatgctccttccaaggcaccatcatgaacgacgacgaaatagaaagcatagaagacaaagcccaagtactaatgatggcatgcttcggcctagcctatgaagacttcagcctagtatcagcaatggtaagccaccccctcaaactacgcaaccggatgaaaataggaaacttccgagtcggtgaaaaggtatccaccgtcctaagcccgttactacgattcacacgctgggccgagttcgcccaaaggttcgccctccaagccaacacatccagagaaggcgcccaaatcagcaacagcgcagtcttcgccgtagaaaggaaaataaccaccgacgtacaacgcgtcgaagaacttctcaacaaagtccaagcgcacgaggacgaaccactacaaacactctacaagaaagtccgagagcaaatctctataataggccgcaacaaaagcgagatcaaagagttcctcggatcctcaatgtacgacctaaacgaccaggaaaaacaaaaccccatcaacttccgaagcggagcccaccccttcttcttcgagttcgacccagactacaacccaatacgagtcaaacgacccaaaaagccaatagctaaacgcaacagcaacatatcacggcttgaagaagaaggaatggacgaaaatagcgaaataggacaagcaaagaaaatgaaaccactagaccaactaaccagcacctccagcaacataccagggaaaaac

SEQ ID NO: 58911 - RNA, 1695 nt, synthetic construct
  misc_feature 1..1695: note = derived and/or modified sequence opt11 from anti-influenza_Chain
  source 1..1695: mol_type = other RNA
atggagaaaatcgtcctactcttcgcaatagtaagccttgtaaaaagcgaccagatctgcatcggctaccacgccaacaacagcaccgaacaagtagacaccataatggagaaaaacgtcaccgtaacccacgcccaggacatccttgaaaagaaacacaatggcaaactatgcgacttagacggcgtcaaacccctcatactccgtgactgctccgtcgcaggctggctcctaggcaacccaatgtgcgacgagttcatcaacgtcccagaatggtcctacatcgtcgaaaaagcaaaccccgtcaacgacctatgctaccccggcgacttcaacgactacgaagaactcaaacacctactgtctcgtataaaccacttcgagaaaatccaaatcatccccaagtcctcctggtccagccacgaagcatcccttggcgtctcttcagcatgcccataccaaggaaaatccagcttcttccgaaacgtcgtctggctgatcaaaaagaactcaacctacccgacaataaaacgctcctacaacaacaccaaccaagaagacctgctcgtactatggggcatacaccacccaaacgacgccgccgaacaaaccaaactataccagaaccccaccacatacataagcgtagggacaagcacactcaaccaacgcctcgtcccccgaatcgcaacacgctccaaggttaacggacagagcggccgaatggagttcttctggaccatcttaaaaccaaacgatgctataaacttcgaaagcaacggcaacttcatagctcccgaatacgcgtacaaaatcgttaagaaaggagactccaccatcatgaaatcagaactcgaatacggaaactgcaacaccaaatgccaaacccccatgggcgccataaacagctccatgccctttcacaatatccaccccctcaccattggagaatgcccaaaatacgtcaaatccaaccgcctcgtcctcgccacaggcctccgaaactcaccccaaagagaacgtcgacgcaagaaacgcggcctcttcggagccatcgcaggattcatagaaggtggatggcaaggcatggtcgacggctggtacggataccaccactccaacgaacaaggcagcggctacgccgcagacaaagaatcaacacaaaaagcaatcgacggcgtgaccaacaaagttaactcaatcatcgacaagatgaacacacaattcgaagccgtaggccgcgagttcaacaacctcgaacgccgaatcgaaaacctcaacaagaaaatggaagacggcttcctcgacgtctggacatataacgccgaactactcgtcctaatggaaaacgaacgaaccctagacttccacgacagcaacgtcaaaaacctctacgacaaagtgcgtctccaactacgagataacgccaaagaactcggcaacggatgcttcgagttctaccacaaatgcgacaacgaatgcatggaatccgtccgcaacggaacctacgactacccccaatactccgaagaagcccgcctaaaacgcgaagaaatatccggcgtcaaactcgaatcaataggcatataccagatcctcagcatctactccacagttgccagctccctcgcccttgctatcatggtagcgggcctatcactctggatgtgctcgaacggctctctccaatgccgc

SEQ ID NO: 58912 - RNA, 1695 nt, synthetic construct
  misc_feature 1..1695: note = derived and/or modified sequence opt11 from anti-influenza_Chain
  source 1..1695: mol_type = other RNA
atggagaaaatagtgctcctctttgccatcgtgtcccttgtcaaatccgaccagatatgcatcggctaccatgccaataactctaccgaacaagtagacaccatcatggaaaagaacgtcaccgtcacccacgctcaagacatcctcgagaaaacccacaacggcaaactctgcgacctcgacggcgtcaaacccctcatccttcgcgactgctccgtggccggatggctcctgggcaaccccatgtgcgacgagttcatcaacgtgcccgaatggtcctacatcgtcgaaaaagcaaacccagtcaacgatctctgctacccaggagacttcaacgactacgaagaactaaaacacctcctttcccgcatcaaccacttcgagaaaatccaaattatccccaaaagctcatggagctctcacgaagccagcctcggcgtctcctccgcctgcccctaccaaggaaaaagctcattctttcgaaacgtcgtatggctcatcaagaaaaactccacctaccctaccatcaaacgatcctacaacaatacaaaccaagaggacctcctagtgctctggggaatacaccacccaaacgacgccgccgaacaaacaaaactctaccaaaaccccaccacatacatatccgtcggcacaagcacccttaaccaacgcctcgtaccccgcatcgcaacaagaagcaaagtcaatggacagagcggccgcatggaatttttctggaccatcctcaaacccaacgacgccatcaacttcgagtcaaacgggaacttcatcgcaccggaatacgcatacaaaatcgtcaagaaaggagacagcaccatcatgaaatccgaactagaatacggcaactgcaacactaaatgccaaaccccaatgggcgccataaactccagcatgccattccacaacattcaccccctaaccataggtgaatgccccaaatacgtcaaatccaaccgcctggtcctcgccaccggccttcgcaactcaccccaacgagaacgccgccgaaagaaacgcggcctcttcggagccatcgccggctttatcgagggtggatggcaaggcatggtcgacgggtggtacgggtaccaccactccaacgaacaaggctccggctacgcagcagacaaagaaagtacccaaaaagccatcgacggcgtcacaaacaaagtaaacagcataatcgacaaaatgaacacacaattcgaggccgtcggccgcgagttcaacaatctcgaaagacgcatcgaaaacctcaacaagaaaatggaagacggcttccttgacgtatggacctacaacgcagaactcctcgtcctcatggaaaacgaacgcaccctcgacttccacgacagcaacgtcaaaaacctctacgacaaagtacgcctacaactccgagataacgccaaagaactcggcaacggatgcttcgagttctaccacaaatgcgacaacgaatgcatggaatccgtacgcaacggaacctacgactacccccaatacagcgaagaagcacgcctgaaacgagaagaaataagcggcgtcaaactggaatcgataggaatctaccaaatcctctccatatactcaacagtcgcctcctccctcgccctagccatcatggtcgccggcctaagcctatggatgtgctcaaacggcagcctccaatgccgc

SEQ ID NO: 58913 - RNA, 1695 nt, synthetic construct
  misc_feature 1..1695: note = derived and/or modified sequence opt11 from anti-influenza_Chain
  source 1..1695: mol_type = other RNA
atggaaaagatcgtcctcctcctagccatcgtctcactcgtgaaaagcgatcaaatatgcatcggataccacgcaaacaattccaccgaacaagtcgacaccataatggagaaaaacgtaacggtcactcacgcgcaagacatcctcgagaaaacccacaatggcaaactgtgcgacctcgacggcgtcaaacccctcatcctaagagactgcagcgtagccggatggctactaggaaacccaatgtgcgacgaatttatcaacgtacccgaatggtcttacatagtcgaaaaagccaaccccgccaacgacctctgctaccccggtaacttcaacgactacgaagaactcaaacacctcctcagccgcatcaatcacttcgagaaaatacaaataatccctaaaagctcctggtctgaccacgaagccagctccggcgtctcctccgcctgcccctaccaaggcaaatcctccttcttccgcaacgtagtctggctcatcaaaaagaactcatcgtaccccaccatcaaacgatcgtacaataacaccaaccaagaagacctacttgtactctggggaatacaccacccaaacgacgccgcagaacaaaccagactataccaaaaccccaccacctacatctccgtaggcaccagcacactgaaccaacgacttgtacccaaaatcgctactcgatccaaagtcaacggacaatcaggacgcatggagttcttctggacgatactaaaaccaaacgatgccataaacttcgaatccaacggcaacttcatcgcacctgaatacgcctacaaaatcgtcaaaaagggcgactcagcaataatgaaatccgaactagaatacggaaactgcaacacgaaatgccaaacaccgatgggagccatcaactcatccatgcccttccacaacatacacccactaacaataggcgaatgcccaaaatacgtaaaaagcaaccgcctggtactagccacagggctccggaacagcccacaacgagaacgccgccgcaagaaaagaggcctgtttggagcgatcgccggattcatcgaaggcggatggcaaggcatggtcgacggatggtacggctaccatcactccaacgaacaaggaagcggttacgcagccgacaaagaaagcacccaaaaagccatcgacggagtcaccaacaaagtcaactccatcatagacaagatgaacacacagttcgaagcagtcggacgcgagttcaacaaccttgaacgtcgaatagaaaacctaaacaaaaagatggaagacggcttcctagacgtctggacctataacgcagaactccttgtcctcatggaaaacgaacgcacactcgacttccacgattccaacgtcaaaaacctctacgacaaggtccgcctccaactccgagacaacgcaaaggaactcggcaacggctgcttcgagttctaccacaagtgcgacaacgaatgcatggaatcagtccgcaacggaacctacgattacccccaatacagcgaagaagcccgcctcaaacgagaagaaatctccggagtaaaactcgaatccatcggaatataccaaatactgagcatctactccacagtagcgtcatccctcgcacttgccatcatggtcgccggcctatcgctatggatgtgctcaaacggctccctccaatgccgc

SEQ ID NO: 58914 - RNA, 1695 nt, synthetic construct
  misc_feature 1..1695: note = derived and/or modified sequence opt11 from anti-influenza_Chain
  source 1..1695: mol_type = other RNA
atgaaggtcaaactcctcgtcttactctgcacattcaccgccacatacgcagacacaatctgcatcggctaccacgcaaataactcaaccgacaccgtcgacacagtactcgagaaaaacgtgaccgtcacccacagcgtcaacctccttgaaaactcgcacaacggcaaactctgcctcctaaaaggcatcgcacccctccagctcggcaactgcagcgtagccggctggatcctcggaaaccccgaatgcgaactactcattagtaaagaaagctggtcctacatagtagaaaaaccaaaccccgaaaacgggacctgctaccccggccacttcgccgactacgaggaactccgcgaacaactcagctccgtctccagtttcgaaagattcgaaatattccccaaagaaagctcttggcccaaccacactgtcacaggcgtatccgccagttgcagccacaacggagaatcatcattctaccgcaacctactatggctcacaggaaagaacgggctctaccccaacttatccaaatcctacgcaaacaacaaagaaaaagaagtcctagtcctatggggcgtccaccacccacccaacatcggcgaccaaaaagcactctaccacaccgaaaacgcctacgtttcagtcgtcagctcgcactacagccgaaagttcacaccagaaatcgccaaacgtcccaaagtccgcgaccaagaaggccgcattaactaccactggaccctactcgaacccggagacacaataatattcgaagccaacggcaacctaatcgcaccccggtacgccttcaccctatcccgaggcttcggctccggcatcatcaacagcaacgccccaatggacaaatgcgacgccaaatgccaaacaccccaaggagcaataaacagctccctacccttccagaacgtccacccagtaaccatcggagaatgcccaaaatacgtccggagcgccaaactccgtatggtcaccggcctacgcaacataccctcaatacagagcagaggactcttcggagccatagcaggattcatcgaaggcggctggaccggaatggtcgacggatggtacggctaccaccaccaaaacgaacaaggatccggctacgccgcagaccaaaagtcgacccaaaacgcaatcaacggaatcaccaacaaagtcaacagtgttatagagaaaatgaacactcagttcaccgcagtcggaaaagagttcaataaactagaacgtcgcatggaaaacctaaacaagaaagtcgacgacggattcatcgacatctggacctataacgccgaacttcttgtcctgctggaaaacgaacgaaccctcgatttccacgactccaacgtcaaaaacctttatgaaaaagtaaaaagccagctcaaaaacaacgcgaaagaaatcggaaacggctgcttcgagttctatcacaaatgcaacgacgaatgcatggaaagcgtcaaaaacggcacatacgactaccccaaatactcggaagaaagcaaactcaaccgagagaaaatagacggcgtaaaacttgaatctatgggcgtctaccaaatactcgccatatacagcaccgtcgcaagctccctcgtactgctcgtaagcctgggagcaatcagcttttggatgtgcagcaacggctccctccaatgccgtatctgcata

SEQ ID NO: 58915 - RNA, 1695 nt, synthetic construct
  misc_feature 1..1695: note = derived and/or modified sequence opt11 from anti-influenza_Chain
  source 1..1695: mol_type = other RNA
atgaaagtcaaactcctggtccttctatgcaccttcaccgcaacctacgcagacacaatatgcatcggctaccacgccaacaactccactgacacagtagacaccgtcctcgagaaaaacgtcaccgtcacacactccgtcaacctcctagaaaacagtcacaacggcaaactatgccttctcaaaggcatagcacccctccaactcggcaactgctcagtcgccggctggatactcggaaaccccgaatgcgaattactcatctccaaagaatcctggtcatacatagtcgaaaaacccaaccccgaaaacggaacctgctaccccggccacttcgccgactacgaagaactccgcgaacaactcagttccgtctcgagcttcgaacgcttcgagatcttccccaaagaatcctcctggcccaaccatacagtcaccggcgtgtccgcctcatgctcacacaacggcgaatccagcttctaccgcaacctactctggctcaccggcaaaaacggcctataccccaacctaagcaaatcgtacgccaacaacaaagaaaaagaagtactggtcctgtggggcgtccaccaccctccaaacatcggcgaccagaaaacgctctaccacaccgaaaacgcctacgtctcagtcgtcagctcacactatagcagaaaattcaccccggaaatcgccaaacgcccaaaagtccgcgaccaagaggggcggataaactactactggacgctactggaacccggtgacaccatcatcttcgaagcaaacggtaacctaatcgctccccgatacgccttcgccctttcccgcggcttcggctccggaatcataaactccaacgccccaatggacaaatgcgacgccaaatgccaaacaccgcagggggccatcaactccagcttacccttccaaaacgtccacccagtcaccataggagaatgcccgaaatacgtccgatccgccaaactccgcatggtcacgggcctccgaaacatcccatccatccaatcccgcggcctattcggcgcaatcgccggtttcatagagggcggctggacaggcatggttgacggctggtacggataccaccaccaaaacgagcaaggctcaggatacgccgcagaccagaaatcaacccaaaacgcaataaacgggataacgaacaaagtcaactccgtaatcgagaaaatgaacacccaattcactgcggtcggaaaagagttcaacaaactggaacgtcgcatggaaaacctcaacaagaaagtcgacgacggattcatagatatatggacatacaacgccgaactccttgtactactcgaaaacgaacgcacgcttgatttccacgattcaaacgtcaaaaacctttacgaaaaagtcaaatcacaactcaaaaacaacgccaaagaaataggcaacggctgcttcgagttctaccacaaatgtaacgacgaatgcatggaatcggtcaaaaacggaacctacgactacccaaaatactccgaagaaagcaaactcaatcgagaaaagatcgacggggtaaaactagaatccatgggcgtataccaaatactggcaatctacagcaccgtcgcatcaagcctcgtcctactcgtcagcctaggggctatcagcttctggatgtgctcaaacggatcactccaatgccggatctgcata

SEQ ID NO: 58916 - RNA, 1695 nt, synthetic construct
  misc_feature 1..1695: note = derived and/or modified sequence opt11 from anti-influenza_Chain
  source 1..1695: mol_type = other RNA
atgaaagtaaaactactcgtcctcctctgcacattcaccgccacatacgcagacaccatatgcatcggctaccacgcaaacaacagcaccgacaccgtcgacacagtcctcgaaaagaacgtcaccgtgacccacagcgtgaacctcctcgaaaactctcacaacggtaaactctgcctcctcaaaggcatcgcccctctacaactaggaaactgcagtgtcgccggatggatactgggcaacccagaatgcgaactcttaatctccaaggaatcatggagctacatcgtagaaaaacccaacccggaaaacggtacctgctacccaggccacttcgccgactacgaagaactccgcgaacaacttagctccgtatccagcttcgaaagattcgaaatattcccaaaggaatcctcttggcccaaccacaccgtaacaggcgtcagcgcgtcttgctcccacaacggagaatcctccttctaccgtaacctcctatggctaaccggcaagaacggcctctaccccaacctatccaaatcctacgccaacaacaaagaaaaagaagtcctcgtactctggggcgtacatcacccacccgacatcggagaccagaaaacgctctaccacaccgaaaacgcctacgtctccgtcgtctccagccactactcccgcaaattcacccccgaaatcgcaaaaagacccaaagtccgcgaccaagaaggacgcatcaactactactggaccctactcgaacccggagacacaataatcttcgaggcaaacggaaacctcatcgccccacgatacgcctttgctctctcccgcggcttcggaagcggaatcattaacagcaacgccccaatggacaagtgcgacgccaaatgccaaaccccacaaggcgccatcaactcctccctacccttccaaaacgtacacccagtaacaatcggagaatgcccaaagtacgtccgtagcgcaaaactccgcatggtcaccggcctccgtaacataccgagcatacaatcccgcggtctcttcggcgctatcgccggcttcatcgaaggcggctggacaggaatggtcgacgggtggtacggctaccaccaccaaaacgaacaaggctccggatacgccgccgaccagaaaagcacacaaaacgccatcaacggaatcaccaacaaagtaaacagcgtaatagagaaaatgaacacccaattcaccgccgtaggcaaagagttcaacaaattagaacgacgtatggaaaacctcaacaagaaagtcgatgacggtttcatcgacatctggacatataacgccgaactccttgtactactcgaaaacgaacgcacactcgacttccacgactcaaacgtgaaaaacctctacgaaaaagtaaaatcacagctaaagaacaacgccaaagaaatcggcaacggctgcttcgagttctaccacaagtgcaacgacgaatgcatggaatctgtgaaaaacggaacctacgactaccccaaatactccgaagaaagcaaactaaaccgagaaaagatcgacggcgtaaaactcgaatccatgggtgtgtatcagatcctcgccatatattcgaccgtcgcctcctccctagtcctcctagtctccctaggcgcaatcagcttctggatgtgcagcaacggatccctacaatgccgaatatgtatc

SEQ ID NO: 58917 - RNA, 1695 nt, synthetic construct
  misc_feature 1..1695: note = derived and/or modified sequence opt11 from anti-influenza_Chain
  source 1..1695: mol_type = other RNA
atgaaagtaaaactactcgtcctcctctgcaccttcaccgcaacttacgccgacacaatatgcatcggctaccacgcgaacaacagcaccgacacagtcgacaccgtcctcgagaaaaacgtaaccgtcacccactcagtcaacctccttgaaaactcccacaacggaaaactctgcctactaaaaggcatcgcacccctacagctcggcaactgctcagtcgccggctggatcctcggcaacccggaatgcgaacttcttatcagcaaagaatcatggtcttacatcgtagaaaaacccaaccctgaaaacggcacttgctaccccggccatttcgctgactacgaggaactacgtgaacagctctcaagcgtctcatccttcgaaagattcgaaatcttccccaaagaatccagctggccaaaccacaccgtcaccggcgtgtccgcaagctgcagccacaacggcgagagctcattctaccgcaacctcttatggctcacaggtaaaaacggactctaccccaacctttccaaaagttacgcgaacaacaaagagaaagaagtcctggtactatggggcgtccaccatcccccaaacatcggcgaccaaaaagcgctataccacacagaaaatgcctacgtctcagtggtaagctcccactactcacgcaaattcacacccgaaatagccaaaagaccaaaagtccgagaccaagaaggcaggataaactactactggaccctcctagagccaggcgacaccatcatattcgaagccaacggaaacttaatagccccgcgatacgcatttgccctctcccgaggatttggctccggaatcatcaacagcaacgcccccatggataaatgcgacgccaaatgccaaactccccaaggcgccatcaactcttcacttccgttccaaaacgtccaccccgtaaccatcggagaatgccccaaatacgtacgatccgctaaactcagaatggtcaccggcctccgaaacataccatccatccaatctcgcggcctctttggtgcgatcgccggcttcatcgaaggcggatggaccggaatggtcgacggatggtacggctaccaccaccaaaacgaacaaggctccggctacgccgccgaccaaaaatccacccaaaacgccatcaacggaattaccaacaaagtcaactccgtcatcgagaaaatgaacacccaattcaccgcagtcggaaaagagttcaacaaactggaacgccgcatggaaaacctaaacaagaaagtcgatgacggattcatcgacatctggacctacaacgccgaactccttgtcctactcgaaaacgaacgcaccctcgattttcacgactccaacgtcaaaaacctctatgaaaaagtaaaaagccagctcaaaaacaacgccaaggaaatcggcaatggctgcttcgagttctaccacaagtgcaacgacgaatgcatggaaagtgtaaagaacggaacctacgactacccaaaatactcagaagaatccaagctaaaccgagaaaagatagacggcgtaaaactagaatccatgggcgtctaccaaatcctagctatatactccaccgtcgcctcctccctggtactcctcgtaagcctgggcgcaatctcattctggatgtgctccaacggctcccttcaatgccgcatctgcatc

SEQ ID NO: 58918 - RNA, 1695 nt, synthetic construct
  misc_feature 1..1695: note = derived and/or modified sequence opt11 from anti-influenza_Chain
  source 1..1695: mol_type = other RNA
atgaaggcaaaactattagtcctactatgcaccttcaccgcaacatatgccgacaccatctgcatcggctaccacgcaaacaactccaccgacacagtagacacagtcctcgagaaaaacgtcaccgtcacccactccgtgaacctcctggaagactcccacaacggcaagctatgcctactcaaaggcatagctcccctccagctcgggaactgctccgtcgccggctggatcctcggcaaccccgaatgcgaactactaatatccaaagaatcctggtcctacatcgtagaaacgcccaacccggaaaacggaacatgctaccccggatacttcgccgactacgaagaactacgcgaacaattatcctccgtctcatcctttgaacgcttcgaaatcttcccaaaagaatcaagctggcctaaccacaccgtaacaggtgtcagcgcgtcctgcagccacaacgggaaatcgtccttctaccgcaacctcctttggctaacgggcaagaacggactctacccaaacctctcaaaatcctacgttaacaacaaagaaaaagaagttcttgtcctatggggcgtccaccatccacccaacatcggcaaccaaagagcactctaccacaccgaaaatgcctacgtcagcgtagtcagctcccactactcccgccgcttcacacccgaaatcgcaaagcgccccaaagtccgcgaccaagaaggacgcataaactactactggacactcctggaacccggagacaccatcatcttcgaagcgaatggaaacctcatagccccctggtacgcgttcgcactgtcacgaggcttcgggagcggcatcatcacctccaacgcacccatggacgaatgcgacgcaaaatgccaaacaccacaaggagcaatcaactcatccctcccatttcaaaacgtacacccagtcaccatcggcgaatgccccaaatacgtacgtagcgccaaacttcgcatggtaaccggcctgcgcaacataccctccatccaatcacgcggactattcggcgcaatagccggcttcatcgaaggcggctggacaggcatggtagacggctggtacggctaccaccaccaaaacgaacaaggatcaggatacgcagctgaccaaaagagtacccaaaacgcaatcaacggcatcaccaacaaagtaaacagcgtgatcgagaaaatgaacacccaattcacagccgtcggcaaagagttcaacaaactcgaaagacgcatggaaaacctaaacaagaaagtcgacgacggattcctcgacatctggacatacaacgccgaactcctcgtcctactggaaaacgaacgtacactcgacttccacgacagcaacgtcaaaaacctatacgaaaaagtcaaatcacaactcaaaaacaacgccaaagagatcggcaacggctgcttcgagttctatcacaaatgcaacaacgaatgcatggaatcagtcaaaaacggaacatacgactaccccaaatactccgaagaatctaaactcaacagagagaaaatagacggagtaaaactcgaaagcatgggagtataccaaatactcgccatctactcaaccgtagcctcgtccctggtcctcctagtctcactaggagccatctccttttggatgtgcagcaacggatccctccaatgcagaatatgcatc

SEQ ID NO: 58919 - RNA, 1695 nt, synthetic construct
  misc_feature 1..1695: note = derived and/or modified sequence opt11 from anti-influenza_Chain
  source 1..1695: mol_type = other RNA
atgaaggtcaagctcctcgtcctactgtgcaccttcacagcaacttacgccgacaccatctgcatcggctaccacgccaacaacagcacagacacagtagacaccgtcctcgaaaagaacgtcaccgtcacacactccgtcaacctcctagaagacagccacaacggcaagctatgcctcctgaagggaatagcaccactacaactaggcaactgctcagtcgcaggatggatcctcgggaaccccgaatgcgaactcctcatatcccgagaatcctggtcatatatcgtagaaaaacccaaccccgaaaacggaacctgctaccccggccacttcgccgactacgaagaactccgagaacaactatcgtctgtctcctccttcgaacgcttcgaaatcttccccaaagaatcgagttggcccaaccacaccaccacgggcgtgtccgccagctgctcccacaacggcgaatccagcttctacaaaaacctcctatggctcactggcaaaaacggcctctacccgaacctcagcaaatcgtacgccaacaacaaagagaaagaagtcctcgtcctatggggcgtccatcacccgcccaacatcggggaccaacgcgccctataccacaaagaaaacgcctatgtttccgtagtcagctctcactactccaggaaattcacccctgaaatcgctaaacgtcccaaagtccgcgaccaggaaggccgcataaactactactggacactactcgaacccggcgacacaatcatcttcgaagccaacggcaacctaatcgctccccgctacgccttcgccctctcccggggattcggctccggcatcatcaactctaacgcccccatggacgaatgcgacgccaaatgccaaacaccccagggagccataaattcgagcctcccattccaaaacgtccaccccgtcacaataggcgaatgccccaagtacgtccgctcagccaaactcagaatggtcacaggacttcgaaacatccccagcatacaatcccgcggcctcttcggcgccatagccggcttcatcgaaggaggatggactggcatggtcgacggctggtacggctaccaccaccaaaacgaacaaggaagcggctacgccgcagaccaaaaatccacccagaacgcaatcaacggcatcaccaacaaagtcaacagcgtcatcgagaaaatgaacacccaattcacagccgtaggcaaagagttcaacaaactcgaacgacgaatggaaaacctcaacaagaaagtcgacgacggattcatcgacatctggacctacaacgccgaactactcgtactgctcgaaaacgaacgcacactcgacttccacgactccaacgtcaaaaacctctatgaaaaagtaaaaagtcaactcaaaaacaacgctaaagaaatcggaaacgggtgctttgagttctaccacaagtgcaacgacgaatgcatggaatcggtcaaaaacggtacctatgactatcccaaatactctgaagaatcaaaactaaaccgagagaaaatcgacggagtaaaactcgaaagcatgggcgtataccagatccttgcaatctactccaccgttgcctcctcactcgtcctactcgtaagcctcggcgccatctcattctggatgtgcagcaacggctccctccaatgcagaatatgcata

SEQ ID NO: 58920 - RNA, 1698 nt, synthetic construct
  misc_feature 1..1698: note = derived and/or modified sequence opt11 from anti-influenza_Chain
  source 1..1698: mol_type = other RNA
atgaagacaatcatcgcactatcctacattctctgcctagtattcgcccaaaaactccccggcaacgacaactcaaccgccacactatgtctaggccaccacgccgtaccaaatgggacaatagtcaaaaccatcaccaacgaccaaatcgaagtcactaacgcaaccgaactcgtccagagttcctcgacaggcggcatatgtgactctcctcaccaaatactcgacggcgaaaactgcaccctcattgacgcactcctcggagacccgcaatgcgacggattccaaaacaaaaagtgggacctattcgtggaaagatccaaagcctactcaaactgctacccctacgacgttcccgactacgcatcactccgctcccttgtagccagctccggcacactcgagttcaacaacgaatcattcaactggaccggcgttacccaaaacggaaccagctcagcctgcaaacgccgatccaacaacagcttcttcagccgactcaactggctcacccatctcaaattcaaataccctgccctaaatgtcaccatgcccaacaacgaaaaattcgacaaactttacatctggggcgtgcaccaccccgggaccgacaacgaccagattagcctctacgcccaagcatccggtcgcatcacagtcagcaccaaacgctcccaacaaaccgttataccctcgatcggatctagaccccgcatacgcgacgtaccctcgcgcatctccatatactggacaatcgtcaaaccaggcgacatcctcctaatcaactccaccggcaacctcatcgcaccccggggctacttcaaaatccgctccggaaagtcctccatcatgagatccgacgcccccatcggaaaatgcaactcagaatgcataacccccaatggaagcatccccaacgacaaacccttccaaaacgtaaaccgaataacctacggcgcctgccctcgatacgtcaaacaaaacacactaaaactcgcaaccggaatgcgcaacgtaccggaaaaacaaacccgcgggatattcggcgccatcgccggcttcatcgaaaacgggtgggaaggaatggtcgacggctggtacggcttccgccaccaaaactcagaaggcaccggacaagctgccgacctcaaaagcacacaagccgccataaaccaaataaacggcaaactcaaccgactcataggaaaaacaaacgaaaagttccaccaaatcgaaaaagagttctctgaagtcgaaggacgcatccaagatctagaaaaatacgtagaagacacaaaaatagacctctggagctacaatgccgaactccttgtcgccctcgaaaaccaacacaccatcgacctcactgactccgaaatgaacaagctattcgaaagaaccaagaaacaactcagagaaaatgcggaagacatgggcaacggctgcttcaaaatctaccacaagtgcgataacgcgtgcatcggctccatccgaaacggcacctacgaccacgacgtataccgagacgaagcgctgaacaaccgcttccaaatcaaaggagtcgaactcaaatccggatacaaggactggatcctatggatatccttcgccatctcctgctttcttctatgcgtcgccctcctcggtttcatcatgtgggcctgccaaaaagggaacatccgatgcaacatctgcata

SEQ ID NO: 58921 - RNA, 1698 nt, synthetic construct
  misc_feature 1..1698: note = derived and/or modified sequence opt11 from anti-influenza_Chain
  source 1..1698: mol_type = other RNA
atgaaaaccattatcgcgttatcctacatcctctgtctcgtaagtgcccaaaaattcccaggcaacgacaactcaacagccacactctgtcttggacaccacgccgtccccaacggaaccattgtaaaaacaataaccaacgaccaaatcgaagtaaccaacgccacagaactagtccaatcctcatcaaccggcgaaatctgtgactcaccacatcaaatcctcgacggcgaaaattgcaccctgatcgacgccctgctgggagacccccaatgcgacggattccaaaacaaaaaatgggacctattcgtagaacgctccaaggcctactccaactgctacccctacgacgttcccgactacgcatccctacgatccctagtagcctccagcggcactctcgaattcaacaacgaatccttcaactggacaggagtcacgcaaaacggcacctccagcgcctgcatccgccgctccaacaactcgttcttcagccgactgaactggctaacccacctcaaattcaagtacccagcactcaacgtaactatgcccaacaacgaagagttcgacaaactctacatctggggcgtccaccaccctgggaccgacaacgaccaaatcttcctctacgcccaagcctcaggacgcatcaccgttagtaccaagcgaagccaacaaaccgtcatcccgaacatcaggagccgcccacgcgttagaaacataccctcacgcatcagcatctactggaccatagtcaagcccggcgacatactccttataaactccacaggcaaccttatagcaccaagaggatacttcaaaatccgctcaggtaaatcctccataatgagatcagacgctccaatcggaaaatgcaacagcgaatgcatcaccccaaacggctcaataccaaacgacaaaccattccaaaacgtcaaccgaatcacctacggcgcctgcccccgttacgtcaaacaaaacaccctaaaactcgctacgggaatgagaaacgtcccagaaaaacaaacccgaggcatattcggagcaatcgccggcttcatcgaaaacggctgggaaggaatggtagacggctggtacggattccgccaccaaaactcggaaggcatcgggcaagccgccgacctcaaatccacacaggcagcaatcgaccaaataaacggcaaactaaaccgcctaatcggaaaaaccaacgaaaagttccaccaaatcgaaaaagaattctcggaagtcgaaggacgcatccaagatctcgaaaaatacgtagaagacaccaaaatagacctgtggtcctacaacgctgaactcctcgtcgccctcgagaaccagcacaccatcgacctcacagattccgaaatgaacaaactcttcgaaaagaccaaaaaacaactccgagaaaacgccgaagacatgggaaacggatgcttcaaaatctaccataaatgcgacaacgcctgcatcggttccattcgaaacggaacttacgaccacgacgtataccgcgacgaagccctaaataaccgcttccaaatcaaaggcgtcgaattaaaaagcggatacaaagactggatcctctggataagcttcgccatctcctgcttcctcctatgcgtcgccttactcggcttcataatgtgggcatgccaaaaaggaaacatacgatgcaacatatgcatc

SEQ ID NO: 58922 - RNA, 1698 nt, synthetic construct
  misc_feature 1..1698: note = derived and/or modified sequence opt11 from anti-influenza_Chain
  source 1..1698: mol_type = other RNA
atgaaaaccatcatcgcactcagctacatcctctgtctcgtcttcgcccaaaaactccccggaaacgacaactccacggccactctctgcctcgggcaccacgccgtccccaacggaacaatcgtcaaaaccatcacaaacgaccaaattgaagtcacaaatgccaccgaactggtacaaagcagcagcaccggcgaaatatgcgactccccacaccaaatcctggacggcgaaaactgcaccctcatcgacgccctcctaggcgacccccaatgtgatgggttccaaaacaagaaatgggacctcttcgtcgaacgctccaaagcatactcaaactgctatccctacgacgtccccgattacgcaagcctacgcagcctcgtcgcatcctccggcaccctggagttcaagaacgaatcattcaactggaccggcgttacacaaaacggcacgagcagcgcctgcatccgccgctccaacaattccttcttctcccgcctcaattggctcacccaccttaaatttaagtaccccgccctcaacgtaacaatgcccaacaaagaaaaattcgacaaactttacatctggggcgtccaccaccccggaacagacaacgaccaaatcttcctctacgcccaagcctcaggacgcatcaccgtaagcaccaaacgatctcaacaaacagtaatcccaaacatcggctcccgcctcagagtccgcgacatccccagccgcatctccatctactggacaatagtaaaaccaggagacatcctcctaataaacagcacaggaaacctaatcgcaccccgaggatacttcaaaatccgcagcggcaagtcctccataatgcgttccgacgccccaatcggaaaatgcaactcagaatgcataacacccaacggatccatccccaacgacaagcccttccaaaacgtcaaccgaataacatacggagcctgcccccgttacgtaaaacaaaacacactcaagttggccaccggaatgcgcaacgtccccgaaaaacaaacacgcggtatcttcggcgccatcgccggattcatcgaaaacggatgggaaggcatggtcgacggatggtacggattcagacaccaaaactcagaaggcacaggccaagcggcagacctcaaatccacgcaagcggccatcgaccagatcaacggaaaacttaacagactaatcggcaaaaccaacgaaaaattccaccaaatcgaaaaggagttctcagaagtagaaggacgcatccaagacctcgaaaaatacgtagaagacacaaaaatcgacctatggtcatacaacgcggaactcctcgtcgccctagaaaaccaacacacgatcgacctaacggacagcgaaatgaacaaactcttcgagaaaacgaagaaacaactccgggaaaacgccgaagacatgggcaacggctgcttcaagatctaccacaagtgtgacaacgcctgcataggaagtatccgcaatgggacctacgaccacgacgtatatcgggacgaagccctaaacaaccgattccaaatcaagggagtcgagctcaagtccggctataaagactggatcctatggatatcattcgccatctcctgcttcctcctatgcgtagccctcctaggcttcataatgtgggcctgccaaaaaggcaacatccgatgcaacatctgcata

SEQ ID NO: 58923 - RNA, 1698 nt, synthetic construct
  misc_feature 1..1698: note = derived and/or modified sequence opt11 from anti-influenza_Chain
  source 1..1698: mol_type = other RNA
atgaaaaccatcatcgccctcagctacatcctctgcctagtcttcgcccaaaagctccccggaaacgacaacagtacagccacactctgcctcggccaccatgccgtgcccaacggcacaatcgtgaaaacaataacaaacgaccaaatagaagtcaccaacgcaactgagctagtccaatcatcaagcaccggcgaaatatgtgacagtccccaccaaatactcgacggagaaaattgcaccctcatagatgcccttctaggcgacccccagtgcgacggattccaaaacaaaaagtgggacctattcgtggaacgctccaaagcctactccaaatgctacccatacgacgtcccagactacgcctccctaagatcccttgtagcctcctccggcaccctcgagttcaacaacgaatccttcaactggaccggcgtcacacaaaacggaacctccagcgcctgcatccgccgatccaacaacagcttcttctcccggctaaactggctcacccacctcaaattcaaatacccagccctcaatgtcacaatgcccaacaatgaaaaattcgataaactctacatctggggcgtccaccacccaggcaccgacaacgaccaaatcttcctctacgcgcaagcgagcggacgcataaccgtctcaaccaaacggtcccaacaaacagtaatcccgaacatcggctcacgccctcgagtccgcgacatcccctcccgcatcagcatctactggaccatagtcaaaccaggcgacatcctcctaatcaacagcacaggcaacctaatagcgccccgcggctacttcaaaatccgttcaggaaagtccagcatcatgcgctccgatgccccaatcggtaaatgcaactcagaatgcatcacccccaacggctccatccccaacgacaaacccttccaaaacgtcaaccgcataacatacggagcctgccccagatacgtaaaacaaaacaccttgaaactagcaaccggaatgcgaaacgtccccgaaaagcaaacccgtggaatctttggagccatcgccggcttcatagagaacggctgggaaggcatggtcgacggctggtacggcttccgccaccagaactccgaaggcatcggccaagcagccgacctcaaatccacccaagccgccatcgaccaaatcaacggtaaactcaatcgtctaatcggcaaaacaaacgagaagttccaccaaatagaaaaagagttctcagaggtcgaaggccgcatccaagacctcgaaaagtacgtggaagacacaaaaatagacctatggtcctacaacgccgaactactcgtagccctagagaaccagcacaccatcgacctgacagactccgaaatgaacaaactcttcgagaaaaccaagaaacaactccgcgaaaacgccgaagacatgggtaacggctgcttcaaaatctaccacaaatgcgacaacgcctgcataggctcaatcaggaacggaacatacgaccacgacgtataccgtgacgaagcactaaacaaccggttccaaattaaaggagtagaactcaaatccggatacaaagactggatcctgtggatctccttcgccatctcctgcttcttactctgtgtcgccctcctgggattcataatgtgggcatgtcagaaaggaaacatccgctgcaacatatgtatc

SEQ ID NO: 58924 - RNA, 1698 nt, synthetic construct
  misc_feature 1..1698: note = derived and/or modified sequence opt11 from anti-influenza_Chain
  source 1..1698: mol_type = other RNA
atgaaaactattatcgcactatcctacatcctatgcctcgttttcgcacagaagctccctggtaacgacaacagtaccgccaccctatgcctaggccaccacgccgtacccaacggaacaatcgtaaaaacaataaccaacgaccaaatcgaagtcacaaacgccaccgaactcgtacaatcctcatcaaccggcgaaatctgcgactcaccccaccaaatcctagacggagaaaactgcaccctaatagacgccctactcggcgacccccaatgcgacggcttccagaacaagaaatgggacctcttcgtagaacgatccaaagcctacagcaactgctacccctacgacgtccccgactatgcttccctacgaagcctcgtcgcctcctccggcaccctcgagttcaacaacgaatccttcaactggaccggcgtcacccaaaacggcacatcctccgcctgtatccgccgcagcaacaactccttcttctcccggcttaactggttaacccacctcaaattcaaataccccgcactcaacgtcactatgcctaacaacgaaaaattcgacaaactatacatatggggcgtgcaccaccccggcacagacaacgaccaaatcttcctatacgcacaagcatcaggccgaataacagtctccacaaaacgatcccaacaaacagtcatccccaacataggctcccgcccacgggtccgaaacatcccttcccgcatctccatctactggaccatcgtcaaacccggcgacattctcctcatcaacagcaccggaaacctaatagctccacggggctactttaaaatacgatcaggcaaaagctccataatgcgctcagacgcacccatcggcaaatgcaactcagaatgcataactccaaacggctccatccctaacgacaaaccattccaaaacgtcaaccgaataacatatggtgcctgcccccgttacgtcaaacaaaacacactcaaactagcaacaggcatgcgcaacgtacccgaaaaacaaacacgcggaatttttggcgcaatcgccggattcatcgaaaacggctgggaaggcatggtcgacggctggtatggattccgccaccaaaactcagaaggaatcgggcaagcagctgacctcaaatccacacaagcagccatcgaccaaatcaacggcaagctcaaccggctcatcggcaaaaccaacgaaaaattccatcaaatcgaaaaggagttctccgaagtagaaggccgcatccaagacctagaaaaatacgtcgaagacaccaaaatcgacctatggtcttacaacgcagagctcctcgttgccctagaaaaccaacacacgatcgacctaaccgactcagaaatgaacaaactcttcgagaaaacaaagaaacaacttagagaaaacgcagaagacatggggaacggctgcttcaaaatataccacaaatgcgacaacgcctgcatcggaagcatccgcaatgggacctacgaccacgacgtctaccgcgacgaagctctaaacaaccgattccaaataaagggagtcgaactcaaaagcggctacaaggactggatactctggatctcatttgccatatcatgcttcctcctttgtgtcgcactactaggattcattatgtgggcctgccaaaaaggcaacatccgatgcaacatctgcatc

SEQ ID NO: 58925 - RNA, 1698 nt, synthetic construct
  misc_feature 1..1698: note = derived and/or modified sequence opt11 from anti-influenza_Chain
  source 1..1698: mol_type = other RNA
atgaagaccataatcgccctctcctatatcctatgcctagtattctcccaaaaactgccaggaaacgacaacagtacagccaccctctgcctaggacaccacgcagtccccaacggaaccatagtcaagacaatcaccaacgaccaaatagaagtcaccaacgccaccgagctcgtccaatctagctcaacaggcggtatctgcgactcaccccaccaaatcctagacggagaaaactgcaccctaatcgacgcactcctcggagacccgcaatgcgacggcttccaaaacaagaaatgggacctcttcgtagaaagatccaaagcctacagcaactgctacccctacgacgtcccagactacgccagcctacgatcactcgtcgcctccagcggtaccctagagttcaacaacgaatccttcaactgggccggtgtaacccaaaacggcacctcatcggcctgcaagcgccgatcaaacaagtccttcttctcccgactcaactggctcacccacctaaaatacaaataccccgccctcaacgtaacaatgccaaacaacgaaaaattcgacaagctctacatatggggcgtccaccatcccgtaaccgactcagaccaaatctctctatacgcacaggcaagcggccgcataacagtatccacgaaacgctcacaacagaccgtcatccccaacataggctaccgccccagagtacgcgacataagctcccgaataagcatttactggacaatagtaaaacccggagacatactcctcatcaacagtacgggcaacctaatcgcaccccgaggatacttcaaaatacgcagcggcaaatcctcaatcatgcggtccgacgcacccatcggaaaatgcaacagcgaatgcataacccccaacggctccatcccaaacgacaaaccgttccaaaacgtcaaccgcataacctacggcgcctgcccccggtacgtcaaacagaacactctaaaactcgctaccggcatgcgaaacgtcccagaaaaacaaacccgcggcatcttcggagccatcgcaggctttatcgaaaacggctgggaaggcatggtagacggatggtacggattccgccaccagaactccgaaggcaccggccaagccgcagacctaaaatccacacaggccgccatcaaccaaattaacggcaaactaaaccgccttataggcaaaaccaacgagaaattccaccaaattgaaaaggagttctccgaagtcgaaggtcgcatccaagaccttgaaaaatacgtcgaagacaccaaaatcgacctctggagctataacgcggaactcctagtcgccctcgaaaaccaacacacaatcgacctgacagacagcgaaatgaacaaactattcgaacgcaccaagaaacaactaagagaaaacgccgaagacatgggaaacggctgcttcaaaatttaccacaaatgcgacaacgcgtgcatcgaatccatccgcaacgggacctacgaccacgacgtctaccgtgacgaagccctaaacaaccgcttccaaattaaaggagtcgaactcaaaagcggctacaaagactggatcctgtggatatccttcgcaattagctgcttcctcctttgcgtcgctctcctaggcttcatcatgtgggcctgccaaaaaggaaacataagatgcaacatatgtatc

SEQ ID NO: 58926 - RNA, 1698 nt, synthetic construct
  misc_feature 1..1698: note = derived and/or modified sequence opt11 from anti-influenza_Chain
  source 1..1698: mol_type = other RNA
atgaagaccataatagcactatcctacatcctatgcctggtattcgcccagaagctcccgggaaacgacaactccacagccacactctgcctaggccaccacgcagtacccaacggcaccatcgtcaaaaccatcacaaacgaccaaatcgaagtcaccaacgccacagaactcgtccagtcctcatcaaccggcggcatttgcgactccccacaccaaatccttgacggcgagaactgtaccctgatcgacgcccttctcggcgacccccaatgcgacggattccaaaataagaaatgggacctcttcgtcgaacgatcaaaagcctactccaactgctacccctacgacgtccctgactacgcctccctccgctcgctcgtcgcatcatccggaaccctagagttcaacgacgagagcttcaactggaccggagtcacccaaaacgggaccagctcctcctgtaaacgcagaagcaacaactccttcttctcccgactcaactggctcacacacctaaaattcaaataccccgctctaaacgtcaccatgccaaataacgaaaaattcgacaaactctacatctggggagtccaccaccccgtaactgacaacgaccaaatcttcctttacgcccaagcctccggacgcatcaccgtctccacaaaacgctcccagcaaaccgtcatacccaacatcggcagcagaccacgcatccgaaacataccctcccgcatatccatctactggaccatagtcaaacccggagatatccttctaatcaactcaaccggcaacctgatcgcacctcgaggatacttcaaaatccgaagcggcaaatcctcgataatgcggtcagacgcgccgatcggcaaatgcaactccgaatgcattacccccaacggatccatcccaaatgacaaacccttccaaaacgtcaaccgaatcacatacggcgcctgcccccgctacgtaaaacagaacaccctaaaactagcaaccggcatgagaaacgtaccagaaaaacaaacccgcggcatcttcggcgccatagccgggttcatcgaaaacggatgggaaggcatggttgacggctggtacggcttccgccaccaaaactccgaaggcataggccaagcagccgatctcaagtcaacccaggccgccataaaccagattaacggcaagctcaaccggctaatcggcaaaacaaacgaaaaattccaccaaatagaaaaagagttctccgaagtcgaaggaagaatccaagacctcgaaaaatacgtcgaagacacaaaaatcgacctctggtcctacaacgccgaactcctagtcgcactagaaaaccaacacacaatcgacctcacagactccgaaatgaacaaactattcgaacgcaccaaaaagcaactccgggaaaacgcggaagacatgggcaacggctgcttcaagatttaccacaaatgcgataacgcatgcatcggctcaatccggaacggcacctacgaccacgacgtctaccgagacgaagccctaaacaaccgattccaaataaaaggagtcgaacttaaatcagggtacaaagactggatcctatggatctccttcgccatatcctgcttccttctatgcgtggcccttctaggcttcatcatgtgggcctgccaaaaaggaaacatccgttgcaacatatgcatc

SEQ ID NO: 58927 - RNA, 1698 nt, synthetic construct
  misc_feature 1..1698: note = derived and/or modified sequence opt11 from anti-influenza_Chain
  source 1..1698: mol_type = other RNA
atggaaaagatcgtcctcctcctcgccatcgtatcactcgtaaaatcagatcaaatctgcataggctaccacgcaaacaactccaccgaacaagtagacaccatcatggaaaaaaacgtcaccgtaacccacgctcaagacatactagaaaaaacacataacggcaaactatgcgacctcgacggagtcaaaccactcatactacgagactgctcagtcgcaggctggctactagggaaccccatgtgcgacgaattcatcaatgtcccagaatggtcctacatagtcgaaaaagccaaccccacaaacgacctgtgctacccaggaagcttcaacgactacgaagagctaaaacacctcctctccagaatcaaccacttcgaaaaaatccaaatcatccctaaatcctcatggtccgaccacgaagcaagctccggcgtttcatccgcatgcccctacctaggctccccatcattcttccgaaacgtcgtatggctcatcaaaaaaaacagcacatacccgacaattaaaaaatcatacaacaacacaaaccaagaagacctactcgtcctatggggtatccaccaccctaacgacgcagccgaacaaacacggctctaccagaaccctaccacctacatctccataggcacctccaccctcaaccaacgtctagtgccgaaaatcgcaacacgttctaaagtcaatggacaaagcgggcgcatggaattcttctgggccatactcaaaccaaacgacgcaatcaacttcgagtccaacggcaacttcatcgcaccagaatacgcctacaaaatcgtaaaaaaaggcgactccgcaatcatgaagtccgaactcgagtacggtaactgcaacactaaatgccaaacccccatgggcgccataaactcatcaatgcccttccataacatacacccactcactataggagaatgcccaaaatacgtcaaatccaaccgactcgtgctcgccaccggcctccgaaactccccccaacgcgaatcccgacgcaaaaagcgaggattgtttggggcgatcgccggattcatcgaaggcggctggcaaggtatggtcgacggctggtacggataccaccacagcaacgaacagggctccggctacgccgccgacaaggaatcaacacaaaaagccataggagtcactaacaaagtcaactccataatcgacaaaatgaacacccaattcgaagcggtcggcagagaattcaacaacctcgaacgccgcatagaaaacctaaacaaaaaaatggaagacggattcctagacgtctggacctacaacgccgagctcctcgtactaatggaaaatgaacgaacccttgacttccacgactccaacgtcaaaaacctctacgacaaggtccgactacaactccgagacaacgccaaagaactgggcaacggatgcttcgaattctaccacaaatgcgacaacgaatgcatggaatccatccgaaacggcacctacaacccccaatatagcgaagaagcccgactcaaacgagaagaaatctccggagtcaaactagaatccatcggcacctatcagatcctctcaatctacagcaccgtcgcatcatcactagccttagccataatgatagccggcctctccctctggatgtgctcgaacggctcactccagtgccgcatatgcatc

SEQ ID NO: 58928 - RNA, 1698 nt, synthetic construct
  misc_feature 1..1698: note = derived and/or modified sequence opt11 from anti-influenza_Chain
  source 1..1698: mol_type = other RNA
atgaaagcaatcctagtagtcctactatacacattcgccacagccaacgcagacaccctctgcatcggataccacgccaacaactccacagataccgtcgacacagtattagagaaaaacgtcaccgtcacccactccgtcaacctcctcgaagacaaacacaacggcaaactctgcaaactacgcggggtagcacccctccacctagggaaatgcaacatcgccggctggatcctcggaaaccccgaatgcgaatccctctccaccgcatcttcatggtcctacatcgtcgaaacatcctccagcgacaacggtacatgctaccccggcgacttcatcgactacgaagaactacgcgaacaactctcatccgtcagctcctttgagcgcttcgagatattcccaaaaaccagctcttggcccaaccacgacagcaacaaaggcgtcaccgcagcctgcccccacgccggagccaaatcattctacaaaaacctcatatggctcgtcaagaaaggcaactcgtaccccaaactctcgaaatcatacatcaacgacaaaggcaaagaggtactggtcctctggggaatccaccacccatcgacgtcagctgaccaacaaagtctctaccaaaacgcagacgcatatgtcttcgtcggaacatcccgatactcaaagaaattcaaacccgagatcgccatccgccccaaagtacgcgaccaagaaggaagaatgaactactactggaccctcgtagaaccaggcgataaaataacattcgaagcaaccggcaacctagtcgtcccccgatacgcattcgccatggagcgaaacgcgggctccggcatcatcatcagcgacacccccgtccacgattgcaacacaacctgccaaacccccaaaggcgccataaacacttctctaccctttcagaacatccacccgataaccatcggcaaatgcccaaaatacgtcaaatccaccaaactccgcctcgcaacaggcctccgcaacgtcccctccatacaatcccgtggactcttcggcgccatcgcgggcttcatcgagggcggatggaccggcatggtagacggctggtacggctaccaccaccagaacgaacagggatcaggatacgccgccgacctcaaatccacccaaaacgccatagacgaaatcacgaacaaagtcaactcggtcatagagaaaatgaacacccaattcactgcagtaggaaaagaatttaaccacctcgaaaaacgaatcgaaaacctaaacaagaaagtggacgatggcttcctcgacatatggacctacaacgcagaactacttgtcctcttagaaaacgaacgcaccctggactaccacgactccaacgtcaaaaacctatacgaaaaagtacgctctcaactcaaaaacaacgccaaagaaataggaaacggctgcttcgagttctaccacaaatgcgacaatacctgcatggaatcggtcaaaaacggcacctacgactacccaaaatactccgaagaagccaaactaaaccgcgaagaaatcgacggagtcaaactagaaagcacacgcatataccaaatcctagcaatctacagcaccgtagcaagcagcttagtcctagtagtatccctcggcgccatctcattctggatgtgcagcaacggatcacttcaatgcagaatctgcata

SEQ ID NO: 58929 - RNA, 1698 nt, synthetic construct
  misc_feature 1..1698: note = derived and/or modified sequence opt11 from anti-influenza_Chain
  source 1..1698: mol_type = other RNA
atgaaagccatcctagtcgttctcctctacaccttcgcaacagcaaacgccgacaccctctgtatcggctaccacgcaaacaactcaacagacaccgtagacaccgtgctcgagaaaaacgtaaccgtcacccacagcgtaaacctcctcgaagataaacataacggcaaactatgtaaactccgtggagtcgcgcccctgcacctcggcaaatgtaacatcgccggctggatcctcggcaacccagaatgcgaatccctctccactgccagctcctggtcatacatcgtagaaacctcctcctctgacaacggaacctgctaccccggtgacttcatcgactacgaagaactaagagaacaacttagctcagtaagctccttcgaacgattcgaaatcttcccaaaaacgagctcgtggcccaaccacgactccaacaaaggcgtcacggccgcctgccctcacgccggcgccaaatcattctataaaaacctgatctggctggtcaagaaaggcaacagctaccccaaactctccaaatcatacataaacgacaaaggcaaagaggtcctagtactatggggcatccaccacccacccacctcggccgaccaacaaagcctctaccaaaatgcagacgcctatgtcttcgtcgggtcatcccgctactccaagaaattcaaaccagaaatcgccatccgaccaaaagtccgagaccaggagggccgcatgaactactactggaccctagtagagccaggcgataagataaccttcgaggccaccggcaacctcgtcgtaccccgctacgccttcgccatggaacggaacgccggttccggaataatcatcagcgacacccctgtacacgattgcaacaccacctgtcaaacacccaaaggagctataaatacatcgctacccttccaaaacattcaccccataaccataggcaaatgcccaaaatacgttaaatcgaccaaactccgcctcgccaccggactccgcaacatcccctctatccaatcccgcggccttttcggcgccatcgccggattcatcgaaggcggttggaccggaatggtcgacgggtggtacgggtaccaccaccaaaacgaacaaggaagcggctacgcggccgacctcaaatccacacagaacgccatagacgaaatcacgaacaaagttaacagtgtcatcgagaaaatgaacacccaattcacagccgtaggcaaagagttcaatcacctagaaaaacgcatcgaaaacctcaacaagaaagtcgatgacggcttcctagacatatggacctacaacgccgaactcctcgtacttttagaaaacgaacgcacactagactaccacgactccaacgtcaaaaacctctacgaaaaagtccgcagccaactcaaaaacaacgccaaagaaataggcaatggatgcttcgagttctaccacaaatgcgataatacctgcatggaatccgtcaaaaacggcacatacgactaccccaaatactcagaagaagccaaactaaaccgcgaagaaatcgacggagtaaaactagaatccacccgaatataccagatactagccatatactcaacagtagcctcctccctcgtactcgtagtgagcctaggagcaatctccttctggatgtgctcaaacggctcactccaatgcagaatctgcatt

SEQ ID NO: 58930 - RNA, 1698 nt, synthetic construct
  misc_feature 1..1698: note = derived and/or modified sequence opt11 from anti-influenza_Chain
  source 1..1698: mol_type = other RNA
atggagaagatcgtgctactcctagccatcgtctccctagtcaaatcagaccaaatctgcatcggctaccacgctaacaactccaccgaacaagtcgacacaattatggagaaaaatgtcacagtcacacacgcacaagacatactagagaaaacacacaacggaaaactctgcgacctcgatggcgtcaaacccctcatccttagagactgcagcgtcgccggttggctccttggcaaccccatgtgcgacgaatttattaacgtccccgaatggtcgtacatcgtagaaaaagccaaccccaccaacgacctctgctatcccggatccttcaacgactacgaagaattaaaacacctcttatcacgcatcaaccacttcgaaaagatacaaataatacccaaatcgagctggtcagaccacgaagcctcatccggcgtctccagcgcatgcccctacctcggatctccctcattcttcagaaacgtagtatggctcatcaaaaagaactcaacctaccccacaataaagaaaagctacaacaacaccaaccaagaagacctcctagttctctggggcatccaccaccccaacgacgcagccgaacaaactcgactctaccagaaccccaccacgtacatatcaattggcacgtccacactgaaccaacgcctcgtcccgaaaatcgccacccgctccaaagtaaacggacaatccggccgaatggagttcttctgggccatcctcaaacccaacgacgcgataaacttcgaatcaaatggaaactttatcgcacccgaatacgcatacaaaatagtcaagaaaggcgacagcgccataatgaaatccgaactcgaatacggcaactgcaacaccaaatgccaaaccccaatgggggcaatcaactcctccatgcccttccacaacatccacccgctaaccatcggcgaatgcccaaaatacgtaaaatccaaccgactcgtcctcgccaccggcctccggaactccccgcaacgcgaatcccgccgcaagaaacgcggcctgttcggcgccatagcaggattcatcgaaggcggttggcaaggcatggtcgacggatggtacggctaccaccacagcaacgaacaaggatcaggatacgcagccgacaaagaaagcactcaaaaagccataggcgtcaccaacaaagtcaactcaataatcgacaaaatgaacacccaattcgaagcagtcggcagggagttcaacaacctcgaacgcagaatcgaaaacctgaacaagaaaatggaggacggcttcctcgacgtctggacatacaacgccgaactcctcgtcctcatggaaaatgaacgcacactagacttccacgacagcaacgtcaaaaacctatacgacaaagtccgactccaacttcgcgacaacgccaaagaactcggaaacggctgtttcgagttctatcacaaatgtgacaacgaatgcatggaatccatcagaaacggaacctacaacccccaatactcagaagaagcaagactcaaacgcgaagaaataagcggcgtcaaactcgaatcgatcggcacctaccaaatactcagcatctacagcacagtggcctcctcccttgcactcgccatcatgatagccggtctaagcctctggatgtgctcaaacggctccctccaatgcagaatctgcatc

SEQ ID NO: 58931 - RNA, 1698 nt, synthetic construct
  misc_feature 1..1698: note = derived and/or modified sequence opt11 from anti-influenza_Chain
  source 1..1698: mol_type = other RNA
atgaaaaccatcatagccctatcctacatcctctgcctcgtattcgcccaaaaactccccggcaacgacaactccacagccaccctatgtctcggccaccacgcagtccccaacggcacgatcgtcaaaaccatcacaaacgaccaaattgaagtcaccaacgccaccgagctagtccagagctcaagcaccggcggaatctgcgactcaccccaccaaatattagacggcgaaaactgcactctcatcgacgccctcctcggcgatccccaatgcgacgggttccaaaacaaaaagtgggaccttttcgtcgaaagatctaaagcatatagcaactgctacccctacgacgtccccgactacgcctccctgcgctcactcgtagccagttcaggcacactagagttcaacaacgaatccttcaactggactggcgtgacacaaaacggcacctcctcagcctgcaaacgacgatcgaataactccttcttctcccgactcaactggctcacacaccttaaattcaaataccccgcgctgaacgtcaccatgccaaacaacgaaaaattcgacaaactctacatctggggagtacaccaccccggcacagacaacgaccaaatcagcctatacgcccaagcatcaggacgaatcacagtctctacaaagcgatcccaacaaaccgtcattcccagcatcgggtctcgcccacgcatacgcgacgtaccctcacgcatctcaatctactggaccatcgtaaaaccaggcgacattctactcatcaacagcaccggaaacctcatcgctccccgcggctacttcaaaatccgcagtggcaaaagctccataatgcggtccgacgcaccaatcggcaaatgcaacagcgaatgcatcacccccaacggcagcatccccaacgacaagccattccagaacgtcaaccgaataacctacggagcatgcccccgatacgtcaaacaaaacactctcaaactcgccacaggcatgagaaacgtccccgaaaagcaaacccgcgggatcttcggagccatcgcaggctttatcgaaaacggatgggaaggaatggtcgacggctggtacggatttagacaccaaaactcagaagggacaggccaagcagctgacctaaaatcaacccaagccgccattaaccagatcaacgggaaactaaaccgcctcatcggtaaaacgaacgaaaaattccaccaaatcgaaaaagagttctcagaagtagaaggccgcatccaagacctcgaaaaatacgtcgaagacacaaaaatcgacctctggtcatacaacgccgaactcctcgtcgcactcgaaaaccagcacacaatcgacctcacagactcagaaatgaacaaactcttcgaaaggaccaagaaacaactccgagaaaacgccgaagacatgggaaacggttgcttcaaaatctaccacaagtgcgacaacgcttgcatcggctccatccgcaacggcacctacgaccatgacgtgtacagagacgaggccctaaacaaccgattccaaatcaaaggagttgaactaaaaagcggctacaaagactggatcctctggatatcctttgccatctcctgcttcctactctgcgtcgccctcctgggcttcatcatgtgggcctgccaaaaaggcaacatccgatgcaacatatgcatc

SEQ ID NO: 58932 - RNA, 1698 nt, synthetic construct
  misc_feature 1..1698: note = derived and/or modified sequence opt11 from anti-influenza_Chain
  source 1..1698: mol_type = other RNA
atgaaagccatcctagtcgtcctcctctacaccttcgccaccgccaacgccgacactctttgcatcggatatcacgccaacaattccacagacaccgtcgacacagtcctggagaaaaatgtaacagttacgcactccgtcaacctcctagaagacaagcataacggcaaactatgcaaactccgcggagtagcacctctccacctcgggaaatgcaacatcgccggctggatcctaggcaaccccgaatgcgagtcactatccacagcctcatcctggagctacatagtcgaaacctcctcaagcgacaacggcacatgctaccccggagacttcattgactacgaagaactccgcgaacaactgtccagcgtcagcagcttcgaacgattcgaaatattcccaaaaacatcctcctggcccaaccacgattcaaacaaaggcgtaaccgccgcctgcccacacgctggcgccaaatccttctacaaaaacctcatatggctcgtaaagaaaggcaactcctaccccaaactctccaaatcatacataaacgacaaaggcaaagaggtcctagtattgtggggcatccaccacccatccacctccgcagaccaacaatcgttataccaaaacgccgacgcctacgtcttcgtaggcacctcacgctactccaagaaattcaaacctgaaatcgccatccgacccaaagtccgagaccaagagggacgaatgaactactactggactctcgtggaacccggcgataaaataaccttcgaagccacaggaaacctagtcgtccccagatacgccttcgccatggaacgaaacgccggaagcggaatcataatctccgacacaccagtccacgactgcaacacgacctgccaaacccccaaaggagccattaacacctcactccccttccagaacatacaccccattaccataggaaaatgcccaaaatacgtcaaatccacaaaactacgcctcgctaccggcctccgaaacgtcccaagcatccaatcccgcggcctcttcggcgcaatcgcaggattcatcgaaggcgggtggaccggcatggtcgacgggtggtacggttaccaccaccaaaacgaacaaggatcaggctacgcggccgacctaaaaagcacccagaacgccattgacgaaatcacaaacaaagtaaactccgtcatagagaaaatgaacacccaattcaccgctgtcggcaaagagttcaaccacctcgaaaaacgaattgagaaccttaacaagaaagtcgacgacggattcctcgacatatggacctacaacgcagaacttctagtcctactagagaacgaacgtaccctcgactaccacgactcaaacgtgaaaaacctctacgaaaaagtccgcagccaacttaaaaacaacgcaaaagagatcggaaacggctgtttcgagttctaccacaaatgcgacaatacctgcatggaatccgtcaaaaacgggacctacgactaccccaaatactctgaagaagcaaaactcaacagagaggaaatagacggagtcaaactggaaagcacacgcatctaccaaatcctagccatatactccaccgtagcatccagcctcgtcctcgtcgtaagcctcggagccatctccttctggatgtgttccaacggctccctccaatgccgcatctgcata

SEQ ID NO: 58933 - RNA, 1698 nt, synthetic construct
  misc_feature 1..1698: note = derived and/or modified sequence opt11 from anti-influenza_Chain
  source 1..1698: mol_type = other RNA
atgaaagccatcctcgtcgtcctactatacacattcgcgacagcgaatgcagacaccctctgcatcggataccatgccaataactccacagacacagtcgacacggtcctcgaaaagaacgtcaccgtcacccacagcgtaaacctcctggaagacaaacacaacggcaaactgtgcaaactccgcggagtagcacccctacatctcggcaaatgcaacatcgccggctggatcctcggaaaccccgaatgcgaatccctgagtacagcctccagctggtcctacatcgtagaaacatcctcgagcgacaacggaacctgctacccgggcgacttcatcgattatgaagaactccgggagcaactctcctccgtcagctccttcgagagattcgaaatattcccaaaaacatcctcctggccaaaccacgactcaaacaaaggcgtcacagccgcctgcccccacgcaggagccaaatccttctacaaaaacttaatctggctcgtcaaaaagggaaacagctaccccaagctaagcaaatcgtacatcaacgataagggcaaagaagtactcgtcctctggggcatacatcacccaccaacctccgccgaccaacaatcactctaccaaaacgccgacgcctacgtcttcgtcggatcctcgcgatatagcaagaaattcaaacccgagatcgccatacgacccaaagtacgcgaccaagaaggacgcatgaactactactggacgcttgtagaaccaggcgacaaaatcaccttcgaagccaccggaaacctcgtcgtacctaggtacgccttcgccatggaacgtaacgcaggcagcggcatcattatctccgacacaccagtacacgattgcaataccacctgtcagacaccaaaaggcgccataaacacatcccttccttttcaaaacatccaccccataaccatcggaaaatgcccaaaatacgtaaaaagcaccaaactacgcctcgcaacaggactccgcaatatcccaagtatacaatcacgcggactcttcggcgccatcgccggcttcatagaaggcggctggacaggcatggtagacggttggtacggctaccaccaccaaaacgagcaggggagcggatacgcggccgacctcaaatccacacaaaacgcaatagacgaaattaccaacaaagtaaacagcgtgatagaaaagatgaacacacagttcaccgcagtcggaaaagagttcaaccacctagaaaaacgaatcgaaaacctaaacaagaaagtcgacgacggattcctcgacatctggacatacaacgccgaactgctcgtactccttgaaaacgaacggacactcgactaccacgactcaaacgtaaagaacctctacgaaaaagtacgcagccaactcaaaaacaacgccaaagaaatcggcaacggctgctttgagttctaccacaaatgcgacaatacatgcatggaaagcgtcaaaaatggcacatacgactaccccaaatactcagaagaagccaaactcaaccgcgaagaaatcgacggagtaaaactcgaaagcacacgtatttaccaaatcctcgcaatctactccacagtcgcatcctccctcgtcctagtcgtctccctaggagcaatctcattctggatgtgcagtaacggctcactccagtgcaggatctgcatc

SEQ ID NO: 58934 - RNA, 1698 nt, synthetic construct
  misc_feature 1..1698: note = derived and/or modified sequence opt11 from anti-influenza_Chain
  source 1..1698: mol_type = other RNA
atgaaaacaatcatcgcactctcatacatcctatgcctcgtctccgcccaaaagttccccggaaacgacaacagcacagccaccctctgcctcggccaccacgccgtcccaaacggcaccatcgtaaaaaccatcaccaacgaccaaatagaagtcacaaacgcgacagaactcgtccaaagctcaagcacaggcgaaatatgcgacagcccccaccaaattctcgacggagaaaactgtaccctaatcgacgcacttttaggagacccccagtgcgacggattccaaaacaagaaatgggacctgttcgtagagagaagcaaagcctatagcaactgctacccctacgacgtcccagactacgccagcctgagatcactcgtcgcatcgtccggaaccctcgaatttaacaacgaatccttcaactggacaggcgtcacccaaaacggcacctcctccgcttgcatccgtcgctcaaacaactccttcttttcccgcctcaactggctaacccacctaaaattcaaatacccagccctcaatgtgaccatgccaaacaacgaagagttcgacaaactctacatctggggcgtccaccaccccgggaccgacaacgaccaaatcttcctttacgcccaagcctccggacgcataaccgtatcaacgaaacggtcacagcaaacggtgatacctaacatccggagccgcccaagagtccgcaacatcccctcccgtatctcaatatactggaccattgtcaaacccggcgacatccttctaatcaactcaactggcaacctaatcgcaccccgcggatacttcaaaattcgatcgggcaagtcctccatcatgcgctcagacgcccccatcggcaaatgcaattccgaatgcataaccccaaacggatccatcccaaacgacaaacccttccaaaacgtgaaccgcatcacctatggcgcctgcccccgctacgtcaagcaaaacaccctcaaactggccaccggcatgcgaaatgtacccgaaaaacaaacacgagggatcttcggcgccatagccggcttcatagaaaatggatgggaaggcatggtagacgggtggtacggcttccgccaccaaaactccgaaggaatcggccaagccgcagacctaaaatccacacaagccgcaatcgaccaaatcaacggaaaacttaaccgcctaatagggaaaaccaacgaaaaattccaccagatcgaaaaagagttctccgaagtggaaggccgcatccaagacttagaaaaatacgtcgaagacacaaaaatagacctctggtcatacaacgccgaacttctagtcgcactagagaaccaacacactatcgacctaacagactcggaaatgaacaaacttttcgagaaaacaaagaaacaactccgcgaaaacgcagaggacatgggcaatggctgcttcaaaatataccacaaatgcgacaacgcctgcataggctcaatcagaaacggaacctacgatcacgacgtctaccgagacgaagccctcaacaaccgcttccaaataaaaggcgtagaacttaaatccgggtacaaagactggattctatggattagcttcgccatatcctgcttcctcctctgcgtcgccctactgggattcatcatgtgggcctgccaaaaagggaacatccgctgcaacatctgcata

SEQ ID NO: 58935 - RNA, 1698 nt, synthetic construct
  misc_feature 1..1698: note = derived and/or modified sequence opt11 from anti-influenza_Chain
  source 1..1698: mol_type = other RNA
atgaaaaccatcatcgccctcagctacatcctctgcctcgtcttcgcccaaaaactccccggcaacgacaattcaaccgccacattatgtctcggccaccacgccgtccccaatggcaccatagtcaaaaccatcaccaacgaccaaatcgaagtgacaaacgcaacagaactcgtccaaagctcgagcaccggcgaaatctgcgattcaccacatcaaatcctagacggagaaaactgcaccctaatcgacgccctattaggagacccccaatgcgacggattccaaaacaagaaatgggacctcttcgtcgaacgctccaaagcatactcaaactgttatccctatgacgtcccagactacgcctccctccgctccctagtagccagcagcggcacccttgagttcaaaaacgaatccttcaactggacaggcgtaacccaaaacggaacgtcctcagcctgcatacgacgaagcaacaactccttcttctcccggttaaactggctcacccacctcaaattcaaatacccagcactgaacgtaacaatgccaaacaaagaaaaattcgacaaactctacatctggggagtacaccaccccggcaccgacaacgaccaaatattcctctacgcccaagccagcggacgcatcaccgtctcgaccaaacgcagccaacaaaccgtcatacccaacatcggctcccggttacgcgtcagagacatcccctcaagaatatccatctactggacaatcgtaaaacccggagacatactcctaatcaacagcaccggaaaccttatcgcaccccgcggctatttcaaaatacgatcaggcaaatcttccatcatgcgctccgacgcccccatcggcaagtgcaactccgaatgcataacacccaacggctccatcccgaacgacaaaccattccaaaacgtcaaccgcatcacctacggcgcctgcccgcgatacgtcaagcaaaacaccctcaaactcgccaccggaatgcgcaacgtcccagaaaaacaaacacgaggtatcttcggcgccatcgcaggtttcatcgaaaacggatgggaaggtatggttgacggatggtacggattccgacaccaaaacagcgaaggaactggccaagccgcagacctcaagtccacacaagccgccattgaccagataaacggaaaactcaaccgccttatcggcaaaacgaacgaaaaattccaccaaatcgaaaaagagttctccgaagtcgaaggccggatccaagatctagaaaaatacgtcgaagacaccaaaatcgacctgtggagctacaacgccgaactcctagtcgccctagaaaaccaacacaccatcgacctaacagactccgaaatgaacaagctattcgagaaaaccaagaaacagttacgagaaaacgcagaagacatgggcaacggatgctttaaaatttaccacaaatgcgacaacgcctgcatcggatccatccgcaacggcacctacgatcacgacgtctaccgggacgaagctctcaataaccgattccaaataaaaggcgtcgaactaaaatcaggctacaaagactggatactctggatatcgttcgcaatcagctgcttcctgctctgcgtcgccctactcggattcatcatgtgggcctgccaaaaaggcaatatccgctgcaacatctgcata

SEQ ID NO: 58936 - RNA, 1698 nt, synthetic construct
  misc_feature 1..1698: note = derived and/or modified sequence opt11 from anti-influenza_Chain
  source 1..1698: mol_type = other RNA
atgaaaacaatcatcgccctttcctacatactctgcctagtgttcgcccagaagctacccggcaacgacaacagcacggccaccctatgcctaggccaccacgccgtccccaacggcaccatagtcaaaacgatcaccaacgaccaaatagaagttaccaacgcaacagaactcgtccaatcatccagcaccggcgaaatctgcgactcaccccaccaaatactagacggcgaaaactgcaccctcatcgatgcccttctcggagacccccaatgcgacggattccaaaacaagaaatgggacctgttcgtagaaagatccaaagcctactccaaatgctacccatacgacgtacccgactacgccagccttcgatccctagtggcctcctccggcaccctcgagttcaacaacgaatccttcaactggaccggagtcactcaaaacggcacctcctcagcatgcatacgaagatctaacaacagcttcttctcccgcctaaactggctaacccacctcaaattcaaatacccagctctcaacgtcaccatgcccaataacgaaaagttcgataaactatacatctggggtgtccaccaccctggtaccgacaacgaccaaatcttcctatacgcacaagcaagcggccgcataaccgtaagcacaaaacgctcccaacaaaccgtcatccccaatatcggatcccgcccccgagtccgtgacataccatcccgcatctccatatactggaccatagtcaagccaggagacatcctcctaataaattccaccggcaacctcatagccccacgcggctacttcaaaatccgttcaggaaaatcctccataatgcgttcagacgcacccataggcaagtgcaactccgaatgcatcaccccaaacggatccatccccaacgacaaaccattccaaaacgtaaaccgcataacctacggcgcttgcccacgctacgtcaaacaaaacaccctcaaactagccaccggcatgcgcaacgtacccgaaaaacaaacacgaggaatcttcggtgcgatcgccggattcatcgaaaacggctgggaaggcatggtcgacggctggtatggcttccgacaccagaactccgaaggaataggacaagccgccgacctaaaaagtacccaagcggccattgatcaaatcaacggcaaactaaatagactaatcggaaagaccaacgaaaaattccaccagatcgaaaaagagttctccgaagtggaaggccgtatccaagacctcgaaaaatacgtcgaagacaccaaaatcgacctatggagctataacgccgaattactcgttgcactcgaaaaccaacacacgatcgacctcaccgactccgaaatgaacaaactcttcgagaaaaccaagaaacaactcagagaaaacgccgaagacatgggaaacggctgcttcaaaatctaccacaaatgcgacaacgcgtgtatcggatcaatccgaaacggcacctacgaccacgacgtctaccgagacgaagccctcaacaacagattccaaatcaaaggagtcgaactaaaaagcggatacaaagactggatcctctggatatcattcgccatcagctgtttcctactctgcgtcgcgctcctaggcttcatcatgtgggcctgtcaaaaaggaaacatacgctgcaatatctgcata

SEQ ID NO: 58937 - RNA, 1698 nt, synthetic construct
  misc_feature 1..1698: note = derived and/or modified sequence opt11 from anti-influenza_Chain
  source 1..1698: mol_type = other RNA
atgaaaacaatcatcgcactcagctacatcctctgtctcgtattcgcacaaaaactccccggaaacgacaatagcacagccacactctgcctcggccaccacgccgtcccaaacggcacaatcgtaaaaaccatcaccaacgaccagatcgaagtaaccaacgcaaccgaactcgtccaatccagctccaccggagaaatctgcgatagcccacaccaaatcctagatggcgaaaattgcacactcatcgacgcactactcggagacccccagtgcgacggattccagaataagaaatgggacctcttcgtcgaacgcagcaaagcctacagcaattgctacccatacgacgtaccagactacgcctcactacgctccctagtagcatcctccggcaccctagagttcaacaacgaatcattcaactggaccggagtcacacaaaacggaacatcaagcgcctgcattcggagaagcaacaactcattcttctcaagactcaactggctaacccacctaaaattcaaataccccgccctaaacgtaaccatgcctaataacgaaaaattcgacaaactatacatctggggcgtccaccaccccggcaccgacaacgaccaaatattcctgtacgcccaagccagcggacgcataaccgtcagcacgaaacgcagccaacaaacagtcataccaaacatcggatccagaccaagagtccgcaacattccctcccgaatcagcatatactggaccatcgtaaaacccggagacatactcctcatcaactcaaccggcaacctcattgcgccacgcggctacttcaaaatacgctcgggcaagtcctccatcatgcgctccgatgcccccatcggcaaatgcaactccgaatgcatcaccccaaacggatcaattcccaacgataaacccttccaaaacgtcaaccgcataacctacggcgcatgcccccgctacgtaaaacaaaacactctaaaactagcaacaggaatgcgcaacgtccccgaaaaacaaacacgaggaatcttcggggccatcgccggcttcatcgaaaacggatgggaaggcatggtcgacggctggtacggcttccgccaccaaaacagcgaaggaatagggcaagcagccgacctcaaaagcacgcaagcggccatcgaccaaatcaacggcaaactcaaccgcctcatcgggaaaacaaacgaaaaattccaccaaattgaaaaagagttctcagaagtcgaaggccgaatacaagacctcgaaaaatacgtcgaagacaccaaaatcgacctatggtcctacaacgcagaactcctggtcgccctcgaaaaccaacacacgatagacctaaccgactcagaaatgaacaaactcttcgaaaagaccaagaaacaactacgagaaaacgccgaagacatgggaaacggatgtttcaagatctaccacaaatgcgacaacgcctgcatcggctctatcaggaacggcacctacgaccacgacgtctaccgagacgaagcactgaacaaccgattccaaataaaaggcgtagaactgaaaagcggctacaaagactggatcctctggatatcattcgctataagctgcttcctcctctgcgtcgcactattaggcttcatcatgtgggcctgccaaaaagggaacataagatgcaacatatgcata

SEQ ID NO: 58938 - RNA, 1698 nt, synthetic construct
  misc_feature 1..1698: note = derived and/or modified sequence opt11 from anti-influenza_Chain
  source 1..1698: mol_type = other RNA
atgaaaaccataatcgccctatcatacatcctatgtctcgtcttctcacaaaagctccccggcaacgacaacagcacagccaccctctgtctcggacaccacgccgtacccaacggcacaatcgtaaaaacaatcaccaatgaccaaatcgaagtcacaaatgcaacggagctagtccagagctccagcaccggaggaatatgcgactcgccccaccaaatactcgacggcgaaaactgcaccctgatcgacgcgctcctcggagacccccaatgcgacggcttccaaaacaagaaatgggatctcttcgtagaacggtcaaaagcatactcaaactgctacccctatgacgtccccgactacgcgagcctccgatcccttgtcgccagctccggcaccctggagttcaacaacgagagcttcaattgggccggagtcacacaaaacggcacatcgtccgcctgcaaacgccgaagcaacaaatcatttttctcccgactcaactggctgacacacctaaaatacaagtaccccgcactcaacgtcaccatgcccaataacgaaaaattcgacaaactctacatctggggcgtccaccaccccgtaaccgacagcgaccaaataagcctatacgcccaagcatccggccgaataaccgtatcaaccaaacgcagccaacaaaccgtcatccccaacatcggctaccgaccccgggtacgcgacataagctcccgtatcagcatatactggaccatcgtcaaacccggggacatcctactaatcaactccaccggcaacctcatagcgccgcgaggatacttcaagatccgctcaggcaaatcatccatcatgcgctctgatgcccccatcggcaaatgcaactcagaatgcattacccccaacggctccatccccaacgacaaacccttccaaaacgttaaccgaataacctacggcgcctgcccccgatacgtcaaacaaaacaccctcaaactagcaacgggcatgcgcaacgtcccggaaaaacaaacacgcggcattttcggggcaatcgccgggttcatcgaaaacggctgggaaggaatggtcgacgggtggtacggattccgccaccagaactccgaaggaaccggccaagcagccgacctcaaaagcacacaagccgcgataaatcaaatcaacggcaaactcaacagactcatcggcaaaacaaacgaaaagttccatcaaatcgaaaaagagttctcagaagtcgaaggccgaatacaagacctcgaaaaatacgtcgaagacacgaaaatcgacctctggtcctacaacgccgaactactggtcgccctagaaaaccagcacacgatagacctaaccgacagcgaaatgaacaaactattcgagaggacaaagaaacaactacgcgaaaacgcagaagacatgggaaacggctgcttcaaaatataccacaaatgcgacaacgcgtgtatagaatcaatccgcaacggcacgtacgaccacgacgtctatagagacgaagccctgaacaaccgcttccaaatcaaaggagtcgaactcaaaagcggctacaaagactggatactatggatcagcttcgccatatcctgcttcttgctatgcgtcgcacttctcggctttatcatgtgggcctgccagaaaggcaacatacgctgcaacatctgcata

SEQ ID NO: 58939 - RNA, 1698 nt, synthetic construct
  misc_feature 1..1698: note = derived and/or modified sequence opt11 from anti-influenza_Chain
  source 1..1698: mol_type = other RNA
atgaagaccatcatcgccctgagctacatcctgtgcctggtgttcgcccagaagctgcccggcaacgacaactccaccgcgacactctgcctggggcaccacgccgtcccgaacggcacaatagtcaagacgatcactaatgaccagatcgaagtgacgaacgcaaccgaactggtccagagctcctccaccgggggcatctgcgacagcccccaccagatcctcgacggagagaactgcaccctgatcgacgccctgctcggtgacccacagtgcgacggcttccagaacaaaaagtgggacctgtttgttgagcgcagcaaggcctactccaactgctacccctacgacgtgccggactatgcgtccctgcgatccctcgtcgcaagctccgggacgctggagttcaacgacgagagcttcaactggaccggcgtgacccaaaacgggacctccagctcctgcaagcgccggagcaacaattccttcttcagccgcctgaactggctcacgcacctgaagttcaagtacccggcgctgaacgtgacaatgcccaacaacgagaagttcgacaagctctacatatggggcgtccaccaccccgtgaccgacaacgaccagatcttcctttacgcccaggcgtccgggcgaatcaccgtgtccactaagcgcagccagcagaccgtcatcccgaacatcggctcccggccccgcatcagaaacatcccctctcgcatttccatctactggaccatcgtgaagcccggcgacatcctgctcatcaacagcaccgggaacctgatcgcaccgagaggttacttcaagatccgctcaggaaaatcctccatcatgcgtagcgacgcccccatcggcaagtgcaactccgagtgcataacccccaacggcagcatccctaacgacaaaccattccagaacgtgaaccgcatcacctacggggcgtgcccccgatacgtcaagcaaaacaccctgaaactcgccaccggcatgcgcaacgtgcccgagaagcagacgcgggggatctttggcgcgatagcggggttcatcgagaacggctgggagggcatggtagacgggtggtacggcttccgccaccagaactccgaagggatcggccaggccgcagatctcaagtctacccaggccgcgatcaaccagatcaacgggaagctgaaccggctgatcggcaagaccaacgagaagtttcaccaaatcgagaaggagttctccgaggtcgagggccgaatccaggacctcgagaagtatgtggaggacaccaagatcgatctgtggtcttacaacgccgagctcctggtggccctggagaaccagcacacgatcgatctcaccgactccgagatgaacaagctgttcgagcggaccaagaagcagctgcgcgaaaacgccgaggacatggggaacggctgcttcaagatctaccacaagtgcgacaacgcctgcatcgggtctatccgcaacggcacctacgaccacgacgtctaccgggacgaggcgctcaacaaccgcttccagatcaagggcgtggagctgaagtccggctacaaggactggatcttgtggatcagcttcgccatctcctgcttcctcctgtgcgtggcccttctcggcttcatcatgtgggcctgccaaaaggggaatatccggtgcaacatctgcatc

SEQ ID NO: 58940 - RNA, 1683 nt, synthetic construct
  misc_feature 1..1683: note = derived and/or modified sequence opt11 from anti-influenza_Chain
  source 1..1683: mol_type = other RNA
atggagaaaatagtcctcctcttcgcaatagtaagcctcgtcaaatccgaccaaatctgtatcggctaccacgcgaacaactccacagaacaagtcgacacaatcatggagaaaaacgtaaccgtaacacacgcacaagacatcctcgagaaaacgcacaacggcaaactctgcgacctcgacggagtaaaacccctcatcctcagagactgcagcgtagccggatggctactcggaaaccctatgtgcgacgagttcataaacgtgccagaatggtcctacatagtcgaaaaagcaaacccagtcaatgacctatgctaccccggcgacttcaacgactacgaagaattaaaacacctcctaagtcgcatcaaccacttcgagaaaatccaaatcatccccaaaagcagctggtcaagccacgaagcctccctcggggtcagctccgcttgcccctaccaagggaaatcctccttcttccgcaacgtagtctggctgataaagaaaaactccacataccccacaatcaaacgaagctacaacaacacaaaccaggaagacctcctagtcctatggggaatacaccacccaaacgatgctgccgaacagacaaaactataccaaaaccccaccacatacataagcgtcggcacaagcacactcaaccaacgactcgtaccacgcatcgccacccgctccaaagtaaacggccagagcggcagaatggagttcttctggaccatcctaaaacccaacgacgccataaacttcgaatccaacggcaacttcatcgcccccgaatacgcgtacaaaatagtcaaaaagggagactctaccataatgaagtccgaactcgaatacggcaactgcaacaccaagtgccaaactcccatgggcgcgatcaactccagcatgccattccacaacatacacccattaaccatcggggaatgcccaaagtacgtcaaatcaaaccgcctagtactggcaaccggactccgcaacagcccccaacgcgagcggcgccgcaaaaagcgaggactattcggagcgatagcaggcttcatagaaggcggatggcaaggcatggtagacggctggtacggataccaccactccaacgaacaaggaagcggctacgccgccgacaaagaatctactcaaaaagccatcgacggcgtcacaaacaaagtgaacagcataatagacaaaatgaacacacaattcgaagcagttggccgcgagttcaacaacctcgaacgccgcatcgaaaaccttaacaagaaaatggaagacggcttcctagacgtctggacttacaacgcagaactcctagtgctcatggaaaacgaacgcacactagacttccacgacagcaacgtcaaaaacctctacgacaaagtccgcctacaactccgcgacaacgcaaaagaactcggcaacggctgcttcgagttctatcacaaatgcgacaacgaatgcatggaatccgtccgtaacggaacatacgattacccccaatactccgaagaagccagactgaaaagggaggaaataagcggcgtcaaactcgaaagcatcggcatctaccagatccaacactcaggcggccgctcctccctcgaaggcccccggttcgaacaaaaactcatctcagaggaagacctcaacatgcacacagga

SEQ ID NO: 58941 - RNA, 1683 nt, synthetic construct
  misc_feature 1..1683: note = derived and/or modified sequence opt11 from anti-influenza_Chain
  source 1..1683: mol_type = other RNA
atggaaaagatcgtactgctcctagccatcgtctccctcgtcaaaagcgaccaaatatgcatcggctaccacgcaaacaacagcacagaacaagtcgacacaatcatggaaaagaacgtcaccgtcacacacgcccaagacatactcgagaaaacacacaacggaaaactttgcgacctagacggggttaaaccactcatactcagagactgctcggtcgcaggctggctcctcggcaaccccatgtgcgacgaatttataaacgtacctgaatggagctacatagtagaaaaagctaaccccgccaacgacctatgttaccccggcaacttcaacgactatgaggaactcaaacacctactctcacgcataaaccacttcgagaaaatacaaataataccaaaatcctcctggtccgaccacgaagcctcctccggcgtcagctctgcatgcccgtaccaaggaaaaagctccttcttccgaaacgtcgtctggctaatcaagaaaaacagttcctacccgaccatcaaacgatcctacaacaacacgaaccaagaagacctcctcgtactctggggcatccaccatcccaatgacgccgccgaacaaacgcgactctaccaaaacccaacaacttacatatccgtaggaacttccacactcaaccaacgcctcgtcccgaaaatcgcaacccgcagcaaagtcaacggacaatccgggcgcatggaatttttctggaccatcctcaaacccaacgacgcaatcaacttcgaatccaacggcaactttatcgcccccgaatacgcctacaaaatcgtaaagaaaggcgactcagccatcatgaagtccgaactagaatacggcaactgcaacacaaaatgccaaacacccatgggcgcaatcaatagctcaatgccattccacaacatacaccccctaacaatcggtgaatgcccgaaatacgtcaaatccaaccgcctagtccttgccaccgggctcagaaacagcccccaaagagaacgccgacgcaagaaacggggactcttcggagcaatcgccgggttcatagaaggcggatggcaaggtatggtcgacggctggtacggctaccaccactccaacgaacaaggctcgggctacgccgccgacaaagaatccacccaaaaagccatcgacggcgtgacaaacaaggtaaacagcataatcgacaaaatgaacacacaattcgaagccgtcggccgagagttcaacaatctcgaacgcaggatagaaaacctaaacaaaaagatggaagacgggttcctcgacgtatggacatacaacgccgaactcctagtgctcatggaaaacgaacgcaccctcgacttccacgactcaaatgtcaaaaacctctacgacaaagtacgcctccaactacgagacaacgctaaagaactaggaaacgggtgcttcgagttctatcacaaatgcgacaacgaatgcatggaaagcgtgcggaacggcacctacgactatccacaatactccgaagaagcccgcctcaaacgcgaagaaatatcaggagtcaagctcgaatcaatcggcatctaccaaatccaacactctggcggccgatcctccctagaaggaccccgcttcgaacaaaaactcatctccgaagaagacctcaacatgcacaccggt

SEQ ID NO: 58942 - RNA, 1701 nt, synthetic construct
  misc_feature 1..1701: note = derived and/or modified sequence opt11 from anti-influenza_Chain
  source 1..1701: mol_type = other RNA
atggaaaaaatagtactcttactagcaatagtctccctcgtcaaatccgaccaaatatgcatcggataccacgccaacaacagcaccgaacaagttgacaccatcatggaaaaaaacgtcaccgtcacacacgcacaggacattctagaaaaaacacacaacggaaaattatgcgacctagacggcgtcaagcccctcatcctccgtgactgctcggtagcgggctggctattaggcaaccccatgtgcgacgaattcataaacgtcccagaatggagctacatcgttgaaaaagccaaccccgccaacgacctctgctacccaggaaacttcaacgactacgaggaactcaaacaccttctctcccgcatcaaccatttcgagaaaatacaaatcatctcgaaatcttcctggtcagaccacgaagcttcctccggcgtctccagcgcatgcccctaccaaggaaccccctcattcttccggaacgtcgtctggctaataaaaaaaaacaacacctaccccacaatcaaacggtcctataacaacaccaatcaagaggacctgctaatcctctggggcatccaccacagcaacaacgccgccgaacaaacaaaactgtaccaaaacccaaccacctacatctccgtaggcacttcaaccctaaacctacgcctagtgccaaaaatcgccacccgctccaaagtcaacggacaaagcggccgcatggacttcttctggaccatcctaaaacccaacgacgccatcaacttcgaatcaaacggaaatttcatcgcccccgaatacgcctacaaaatcgtaaagaaaggggactcagcaataatgaaatccgaagtagaatacggcaactgcaacaccaaatgtcaaacaccaataggtgccataaactcctccatgccattccacaacatccaccccctcaccataggcgaatgccctaaatacgtcaaatccaacaaacttgtgcttgccacaggcctccgcaactcaccactccgagagcgaagacgcaaacggggactctttggcgccatagccggattcatcgaaggaggctggcaaggcatggtagatgggtggtacggctaccaccactcaaacgaacaaggatccggatacgcagcagacaaagaatccacccagaaagccatcgacggcgtaaccaacaaagtcaactcaattatagacaaaatgaacacacagttcgaagcggtaggtcgagaattcaacaacctagaacgccgcatcgaaaacctcaacaaaaagatggaagacggattcctcgatgtatggacctacaacgctgaactcctcgtactaatggaaaacgaacgtacactcgacttccacgactcaaacgtcaaaaacctctacgacaaagtccgcctccaactacgagacaacgccaaagaactcggaaacggctgcttcgaattctaccacaagtgtgacaacgaatgcatggaatccgtccgaaacggcacctacgactacccccaatactccgaagaagccagactcaagcgcgaagaaatcagcggggtaaaactcgaaagcatcggcacctaccaaatcctctctatatactcgacagtagcaagctcactcgccctagccatcatggtcgcaggcctctccctgtggatgtgcagcaacggatcactccaatgccgaatctgcatc

SEQ ID NO: 58943 - RNA, 1701 nt, synthetic construct
  misc_feature 1..1701: note = derived and/or modified sequence opt11 from anti-influenza_Chain
  source 1..1701: mol_type = other RNA
atggagaaaattgtcctcctcctagccatagtctccctagtcaaatccgaccaaatatgcataggataccatgccaacaactccaccgaacaggtagacaccataatggagaaaaacgtaacagtcacacacgcccaggacatactcgagaaaacacacaacggaaaattatgcgacctcgacggcgtcaaacccctaatcctccgagactgtagcgtcgccggatggctactcggcaaccccatgtgcgacgagttcatcaacgtccccgaatggtcctacattgtcgaaaaagccaaccccgcaaacgacctctgctacccaggaaacttcaacgactacgaagaactaaaacacctactatcccgtatcaaccacttcgagaaaatccaaatcataccaaaaagctcctggtctgaccatgaagccagcagcggagtaagctctgcctgcccataccaaggcaccccatcattcttccggaacgtggtctggctcatcaagaaaaacaacacctaccccacaatcaaacgctcctacaacaacaccaaccaagaagacctcctcatcctatggggaatccaccacagcaacgacgccgctgaacaaaccaaactataccaaaatcccaccacatacatcagcgtcggaacctcaaccctcaaccaacgcctcgtacccaaaatcgcaacccgaagcaaagtcaacggccaaagcggaagaatggatttcttctggaccatcctcaaaccaaacgacgcaatcaacttcgaatccaacggcaacttcatcgccccggaatacgcctacaaaatcgtcaagaaaggcgacagcgccatcgtaaaatcagaagtcgaatacggcaactgcaacactaagtgccaaacccccataggcgccatcaactcatcaatgcccttccacaacatccacccactgaccattggagaatgccccaagtacgtcaagagcaacaaacttgtcctcgccacagggcttcgcaactctcccctccgcgaacgaagaagaaagcgcggactcttcggtgccattgccggcttcatcgaaggaggctggcaaggcatggtcgacggctggtacggttaccaccactccaacgaacaaggctccggctacgccgccgacaaagaatcaacccaaaaagccatcgacggcgtcacgaacaaagtcaactctataatcgacaaaatgaacacccaattcgaagccgtaggcagagagttcaacaacctcgaacgccgaatcgaaaacctcaacaagaaaatggaagacggattcctcgacgtctggacctacaacgctgaactactcgttctaatggaaaacgaacgcacactagactttcatgactctaacgtcaaaaacctatacgacaaagtacgcctacaactgcgcgacaacgcaaaagaactcggcaacggatgcttcgagttctaccacaaatgcgacaacgaatgcatggaaagcgtacggaacggcacctacgactacccccagtactccgaagaagcacgactcaaacgcgaggaaatcagcggagtcaaactcgaatcaatcggaacctaccaaatactcagcatctactcaacagtcgcaagctcactcgccctcgcaataatggtagcaggcctatccctctggatgtgctccaacggatccctacaatgccgcatctgcatc

SEQ ID NO: 58944 - RNA, 1683 nt, synthetic construct
  misc_feature 1..1683: note = derived and/or modified sequence opt11 from anti-influenza_Chain
  source 1..1683: mol_type = other RNA
gacaaaatatgcctcggccaccacgccgtgagcaatggaacaaaagtcaacacactaacagaaaggggagtcgaggtcgttaacgccacggaaacagtagaacgcaccaacgtacccagaatatgcagcaaaggtaaacgaacggtcgatctcggccaatgcggcctactcggcaccatcaccggcccaccccaatgcgaccaattcctagagttcagcgccgacctcataatcgaacgacgcgaaggctcagacgtatgctaccccggcaaattcgtaaacgaagaagccctacgacaaatactacgcgaaagcgggggaatagacaaagaaacaatgggcttcacatacagcggcatccgaaccaacggcacaaccagcgcctgccggcgatcagggagcagcttctacgcagaaatgaaatggctactaagcaacacagacaacgcagcattcccccaaatgacaaaatcctacaaaaacacaagaaaggaccccgcactgataatctggggcatccaccacagcggcagcaccacagaacaaaccaaactctatggatcgggaaacaaactcataaccgtcggaagctcaaattaccaacaatcatttgtcccaagccccggcgcacgaccgcaggtcaacggacaatcaggccgtatcgacttccactggctaatactgaacccgaacgacaccgtaaccttcagcttcaacggagcattcatagccccagaccgcgcgagcttcctaaggggcaaaagcatgggaatccaatcagaagtccaagtcgacgcaaactgtgaaggcgactgctaccactccggcggcacaataataagcaacctaccgttccaaaacataaactctcgcgcagtaggaaaatgcccacgctacgtaaaacaagaaagcctgctactcgcgaccggcatgaaaaacgtccctgaaatccccaaaagacgcagacgcggactcttcggcgcgattgccggattcatcgagaacgggtgggaaggcctgatagacggctggtacggattccgacaccaaaacgcgcaaggagaaggaacagcggccgactacaaaagcacacaatccgccatcgaccaaatcacaggcaaactaaaccgactcatagagaaaaccaaccaacaattcgaactcatcgataacgagttcacagaagtcgaacgacaaatagggaacgtaataaactggacccgcgactccatgaccgaagtatggtcctacaacgcggaactcctagtagcaatggaaaatcaacacaccatagacctagcggactccgaaatgaacaaactatacgaacgagtcaaacgccaactcagggaaaacgccgaagaagacggaacaggctgcttcgaaatcttccacaaatgcgacgacgactgcatggccagcattcggaacaacacctacgaccactccaaataccgcgaagaggcaatccaaaaccgcatacaaatagatcccgtaaagctctccagcggctacaaggactcaggcaggctagtcccccggggcagcccaggctccggatacataccagaagctccgcgcgacggccaagcctacgttaggaaagacggcgaatgggtcctactctccaccttcctgggaaaacccatccccaaccccctactaggcctcgacagcacaggc

SEQ ID NO: 58945 - RNA, 1701 nt, synthetic construct
  misc_feature 1..1701: note = derived and/or modified sequence opt11 from anti-influenza_Chain
  source 1..1701: mol_type = other RNA
atggaaaagatcgtcctcctgctggcaatcgtaagcctagtaaaatccgaccaaatatgcataggctatcacgccaacaactcaaccgaacaagtggacaccataatggaaaagaacgtaaccgtcacccacgcacaagacatcctcgagaaaacccacaacggaaaactttgcgacctggacggcgtcaaacccctcatacttcgagactgctccgtcgcaggctggctactgggcaaccccatgtgcgacgaatttatcaacgtccccgaatggtcctacatcgttgaaaaagccaaccccgccaacgacctatgctacccaggcaacttcaacgactacgaagaactcaaacatcttctctcccgcatcaatcacttcgagaaaatacaaatcatccccaaatcctcctggagcgaccacgaagcctcctccggcgtcagcagcgcctgcccataccaaggcaccccatccttcttccgcaacgtcgtctggctgatcaagaaaaacaacacctaccccacgataaaacgatcatacaacaacaccaaccaagaagacttactcatcctctggggcatccaccactcaaacgacgccgccgaacagacgaaactgtatcaaaaccccacaacctacataagcgtaggcacatccacactaaaccaacggctcgtccccaaaatcgccacccgatccaaagtaaacggccaaaacggacgaatggacttcttctggaccattctcaaacccaacgacgccatcaacttcgaatccaatggaaacttcatcgctcccgaatacgcctacaaaatcgtcaagaaaggcgactccgccatcgtcaaatcagaagtcgaatacggaaactgcaacacgaaatgccaaacacccatcggcgccataaacagcagcatgccattccacaacatccaccctctcaccatcggggaatgccccaaatacgtaaaatccaacaaattagtactcgcaaccgggctgcggaactcaccactccgcgaaagaagacgcaaacgaggcctcttcggcgccatcgccggcttcatagaaggcggatggcagggaatggtcgacggatggtacggataccaccactccaacgaacaaggcagcggctacgccgcagacaaagaatccacccaaaaagccatcgacggcgtcaccaacaaagtgaactccatcatagacaaaatgaacacccaattcgaagccgtcggaagagaatttaataacctcgaacgacgcatcgaaaaccttaacaagaaaatggaagacggcttcctagacgtctggacctacaacgccgaactcctcgtcctaatggaaaacgaacgcaccctcgacttccacgactcaaacgtcaaaaacctttacgacaaagtacgacttcaactccgcgacaacgccaaagaactcggtaacggatgcttcgagttctaccacaaatgtgacaacgaatgcatggaaagcgtaagaaacggcacctacgactacccccaatactcagaagaggcacgcctaaaacgggaagagataagcggcgtaaaactcgaatctatcggcacctaccaaatcctctcaatatactcaaccgtcgcctcatccctcgccctagccataatggtagccggcctatcactatggatgtgctctaatggctcgctccagtgccgcatctgcatc

SEQ ID NO: 58946 - RNA, 1683 nt, synthetic construct
  misc_feature 1..1683: note = derived and/or modified sequence opt11 from anti-influenza_Chain
  source 1..1683: mol_type = other RNA
gacaaaatctgcctcggccaccacgccgtcagtaacggaaccaaagtgaatacgctcacagaacggggagtagaagtcgtaaacgctacagaaaccgtggaacgcaccaacgtaccccgaatatgctcaaaaggcaaacgaacagtcgacctggggcaatgcgggctcctcggaaccatcaccggacccccgcaatgcgaccaattcctcgagttcagcgcagacctcatcatcgaaagacgcgaaggcagcgacgtgtgctaccccggcaaattcgtcaacgaagaagccctcagacaaatccttcgcgaaagcggaggaatcgacaaggaaacaatgggattcacctactcaggaataagaacaaacggaaccaccagcgcatgccggagatcaggcagctcattctacgctgaaatgaagtggctactcagcaacaccgacaacgcagcattcccacaaatgaccaaatcctacaaaaacacccgcaaagaccccgcactaatcatctggggaatccaccacagcggctcaacaacagaacaaaccaaattatacggatccggaaacaaacttatcacagttggcagcagcaactaccaacagtccttcgtcccaagtccaggagcccgtccccaggtgaacgggcagagcggccgaatcgacttccactggttaatcctcaaccccaacgacaccgtcaccttcagcttcaacggcgccttcatcgcacccgaccgcgcctcattcctcagaggaaaaagcatgggcatccaatcagaagtccaagttgacgccaactgcgaaggagactgctaccacagcggcggcacaatcatctccaacttaccattccagaacatcaacagccgagccgtcggcaaatgcccacgatacgtgaaacaagaaagcctcctactcgcaaccgggatgaaaaacgtaccagaaatcccgaaacgacgaagacgagggctattcggcgccatagcaggcttcatcgaaaacggctgggaaggcctaatcgacggctggtacggattccgacaccagaatgcccaaggcgaaggaacagccgcagactacaaaagcacccaatccgcaatcgaccaaatcacaggcaaactaaaccgcctcatagagaaaaccaaccaacagttcgaactgatagacaacgagttcaccgaagtcgaacgccaaatcggcaacgttatcaactggaccagagactccatgaccgaagtgtggtcctacaacgcagaactactcgtagcaatggagaaccaacacacaatagacctcgctgactccgagatgaacaaactctacgaacgagtcaagcgccaactaagagaaaatgcagaagaagacggaaccggatgcttcgaaatattccacaaatgcgacgacgactgcatggcctctataagaaacaacacctacgaccacagcaaatacagggaagaagccatccaaaaccgtatccaaatcgaccccgtaaaactctccagcggatacaaagacagcggccgcctcgtaccacgaggcagccccggatccggctacataccagaagcaccacgcgacggccaagcctacgtacgaaaagacggcgaatgggtcctcctctccacattcctaggcaaaccaatccccaacccactcctcggcctagattccaccgga

SEQ ID NO: 58947 - RNA, 1683 nt, synthetic construct
  misc_feature 1..1683: note = derived and/or modified sequence opt11 from anti-influenza_Chain
  source 1..1683: mol_type = other RNA
atggaaaagattgtcctactattcgccatcgtatccctggtgaaatccgaccaaatctgcatcggctaccacgcaaacaactcaaccgaacaagtagacaccatcatggagaaaaacgtgaccgtcacacacgcccaagatatcctcgaaaagacacacaacggaaaactctgcgacctagacggcgtaaaaccactcatactccgggactgctcagtagcaggctggttactcggcaaccccatgtgcgacgagttcatcaacgtacccgaatggagctacatagtcgaaaaagccaacccagtcaacgacttgtgctaccccggagacttcaacgactacgaagaacttaaacacctcctatcccgcattaaccacttcgagaaaatacaaatcatcccaaagtcctcctggtcctcacacgaagcatccctcggtgtatcctccgcctgcccctaccagggaaaaagctcattcttcaggaacgtagtctggctaatcaagaaaaacagcacctatcccaccataaaacgctcctacaacaacaccaatcaagaagacctcctcgtcctatggggcatacaccacccgaacgacgccgccgaacaaacaaaactctaccaaaaccccaccacctacatctcagtaggcacatcaacactcaatcaacggctcgtcccaagaatcgccacacgctcgaaagtaaacggccaatccggccgcatggagttcttctggacaatccttaaaccaaacgacgccataaacttcgaatcgaacggcaacttcatcgccccagaatacgcatacaaaatcgtcaagaaaggagactcaaccataatgaaaagcgaactagaatatggtaactgcaacaccaaatgccaaacccctatgggagccatcaactcaagcatgcccttccacaacatccaccccctaaccataggagaatgtccaaaatacgtaaaatccaaccgcctagtcctcgccacaggcctcagaaactccccacaacgagaacgccgccgaaagaaacgaggtctgttcggagccatcgcaggattcatcgaagggggctggcaaggcatggtcgacggctggtacggctaccaccacagcaacgaacaaggatcaggctacgccgcagacaaagaaagcacccaaaaagcaatagacggcgttacaaacaaagtcaactccatcatagacaaaatgaacacccagttcgaagcagtcggaagagagttcaacaacctcgaacgaagaatagaaaacctcaacaagaaaatggaagacggcttccttgacgtctggacctacaacgccgaactgctagtcctcatggaaaacgaacgcaccctagacttccacgactcaaacgtcaaaaacctatacgacaaagtccgccttcaactccgcgacaacgccaaagaactgggcaacggctgcttcgagttctaccacaaatgcgacaacgaatgcatggaatcagtccgaaacggcacctacgactacccacaatactccgaggaggcacgcctaaaacgcgaagaaatatcaggcgtaaaactcgaatccatcggcatctaccaaattcaacacagcggcggaagatcctccctcgaaggaccccgcttcgagcaaaaactcatcagcgaagaagacctcaacatgcacacaggc

SEQ ID NO: 58948 - RNA, 1683 nt, synthetic construct
  misc_feature 1..1683: note = derived and/or modified sequence opt11 from anti-influenza_Chain
  source 1..1683: mol_type = other RNA
atggagaaaatcgtactcctcctagcaatagtctccctagtaaaaagtgaccaaatctgcatagggtaccacgccaacaactccaccgaacaagtcgacaccataatggagaaaaacgtaacggtaacacacgcccaagacatactcgagaaaacccacaacggcaaactatgcgacctcgacggcgtcaaacctctcatcctacgcgactgcagcgtcgccgggtggctcctcggtaaccccatgtgcgacgagttcatcaacgtacctgaatggagctacatcgtagaaaaagccaaccccgccaacgacctctgctacccaggcaacttcaacgactatgaagaactcaaacacctcctctcccgaatcaaccacttcgagaaaatccaaatcataccaaaaagttcatggtccgaccacgaagcctcctcaggggtatcatcagcctgcccctaccaaggcaaatcctccttcttccgcaacgtggtgtggctcataaagaaaaactcgtcatatccaaccatcaaacgctcctacaacaataccaaccaagaagacctacttgtactctggggcatccaccacccaaacgacgccgcagaacaaacgcgcctctaccaaaaccccaccacctacattagcgtcggcaccagcaccctaaaccaacgactcgtacctaaaatcgcaacccgcagcaaagtaaacggacaatcagggcggatggagttcttctggaccatcctcaaacccaacgacgccatcaacttcgaaagcaacggcaacttcatagcaccggaatacgcatacaaaatcgtcaagaaaggagactccgccatcatgaaatccgaactcgaatacggcaattgcaacacaaaatgccaaacacccatgggagccataaacagctccatgccattccacaacatccaccccctcaccatcggagaatgcccaaaatacgtaaaaagcaaccgcctggtactcgctacaggcctcagaaactccccacaacgcgaacgccgacgcaagaaacgtggcctcttcggcgccatcgccggcttcatcgaaggcggctggcaaggcatggtcgacggctggtacggataccaccacagtaacgaacaaggatcaggctacgccgccgacaaagaatcaacccaaaaagcaatcgacggcgtcactaataaggtcaacagcataatcgataagatgaacacacaattcgaagctgtaggaagagaatttaacaacctcgaacgccgtatcgaaaacctcaacaagaaaatggaagacggattcctcgacgtatggacctacaacgccgaactcctagtcctaatggaaaacgaacgaacactcgatttccacgactccaatgtcaaaaatctatacgataaagtccgactccaactgagagacaacgcaaaagaactcggcaacggctgcttcgagttctatcacaaatgcgacaacgaatgcatggaaagcgtccgtaacggtacatacgattacccacaatacagcgaagaagccagactcaaaagagaggaaatctccggagtcaaactcgaatctataggaatataccaaatccaacatagcggcgggagatcctccctcgaagggccccgcttcgaacaaaaactaatcagcgaggaagacctcaacatgcacaccggc

SEQ ID NO: 58949 - RNA, 1701 nt, synthetic construct
  misc_feature 1..1701: note = derived and/or modified sequence opt11 from anti-influenza_Chain
  source 1..1701: mol_type = other RNA
atggaaaagatcgtcctactcctcgccatagtctccctcgtcaaatccgaccaaatatgcatcggataccacgccaacaactccacagaacaagtagacaccatcatggagaaaaacgtaaccgtaacccacgcccaagacatcctggagaaaacacacaacggaaaactatgcgacctcgacggcgtcaaaccactaatcctccgcgactgctccgtcgccggatggctactaggtaacccaatgtgcgacgagttcatcaacgtcccagaatggtcatacatcgtcgaaaaagctaacccggccaacgacctatgctacccaggcaacttcaatgactacgaagaactcaaacatctactcagcagaatcaaccacttcgagaaaatccaaataatcccaaaatcctcctggtccgaccacgaagccagcagcggcgtatcctcagcgtgcccctaccaaggaacccccagctttttccgcaacgtcgtatggctcatcaaaaagaacaacacctaccccaccataaaacgatcttacaacaacacgaaccaagaagacttactcatactatggggaatccaccactccaacgacgccgcagaacaaaccaaactataccaaaaccccacaacctacatatccgtcggcaccagcaccctcaaccaacgcctcgtccccaaaatcgccacacgctcaaaagtaaacggccaaaacggacgaatggacttcttctggaccatcctcaagccaaacgacgccataaacttcgaatccaacggcaacttcatagcacccgaatacgcatacaaaatcgtcaagaaaggcgactcggcaatcgtaaaatccgaagtagaatacggcaactgcaacaccaaatgccaaaccccaatcggagccatcaactcatcaatgcccttccacaacatccaccccctaaccatcggcgaatgccccaaatatgtcaaaagcaacaaacttgtcctagcaaccggcctacgaaactccccactaagggaacggcgcagaaaacgcggtctcttcggagccatcgccggctttatcgaaggaggctggcagggcatggtagacggctggtacggctaccaccactcaaacgaacaaggatccggctacgctgcagacaaagaaagcacacaaaaagcgattgatggagtcacgaacaaagtcaactccatcatcgacaagatgaacacacaatttgaagccgtcggccgcgagttcaacaacctcgaaagacgcatcgaaaacctcaacaagaaaatggaagacggattcctcgatgtctggacctacaacgcagaactgctagtgctcatggaaaacgaacgcaccctggacttccatgacagcaatgtcaaaaacctctacgacaaagtccgcctccaactccgcgacaacgctaaagaactcggcaacggatgcttcgagttctaccacaaatgcgacaacgaatgcatggaatcagtccgcaacggcacgtacgactacccacaatactctgaagaagcgcgactcaaacgggaagaaatctcaggagtaaaactggaatcaatcggcacctaccaaatcctaagcatctacagcactgttgcctcctcactcgctctcgcaatcatggtggcaggacttagcctgtggatgtgctccaacggatccctacaatgccgcatctgcatc

SEQ ID NO: 58950 - RNA, 1701 nt, synthetic construct
  misc_feature 1..1701: note = derived and/or modified sequence opt11 from anti-influenza_Chain
  source 1..1701: mol_type = other RNA
atggagaaaatagtcctcctactcgcaatagtcagcctcgtcaaatctgaccagatatgcatcgggtaccacgccaacaactccaccgaacaagtagacactatcatggaaaagaacgtgaccgtcacccacgcccaagacatcctagagaaaacccacaacggcaaactctgcgacctcgacggcgtcaaaccgctaatactccgagactgcagcgtagccggatggctactaggcaacccaatgtgcgacgagttcatcaacgttcccgaatggtcctacattgtagaaaaagcaaaccccgccaacgacctatgctacccgggcaatttcaacgactacgaagaactcaaacacctcctctcccgcatcaaccacttcgagaaaatccaaatcatctcaaaatccagctggtccgaccacgaagcctccagcggcgtctcatccgcatgcccctaccaaggcacaccatcattcttccgcaacgtcgtgtggctcataaagaaaaacaacacctacccaaccatcaaacgatcatacaacaacaccaaccaagaagacctcctaatactttggggaatccaccacagcaacaacgcagcagaacagacaaaactctaccaaaacccgaccacctacatcagcgtgggaacaagcaccctcaacctccggttagtccccaaaatagccacacgcagcaaagtaaacggccaaagcggcagaatggacttcttctggaccatactcaaacccaacgacgccataaacttcgaaagcaacggcaacttcatcgccccggaatacgcctataaaatagtaaagaaaggcgactcggccataatgaaatccgaagtcgaatacggcaactgcaacacaaaatgccaaacacccatcggcgccatcaacagctccatgcctttccacaacatacaccccctcacaatcggcgaatgcccaaaatacgtaaaatccaataagctagtcctagcaacaggactccgcaactccccgctacgagaacgacgtcgcaagcgaggactcttcggggcaatagcgggcttcatcgaaggcggatggcaagggatggtagacggttggtacggctatcaccacagcaacgaacaagggtccggctacgcagcagacaaagaaagcacccaaaaagcaattgacggcgtcacaaacaaagtaaacagcattatagacaaaatgaacacccaattcgaagcagtcggacgagagttcaacaacttagaaagacgcatcgaaaacctcaacaagaaaatggaggacggcttcctagacgtgtggacgtacaacgccgagctcctcgtcctgatggaaaacgaacgcaccctcgacttccacgactcaaacgtgaaaaatctctacgacaaagtccgcctccaactccgcgacaacgctaaagaactaggcaacggctgcttcgagttctaccacaaatgcgacaacgaatgcatggaaagcgtccggaacggcacatacgactacccccaatactccgaagaagccagattaaagcgcgaagaaatctccggggtaaaactcgaaagcatcggcacttaccaaatcctatccatctactccaccgtagcctcatccctagcactcgcaatcatggttgcaggcctctcactctggatgtgctcaaacggctcactccaatgccgaatctgcatc

SEQ ID NO: 58951 - RNA, 1701 nt, synthetic construct
  misc_feature 1..1701: note = derived and/or modified sequence opt11 from anti-influenza_Chain
  source 1..1701: mol_type = other RNA
atggagaaaatcgtcctgctactggcaatagtctccctagtcaaatccgaccaaatatgcatcggctaccacgctaacaactccaccgaacaagtagacaccatcatggaaaagaacgtaaccgtcacccacgcccaagacatcctcgaaaagacacacaacggcaaactctgcgacctagacggcgtcaaacccctcatactccgggactgctcagtcgcaggctggctcctcggcaacccaatgtgcgacgagttcatcaacgtaccggaatggtcatacatagtcgaaaaagcaaacccagccaacgacctctgttacccaggaaatttcaacgactacgaagagttaaaacacctcctatcacgcatcaaccacttcgagaaaatccaaatcataccaaaatcaagctggagcgaccacgaagcatcctccggcgtcagcagcgcctgcccttaccaaggcactccctccttcttccgaaacgtagtatggctgatcaagaaaaacaacacatacccaaccataaaaagatcctacaacaacacaaaccaagaagacctcttaatactctggggcatccaccactccaacgacgccgcagaacaaacgaaactctaccagaacccaaccacctacatcagtgtaggcacctccaccctaaaccaacgcctagtcccaaaaatcgccacaagatccaaagtcaacggccaatccggacgtatggacttcttctggaccatcctcaaacccaacgacgctataaacttcgaaagcaacggtaacttcatcgcacccgaatacgcctacaaaatcgtcaagaaaggcgactccgccatcgtcaaaagcgaagtagagtacggaaactgcaacacaaaatgccaaacccccatcggtgccatcaacagctccatgcccttccacaacatccatccactcaccatcggtgaatgccccaaatatgtcaaatccaacaaactcgtcctcgcaacaggactacgcaattcacctctcagagaacgacgccggaaacgcggactcttcggagcaatagccggattcatagaagggggatggcaaggcatggtcgacggctggtacggataccaccactcaaacgaacaaggatctggctacgccgcagacaaagaatcaactcaaaaagcgatcgacggcgtaacgaacaaagtcaactcaataatcgacaaaatgaacacccaattcgaagccgtcggacgcgagttcaacaacctcgaacgccgcatcgaaaatctcaacaagaaaatggaagacggattcctcgacgtctggacatacaacgccgagctactcgtccttatggaaaacgaacgcaccctagatttccacgactccaacgtgaaaaacctatacgacaaagtacgcctccaactacgcgacaacgcaaaagaactcggcaacggctgcttcgagttctaccacaaatgcgacaacgaatgcatggaaagcgtccgcaacggcacgtacgactacccccaatactccgaagaagcccgcctgaaacgcgaagaaatctcaggcgtaaaactagaatccatcggaacttaccagatcctcagtatatactccaccgtcgcctcctccctcgccctcgccatcatggtggccgggctctccctatggatgtgcagcaacggttcactccaatgccgaatctgcatt

SEQ ID NO: 58952 - RNA, 1704 nt, synthetic construct
  misc_feature 1..1704: note = derived and/or modified sequence opt11 from anti-influenza_Chain
  source 1..1704: mol_type = other RNA
atggaaaagatagtccttctcctcgcaatagtcagcctagtaaaatcagaccaaatctgcatcggctaccacgccaacaacagcacagaacaagtcgacaccatcatggaaaagaacgtcactgtcacccacgcacaggacatactagaaaagacccacaacggcaaactctgtgacctcgacggagtcaaacccctgatcctccgcgactgctccgtcgccggttggctactaggaaacccaatgtgcgacgagttcctaaacgtacccgaatggtcctacatcgtggaaaagatcaaccccgcaaacgacctctgctaccccggggatttcaacgactacgaagaactcaaacacctactctcacgcataaatcacttcgagaaaatccaaattatccccaaatcctcctggagcgactacgaagccagctccggagtaagcagcgcctgcccttaccaaggccgctctagcttcttccgaaacgtcgtgtggctcatcaagaaaaacaacgcctaccccacaataaaacgctcctacaacaacacgaaccaagaagacctccttgtgctctggggcattcaccacccaaacgacgccgccgaacaaatacgcctctaccaaaacccaaccacatacatctcgataggaacaagtaccctaaaccaacgactggtgccaaaaatcgcaacccgcagcaaagtcaatggacagtccggccgcatggagttcttctggaccatacttaaatccaacgacgcaatcaacttcgaatccaacggaaacttcatagcccccgaatacgcatataaaatcgtgaagaaaggcgactccaccataatgaaatccgaacttgaatacggcaactgcaacaccaaatgccagacacccataggagcgatcaacagctcaatgcccttccacaacatacaccccctcacgatcggcgaatgccccaaatacgtcaaatccaaccgcctagtcctagccacaggactccgtaacagcccccaaggagaacgacgccgccgcaaacgcggactattcggggccatagccggcttcatcgaaggaggatggcaggggatggtcgacggctggtatggttaccaccacagcaacgaacagggctcaggatatgccgccgacaaagaatccacacaaaaagccatagacggtgtcaccaacaaagttaactccataataaacaaaatgaacacacaattcgaagcagttggccgcgagttcaacaacctcgaacgccgcatagaaaacctcaacaagaaaatggaagacggattccttgacgtctggacctacaacgcagaactcctagtcctaatggaaaacgaacgcacactggactttcacgactcaaacgtcaaaaacctatacgacaaagtccgcctccaactgcgagacaacgccaaagaactaggcaacggctgcttcgagttctaccaccgatgcgacaacgaatgcatggaatcagtgcgcaacggaacttacgactacccacaatacagcgaagaagcaagactcaaacgtgaagaaatatccggcgtcaaactagaatccatgggcatctaccagatcctatccatctactccaccgtcgcatcctccctcgccctagccatcatggtggcaggcctattcctgtggatgtgctccaacggcagcctccaatgtcggatctgcatc

SEQ ID NO: 58953 - RNA, 1704 nt, synthetic construct
  misc_feature 1..1704: note = derived and/or modified sequence opt11 from anti-influenza_Chain
  source 1..1704: mol_type = other RNA
atggaaaagatagtcctcctactagcaatcgtaagcctcgtaaaatccgaccaaatctgcatcggttaccacgccaacaacagcacagaacaagtagacaccatcatggaaaaaaatgtcaccgtaactcacgcccaggacatcctcgaaaaaacccacaatggcaaactctgcgacctcgacggcgtcaaacctctcatcctgcgggactgttcagttgccgggtggctcctaggcaaccccatgtgcgacgaatttatcaacgtcccagaatggtcttacatcgtcgaaaaagccaaccccaccaacgatctctgctaccccggctccttcaacgactacgaagagcttaaacacctcctatcccgcatcaaccacttcgaaaaaatccaaatcatccccaaatcttcctggtccgaccacgaagcctcctcgggagtctcatccgcctgcccctacctaggctctccaagcttcttcagaaatgtcgtctggctaataaaaaaaaattccacataccccaccatcaagaaatcctacaacaacacaaaccaagaagacctcctagtactctggggcatccaccaccccaacgacgcagccgaacaaacccgcctctaccaaaaccccaccacatacatatcgattggaacctccactttaaatcaaagactcgtcccaaaaatcgccacacgctcaaaagtcaacggccaaagcggccgtatggaattcttctggaccatcctcaaacccaacgacgccatcaactttgaaagcaacggcaacttcatcgcccccgaatacgcatacaaaatcgtcaaaaaaggcgactccgccatcatgaaatctgaactcgaatacggcaactgcaacaccaaatgtcaaacacccatgggcgccatcaactcatccatgccattccacaacatccaccccctcacaatcggcgaatgccccaaatacgtcaaaagcaaccgcctagtactagcaacaggactccgcaacagcccccaacgtgaatcccgacgcaagaaacgaggcctgtttggcgccattgccggcttcatagaagggggctggcaaggtatggtcgacggctggtacggataccaccacagcaacgaacaaggctccggctacgccgccgacaaagaatccacccaaaaggccatagacggagtcacaaataaagtgaattccatcatagacaaaatgaacacccaatttgaagcagtcggacgcgaattcaacaacctggaacgccgcatagaaaatctcaacaaaaaaatggaggacggcttccttgacgtctggacttacaacgccgaactactcgtcctaatggaaaacgaaagaaccctggactttcatgactcaaacgtcaaaaacctatacgacaaagtccgactccagctccgcgacaacgcaaaagagctaggcaacggatgcttcgaattctaccataaatgcgacaacgagtgcatggaatccatccgcaacggcacctacaactacccacagtacagcgaagaggcccgacttaaacgagaagagatctcaggcgtcaaactcgaatcaatcggaacctaccaaatactctccatatactccaccgtcgcctcctccctagccctagccatcatgatggccggcctcagcctatggatgtgctcaaacggctcactccaatgccgcatctgcatt

SEQ ID NO: 58954 - RNA, 1704 nt, synthetic construct
  misc_feature 1..1704: note = derived and/or modified sequence opt11 from anti-influenza_Chain
  source 1..1704: mol_type = other RNA
atggagaaaatagtactcctcttcgccatagtaagcctggtgaaatccgaccagatatgcatcggataccacgccaacaactcgaccgaacaagtggacacaatcatggagaaaaacgtcacagtcacccacgcccaagacatccttgagaaaacccacaacggaaaactctgcgacctcgacggagtcaaacccctcatcctccgcgactgcagcgtcgccggttggctactaggaaaccctatgtgcgacgaatttatcaacgtccccgaatggtcttacatcgtagaaaaagccaacccagtcaacgacctgtgctaccccggcgacttcaacgactacgaagaactcaagcacctactctcaagaataaaccacttcgagaaaatccaaataatcccgaaaagcagctggtcatcccacgaagccagcctgggcgtctcctcggcatgtccctaccaaggcaaatcctccttcttcagaaacgtcgtttggctcataaagaagaactccacataccccaccatcaaaagatcctacaacaacaccaaccaagaggacctccttgtgctctggggcatacaccaccccaacgacgcagccgaacaaacaaaactataccaaaaccctaccacctacattagcgtaggcacctcgacgctgaatcaacgactcgtcccacgaatcgcaacccgctccaaagtcaacggccaatccggccgaatggaatttttctggaccatcctcaaaccaaacgacgctataaacttcgaatcaaacggaaacttcatcgcccctgagtatgcctacaaaatcgtaaagaagggcgactccacgatcatgaaatccgaactcgaatatggaaactgcaacaccaaatgccagacaccaatgggcgccatcaacagctccatgcccttccacaacatccaccccctaacgatcggagaatgcccaaaatacgtcaagtccaaccgcctcgtcctcgcaaccggcctccgaaacagcccacaaagagaacgccgccgcaagaaacgcggtctcttcggcgcaatagctggattcatcgaaggcggatggcaaggaatggtagacggatggtacggctaccaccactcaaacgaacaaggctccggctatgcagccgacaaagaatcgacacaaaaagcaatagacggagtcacaaacaaagtcaactccatcatagacaaaatgaacacccaattcgaagcagtaggccgcgagttcaacaacctcgaacgacgcatcgaaaacctaaacaagaaaatggaagacggcttcctcgacgtctggacttacaacgcggaactactcgtactcatggaaaacgagcgaacactagacttccacgactccaacgtcaaaaacctttacgacaaagtgcgcctccagctccgagacaacgccaaagaactcggaaacggctgcttcgagttctaccacaaatgcgacaacgaatgcatggaatccgtccgaaacggcacatacgactacccacaatacagcgaagaagcccgcctcaaacgcgaagaaataagcggagtcaaactcgaatcaataggcatataccaaatactctccatctactccacagtggcctccagcctagcactggcaatcatggtcgcaggcctaagcctttggatgtgcagcaacggctccctccaatgccggatatgcatc

SEQ ID NO: 58955 - RNA, 1704 nt, synthetic construct
  misc_feature 1..1704: note = derived and/or modified sequence opt11 from anti-influenza_Chain
  source 1..1704: mol_type = other RNA
atggagaaaatcgtcctgctactcgcaatcgtgagcctcgtcaaatccgaccagatctgcataggctaccacgccaacaacagcacggaacaggtagacacaatcatggaaaagaacgtcacagtcacgcacgcccaagacatcctagagaaaacacacaacggcaagctatgcgacctagacggcgtcaaaccactcatcctccgagactgcagtgtagccggctggctactcggcaacccaatgtgcgacgagttcctcaacgtcccagaatggagctacatcgtagaaaagataaacccagccaacgacctctgctacccaggcgactttaacgactacgaagaactcaaacacctcctaagccgcatcaaccacttcgagaaaatccaaatcatccctaaatcctcctggagcgactacgaagcctcctctggagtatcctccgcctgcccataccaaggcagaagcagcttcttcagaaacgtagtctggctgatcaaaaagaacaacgcctaccccaccataaaacgctcatataacaacactaaccaagaagacctactggtcctctggggcattcaccaccccaacgacgccgcggaacaaatccgcctttaccaaaaccccaccacctacatctcaatcggaacctccacgctcaaccaacgtctggtcccaaagatagccacacgcagcaaagtcaacggacaaagcggacgaatggagttcttctggaccatactaaaatccaacgacgcaatcaacttcgaaagcaacggaaacttcatcgcccccgaatacgcctacaaaatagtcaagaaaggagactccacaattatgaaatccgaactcgaatacggcaactgcaatacaaaatgccaaaccccaatcggagccatcaactcatccatgcccttccataacatccacccccttacgatcggagaatgcccgaagtacgtaaaatcgaaccgcctagtcctagcaacaggcctcagaaactccccacaaggagaacgccgccgccgcaaacgcggcctattcggcgccatcgccggcttcatagaaggaggatggcaaggcatggtcgacggctggtacgggtaccatcacagcaacgaacaaggctccggctacgccgctgacaaagaaagcacacaaaaggccattgacggcgtaaccaacaaagtaaacagcataatcaacaaaatgaacacgcaattcgaggccgtaggccgagagttcaacaacctagaacgccgaatagaaaacctcaacaagaaaatggaagacggattcctcgacgtctggacatacaacgccgaactactcgtcctcatggaaaacgaacgcaccctcgacttccacgactcaaacgtgaaaaacctatatgacaaagtccgcctccaactccgcgacaacgcaaaagaactcggtaacggctgcttcgagttctaccacagatgcgacaacgaatgcatggagtccgtaagaaacggcacctacgactacccacaatactcagaggaagcacgcctaaaacgcgaggaaatatcaggcgtgaaactcgaaagcatgggcatctaccagatcctatccatctactcgaccgtcgcttcctccctcgccctagcaatcatggtggccggactattcctctggatgtgcagcaacggcagcctacaatgccgcatatgcatc

SEQ ID NO: 58956 - RNA, 1704 nt, synthetic construct
  misc_feature 1..1704: note = derived and/or modified sequence opt11 from anti-influenza_Chain
  source 1..1704: mol_type = other RNA
atggagaaaatcgtactgctccttgcaatcgtaagcctcgtcaaatccgatcaaatatgcataggctaccacgccaacaactccaccgaacaagtcgacaccatcatggagaaaaacgtcaccgtcacccacgcccaagacatcctcgagaaaacccacaacggcaaactatgcgatctagacggcgtcaaaccactcatactgcgcgactgctccgtcgccggatggctcctcggcaaccccatgtgcgatgaatttatcaacgtccccgaatggtcctatatcgtggaaaaggcaaaccccacgaacgatctctgctaccccgggtccttcaacgactacgaggaactcaaacacctactatcgagaatcaaccacttcgagaaaattcaaatcatccccaaaagctcctggagtgaccacgaagcctccagcggagtcagcagcgcatgcccctacctcggatccccctccttcttccgcaacgtcgtctggttaataaagaagaactccacctacccaaccatcaaaaagagctacaacaacaccaaccaagaagacctgctagtactctggggcatacaccaccccaacgacgcagccgaacaaacccgcctataccaaaatccaacaacctacataagcataggaacgagcaccctcaaccaacgactggtccccaaaatagccacaagaagcaaggtcaacggacagtcaggcagaatggagttcttctggaccatactaaagcccaacgacgccatcaatttcgaaagcaacggaaacttcatcgcaccagaatacgcatacaaaatcgtcaagaaaggcgactccgccattatgaaaagcgaactagaatacggaaactgcaacaccaagtgccaaacccccatgggcgccatcaactcctcaatgcccttccacaacatacaccccctaacgatcggcgaatgccccaaatacgtaaaatccaaccgcctagtactcgccaccggactccgaaattcgccccaacgcgagtcacgccgcaagaaaagaggcctcttcggagccatcgctggtttcatcgaaggcggctggcaaggcatggtggacgggtggtacggctaccatcacagcaatgaacaaggctcaggatacgcagccgacaaagaatccactcaaaaggcaatagacggcgtcaccaacaaagttaactcaataatcgacaaaatgaacacccaattcgaagcagtcggccgcgagttcaataacctcgaacgcagaatcgaaaacctaaacaaaaagatggaagacggcttcctcgacgtctggacctacaacgcagaactcctcgtcctcatggaaaacgaacgaacgctcgacttccacgactcgaacgtcaaaaacctctacgacaaagtacgcctccaactgagagacaacgccaaagaactcggtaacggctgcttcgagttctaccataaatgcgacaacgaatgcatggaaagcatccgcaacggcacatacaactacccgcaatactccgaagaagcccgcttaaaacgcgaagaaatctccggcgtaaaactcgaatcaataggaacataccagatactcagcatctactcgaccgtagcctcctccctcgccctcgcaataatgatggcgggcctctccctctggatgtgctccaacggatcacttcaatgccgcatatgcatc

SEQ ID NO: 58957 - RNA, 1704 nt, synthetic construct
  misc_feature 1..1704: note = derived and/or modified sequence opt11 from anti-influenza_Chain
  source 1..1704: mol_type = other RNA
atggaaaagatcgtcctactcttcgccatcgtgtcactcgtcaaatcagaccaaatatgcatcgggtaccacgccaacaactccaccgaacaagtcgacacaataatggaaaagaacgtcacagtaacccacgcccaagacatactggaaaagacccacaatggcaaactctgtgacctcgacggagtaaaaccgctcatactacgcgactgcagcgtcgccggatggctactcggaaacccgatgtgcgacgagttcataaacgtccccgaatggtcatacatcgtggaaaaagccaacccagtcaacgacctctgctacccgggcgacttcaatgactacgaagaactcaagcacctcctctcccgcatcaaccacttcgaaaagatccaaatcatccccaaatccagctggagcagccacgaagcaagcctaggcgtcagtagcgcatgcccctaccaagggaaatccagcttcttccgcaacgtagtctggctcatcaagaaaaactcaacctaccccacaatcaaaagaagctacaataacacaaaccaagaagacctcctagtcctatggggcatccaccatccaaacgacgcagccgaacaaacgaaactctaccagaaccccacaacctacatctcagtagggacctcaaccctcaaccagcgactcgtaccccgaatagcgacaagaagcaaagtcaacggacaaagcggccgcatggagttcttctggactatcctcaaaccaaacgacgccatcaacttcgaatcaaacggcaacttcatcgccccagaatacgcctacaaaatcgtcaagaaaggcgattccaccataatgaaatcagaactcgaatacggaaactgcaacacgaaatgccaaacaccaatgggcgcaatcaacagctccatgccattccacaacatacacccgctcaccatcggcgaatgtcccaaatacgtaaaaagcaaccgcctagtattagccacaggactcagaaactccccacaaagagaaagaagacgaaagaaaaggggactgttcggcgcgatcgccgggtttatagaaggcggctggcaaggaatggtcgacggctggtacggatatcaccattcaaacgaacaaggatccggatacgcggccgacaaagaatccacccaaaaagccatagatggcgtcaccaacaaagtcaacagcataatcgacaaaatgaacacccaatttgaagccgtaggccgagaatttaacaacctagaaagaagaatagaaaacctcaacaagaagatggaagacggcttcctagacgtctggacctacaacgccgaactcctcgtgctcatggaaaacgaacgaacactagacttccacgacagcaacgtgaaaaacctctacgacaaagtgcggctccaactaagagacaacgccaaagaactcggcaacggatgcttcgagttctaccacaaatgcgacaacgaatgcatggaaagcgtccgaaacggcacctacgactacccccaatacagcgaagaagcccgactcaagcgcgaagaaatctccggcgtaaaacttgaatcaatcggaatataccaaatcctctccatatactccaccgtcgccagcagccttgccctcgccattatggtcgccggcctatcactctggatgtgctcaaacggatccctccaatgccgcatatgcatc

SEQ ID NO: 58958 - RNA, 1707 nt, synthetic construct
  misc_feature 1..1707: note = derived and/or modified sequence opt11 from anti-influenza_Chain
  source 1..1707: mol_type = other RNA
tcgaaaagccgaggatacaaaatgaacacccaaatactcgtattcgcacttgtagcatcaatcccaacaaacgctgacaaaatctgcctcggacaccacgcagtaagcaacggcaccaaagtcaacaccctcaccgaacgcggcgtagaagtggtcaacgccaccgaaaccgtagagcgcacaaacgtaccccgaatctgctccaaaggcaaacgcaccgtagacctaggccagtgcggcctcctcggcaccatcaccggcccaccccaatgcgaccaatttctagagttctccgccgacctcataatcgaacgccgagaaggcagcgacgtgtgctaccccggaaaattcgttaacgaagaagcactacgccaaatactacgagaatccggcggaatcgacaaagaaaccatgggattcacctacagtggcatccgcactaacggcacaacaagcgcatgccgacgatccggatcatccttctacgcagaaatgaaatggctcctgagcaacacagacaacgccgctttcccccaaatgacaaagtcatacaaaaacacccgcaaagaccctgccctaataatatggggcatccaccacagcggaagcacaacagaacaaaccaaactctacggctccggtaacaaactaataacggtagggagctcaaactatcaacagagcttcgtacccagccccggcgcccgcccccaagtcaacggacaatccggacgcatagacttccactggctaatcctgaaccccaacgacacagtaaccttcagcttcaacggagccttcatagcacccgaccgagcctccttccttcgcggtaaaagcatgggaatacaatcagaagtgcaagtcgacgcaaactgcgaaggagattgctaccacagcggcggcacaatcataagcaacctcccattccaaaacatcaactcaagagccgtcggaaaatgcccaagatacgtcaagcaagaatccctacttctagccacaggcatgaaaaacgtcccagaaatacccaaaagacgccgacgtggcctctttggcgccatcgctgggttcatcgagaacggctgggaaggcctaatagacggatggtacggattccgacaccagaacgcccaaggcgagggcaccgctgcagactacaaaagcacgcaatccgcaatcgaccaaatcaccggcaaactcaatcgcctaatcgagaaaacgaaccagcaattcgaactaatcgacaacgagttcacagaagtggagcgccaaatcggaaacgtaatcaattggacacgcgactccatgaccgaagtatggtcatacaacgccgagctcctagttgcaatggaaaaccaacacaccatagacctcgcagactccgaaatgaacaaactatacgaacgagtaaaacgacaactccgagaaaacgcagaagaagacggcaccggatgtttcgaaatcttccacaaatgcgacgacgactgcatggcatcaatacgcaacaacacatacgaccacagcaaataccgagaagaggccatacaaaaccgcatccaaatagaccccgtgaagctctccagcggatacaaagacgtaattctctggttctccttcggtgcctcctgcttcatcctgctcgcaatagccatgggcctcgtcttcatctgcgtcaaaaacggcaacatgcgctgcaccatatgcata

SEQ ID NO: 58959 - RNA, 1707 nt, synthetic construct
  misc_feature 1..1707: note = derived and/or modified sequence opt11 from anti-influenza_Chain
  source 1..1707: mol_type = other RNA
agtaaatcccgcggctacaagatgaacacccaaatcctagtcttcgccctcgtggcgagtatacccaccaacgctgacaaaatctgcctaggccaccacgccgtatcaaatggaaccaaagtaaacacactcacggagcgcggcgtcgaagtcgtcaacgccaccgaaaccgtagaacgaacgaacgttccccgcatttgcagcaaaggcaaacgcaccgtggacctcggacaatgcggcctactagggaccatcacaggcccaccccaatgcgaccaattcctagagttctcagcagacctaatcatcgaaaggcgggaaggcagcgacgtctgctaccccggtaaattcgtcaacgaagaagcactacgccaaatcctgcgagagtccggagggatcgacaaagaaaccatggggttcacctactcgggaatccgcacaaacggtaccacaagcgcctgccgccgctccggctccagcttctacgccgaaatgaaatggctactcagcaacacagacaacgccgcattcccccagatgacaaaatcgtacaaaaacacccgcaaagaccccgccctcattatctggggaatacaccactccggctcgaccacagaacaaactaaactctacggcagcggcaacaagctcatcaccgtcggatccagcaactaccagcaatccttcgtaccatcccccggcgcacgtccgcaagtcaacggccaatccggccgcatcgatttccactggctgatcctcaacccaaacgacaccgtaactttcagcttcaacggcgcattcatagcacccgacagggccagcttcctccgaggaaaaagcatgggaatacaatccgaagtacaagtcgacgcaaattgcgaaggagactgttaccactcagggggcaccataataagcaacctcccattccaaaacataaactcccgagcagtggggaaatgcccacgatacgtaaaacaagaatcactactactcgcaaccgggatgaaaaacgtcccggaaatccccaaacgccgccgacgaggcctcttcggcgcaatagccggcttcatagagaacggctgggaaggactcatcgacggatggtacggcttccgccaccaaaacgcccaaggcgaaggaacggccgcagactacaaatcaacgcaatcagccatcgaccagatcacaggcaaactcaaccgactcatagaaaagaccaaccagcaattcgaactaatcgacaacgagttcacggaagtcgagcgccaaataggcaacgtcataaactggacccgcgactcaatgaccgaagtatggagctacaacgccgaactactcgtagcgatggagaaccaacacacaatcgacctcgcagactcagaaatgaacaaactgtacgaaagagtcaaacggcaactacgcgaaaacgccgaagaagacggaaccggctgcttcgaaatattccacaaatgtgacgacgactgcatggcctccatacggaacaacacctacgaccactccaaataccgagaagaagccatccaaaaccgaatccaaatcgaccccgtcaaacttagctccggctacaaagacgtcatactatggttctcctttggagcctcctgcttcatactactagcaatagcaatgggtctcgtcttcatctgcgtcaaaaacggcaacatgcggtgcacaatctgcata

SEQ ID NO: 58960 - RNA, 1692 nt, synthetic construct
  misc_feature 1..1692: note = derived and/or modified sequence opt11 from anti-influenza_Chain
  source 1..1692: mol_type = other RNA
gaccaaatatgcatcggctaccacgccaacaactccaccgaaaaagtggacaccaacctagaaagaaacgtaacagtgacacacgccaaagacatactcgagaagacccacaacggcaaactatgcaaactaaacggcatcccacccctagaactgggagactgctcaatcgccggatggctactaggaaacccagaatgtgaccgactactgtcagtacccgaatggtcgtacatcatggaaaaagaaaacccccgagacggcctctgctaccccggctccttcaacgactacgaggagctaaaacacctactctcctccgtaaaacacttcgaaaaagtcaagatcctcccaaaagatcgctggacacaacacaccaccacaggaggctcccgtgcatgcgccgtcagcggaaaccccagcttcttccgcaatatggtatggctaaccaaagaaggctcagactacccagtagccaaaggaagctacaacaacacctcaggtgaacaaatgctcatcatctggggcgttcatcacccaatcgacgaaacagaacaacgtaccctctaccaaaacgtcggcacatacgtctcagtagggactagcaccctaaacaaaagaagcacccccgaaatcgccacacgaccaaaagtcaacgggcaaggaggcagaatggaattttcctggaccctcctcgacatgtgggacacaatcaacttcgaatccaccggcaacctgatagccccggaatacggcttcaaaatctccaaacgaggcagcagcggaataatgaaaacagagggcacactggaaaactgcgagaccaaatgccaaaccccactcggggccataaacaccaccttgcccttccacaacgtacacccattgaccataggcgaatgcccaaaatacgtcaaatctgagaagctagtcctagccaccggcctccgaaacgtcccccaaatagaatcccgtggactcttcggcgccatagccggcttcatagagggcgggtggcaggggatggtcgacggctggtacggctatcaccactcaaacgaccaaggctcaggatacgcggccgacaaagaaagcacccaaaaggccttcgacggaataaccaacaaagtgaacagcgtcatcgagaaaatgaacactcaattcgaagcagtaggaaaggagttcggaaacctcgaaagacgcctagaaaacttaaataagcgaatggaagacggcttcctagacgtttggacctacaacgcagaactactcgtactaatggaaaacgagcgaacgctcgatttccacgactcaaacgtcaaaaacctatacgacaaggtacgaatgcagctccgagacaacgtcaaagaactaggaaacggctgcttcgagttctaccacaaatgcgacgacgaatgcatgaactccgtcaaaaacgggacctacgactaccccaaatacgaagaagaaagtaaactcaaccgaaacgaaatcaaaggcgtcaaactctcctccatgggagtataccagtcgggccgcctggtcccacgtggcagcccaggctccggatacatccccgaagcccccagagacggacaagcgtacgtcagaaaagacggcgaatgggtcctgctctccaccttcctgggcaaaccaatccctaaccccctactgggcctggactctaccggg

SEQ ID NO: 58961 - RNA, 1692 nt, synthetic construct
  misc_feature 1..1692: note = derived and/or modified sequence opt11 from anti-influenza_Chain
  source 1..1692: mol_type = other RNA
caaaaactcccgggcaatgacaacagcaccgccacactctgcctaggccaccacgccgtgcccaacggtacaatcgtaaaaacaatcaccaacgaccaaatcgaagtgaccaacgccacagagctagtccaaagttccagcacaggaggcatatgcgactcaccacaccagatactcgacggcgaaaactgcaccctaatcgacgccctcctaggcgacccacaatgcgacggcttccagaacaagaaatgggacctattcgtcgaacgcagcaaagcctactccaactgctacccatacgacgtaccagactatgcgagcctacgctcgctcgtcgcaagctcaggcacactagagttcaacgacgagagcttcaactggaccggcgtcacccaaaacgggacctcttcatcctgcaaacgacgcagcaacaactcattcttcagcaggctcaactggctgacccaactaaaattcaagtaccccgccctaaacgtaacaatgcctaacaacgaaaaattcgacaaactatacatctggggagtacaccacccagtcacagacaacgaccaaatcttcctatacgcccaagcaagcggccgcataaccgtgagcacaaaacgatctcagcaaaccgtcatccccaacataggtagtcgacctcgaatccgaaacataccctcaagaatctcaatctactggacaatcgtaaagcccggcgacatcctcctcatcaactccaccggaaacctcatagcaccccgcggctacttcaaaatccgaagcggaaagtcctccatcatgcgatcggacgcaccaattggcaagtgcaacagcgaatgcataaccccaaacgggtcaatccccaacgacaagcctttccaaaacgtcaacagaatcacctatggcgcctgcccacgctacgtcaaacaaaacacactaaaactcgccacaggaatgcgcaacgttcccgaaaaacaaacgagaggtatcttcggcgccatagcaggtttcatcgaaaacgggtgggaaggcatggtcgacggttggtacggcttcagacaccaaaactccgaaggaataggacaggcagccgacctaaaatcaacacaagccgccataaaccaaatcaacggaaaactaaaccgattgatcggcaaaaccaacgaaaaattccaccaaatagaaaaagagttcagcgaagtcgaaggacgtatccaagacctcgaaaaatacgtcgaagacacgaaaatcgacctatggtcatacaacgccgaactcctagtggcccttgaaaaccaacacacaatcgacctcacagactccgaaatgaacaaactattcgaacgcacaaagaaacaactccgcgaaaacgccgaagacatgggaaacggctgcttcaaaatctaccacaaatgcgacaacgcatgcatcggctcaatacgaaacggaacctacgaccacgacgtgtacagagacgaagcactcaacaaccgattccaaatcaagggcgtcgaactcaaatccggaagcgggcgcctcgtcccacgcggatcccccggctccggatacatcccagaagcgccccgagacgggcaagcctacgtccgaaaagacggggaatgggttctactctccaccttcctagggaaacccatacccaaccccctactcgggctagactcaaccggc

SEQ ID NO: 58962 - RNA, 1692 nt, synthetic construct
  misc_feature 1..1692: note = derived and/or modified sequence opt11 from anti-influenza_Chain
  source 1..1692: mol_type = other RNA
gaccagatctgcataggataccacgccaacaacagcaccgaaaaagtagacacaaacctagaaagaaacgtcacagttacccacgcaaaagacatcctcgagaaaacccacaacggaaaactatgcaaactaaacggcatcccacccctagaactcggagactgcagcatcgcaggctggctactcggaaaccccgaatgcgacagactactatcagtccccgaatggtcatacattatggaaaaagaaaacccccgagacggactatgctaccccgggagctttaacgactacgaagaactcaaacacctactctccagcgtcaaacacttcgaaaaagtcaaaatccttccaaaagatcgctggacacagcacacaaccacaggaggaagcagagcatgcgccgtatccggcaaccccagcttcttccgcaacatggtatggctaacgaaagaggggagcgactaccccgtcgccaaaggaagttacaacaacaccagcggggagcaaatgctgataatctggggcgtccaccacccaatcgacgaaaccgagcaacgcaccctctaccaaaacgtaggaacctacgtaagcgtcggaaccagtacactaaacaaaaggtccacacccgaaatcgcaacccggcccaaagtcaacggacagggcggacggatggagttctcctggaccttactagacatgtgggacacgataaacttcgaatctacaggcaacctaatagcacccgaatacggattcaaaatatccaaacggggctcctcaggcataatgaaaactgaaggaacactcgagaactgcgaaaccaaatgccaaacacccctaggcgccataaacacgaccctacccttccacaacgtacaccccctaaccataggagaatgccccaaatatgtaaaatccgagaagctagtgctcgccacaggactcagaaacgtaccacaaatagaatcacgaggcctcttcggcgccatcgccggctttatcgaaggcgggtggcaaggaatggtagacggatggtacggctaccaccactcaaacgaccaaggatcaggctacgccgcggacaaagaaagcactcaaaaagccttcgacggaatcacgaacaaagtcaacagcgtaatcgagaaaatgaacacccagttcgaagcggtaggcaaagaatttggaaacctcgaaagaagactagagaacctcaacaagcgcatggaagacggcttcctcgacgtatggacctacaacgcagaactcctcgtactaatggagaacgagagaacgctcgacttccacgactccaacgtcaaaaacctatacgacaaagtacgaatgcaactacgagacaacgtaaaagagctaggaaacggctgcttcgagttctaccacaaatgcgacgacgaatgcatgaactcagtcaaaaacggaacgtacgactacccaaagtacgaagaagaaagcaaactcaacaggaatgaaatcaaaggagtaaaactcagctccatgggggtataccaaagcggccgcctagtccccagaggctcccccggaagcggctacatcccggaagccccgagagacggccaagcctacgtaagaaaggacggcgaatgggtactcctaagcaccttcctaggaaaacccatcccgaaccccctcctaggcctcgacagcacgggc

SEQ ID NO: 58963 - RNA, 1692 nt, synthetic construct
  misc_feature 1..1692: note = derived and/or modified sequence opt11 from anti-influenza_Chain
  source 1..1692: mol_type = other RNA
caaaaactgccaggaaacgacaactccaccgccaccctctgcctaggccaccacgccgtgcccaacggtacaatcgtaaaaaccatcaccaacgaccaaatcgaggtcaccaacgccactgaactcgtccaaagctcaagcaccggcggcatctgcgactcaccccaccaaatcctggacggcgaaaactgcacactcatcgacgccctccttggcgacccccaatgcgacggattccaaaacaagaaatgggacctatttgtcgaaagatccaaagcctactccaactgctacccatacgacgtcccagactacgcctccctccgcagcctagtagcatcaagcggaaccctagagttcaacgacgaatcattcaactggaccggagtcacccaaaacggcacaagcagctcctgcaaacgacgctccaataacagcttcttcagccgactcaactggctcacacaactcaaattcaaatacccggcactaaacgtaaccatgcccaataacgaaaaattcgacaaactctacatctggggcgttcaccaccccgtcacagacaacgaccaaatcttcctctacgcccaagcgtcaggccgcataaccgtcagcacaaaacgaagccaacaaacagtcatccccaacataggctcccgaccccgcattcgaaacatcccctcccgtatcagcatctactggacaatagtcaaaccaggcgacatactcctcatcaacagcaccggcaacctcatagccccacgtggatatttcaaaatccgatcaggcaaatcctccatcatgcgctcagacgcccccataggcaaatgtaacagcgaatgcatcacccccaacggcagcatccccaacgacaaacccttccaaaacgtaaaccgaatcacctacggcgcatgccctcgatacgtaaaacaaaacacactaaaactagccaccggcatgcgcaacgtacccgaaaagcagacccgaggcatattcggcgcaatcgcaggcttcatcgaaaacggctgggaaggcatggtcgacggctggtacggattcagacaccagaacagcgaaggcataggacaagcggcagacctcaagagcacccaagccgccatcaaccaaataaacggaaagctcaacagactgatcggcaaaacaaacgaaaagttccaccaaatcgaaaaagagttctccgaagtcgaaggccggatacaagacctagagaaatatgtggaagacaccaaaatcgacctctggagctacaacgccgaactgctcgtagccctagaaaaccaacacaccatcgacctaaccgactccgaaatgaacaaactattcgaaaggacaaagaagcaactacgcgaaaacgcagaagacatgggaaacggctgcttcaaaatctaccacaaatgcgacaacgcatgcatcgggtcaatccgcaacggaacatacgaccacgacgtctaccgagacgaggctctcaataaccgcttccaaatcaaaggcgtagaactaaaatcaggctccggccgtctagtcccacgaggttcacccggatcaggatacatacccgaagcaccccgcgacggccaggcctacgtccgcaaagacggcgaatgggtgctactctcaaccttcttaggtaaaccaatcccaaaccccctactcggcctcgacagcaccggc

SEQ ID NO: 58964 - RNA, 1695 nt, synthetic construct
  misc_feature 1..1695: note = derived and/or modified sequence opt11 from anti-influenza_Chain
  source 1..1695: mol_type = other RNA
gatacaatatgtatcggataccacgccaacaactccacggacaccgtcgacaccgtgctagagaaaaacgtcactgtcacgcactcagtcaacctcctagaagacagccacaacggaaaactctgcctactaaaaggcatagccccgctgcaacttggaaactgcagcgtagctgggtggatactcgggaaccccgaatgcgaattactcataagcagagaatcctggtcgtacattgttgaaaaaccaaaccccgaaaacgggacctgctacccaggacacttcgcagactacgaagaactacgcgaacaattgagctccgtctcatcattcgaacgcttcgaaatcttccccaaagaatcgagctggcccaaccacaccacaacaggagtcagcgcaagctgcagccacaacggcgaaagcagcttctacaaaaacctgctatggctcacgggaaagaacgggctctaccccaacctctccaaatcctacgcaaacaacaaggaaaaagaagtcctagtcctgtggggcgtccaccacccgcccaacatcggcgaccagcgcgcactataccacaaggaaaacgcctacgtctcagttgtaagctcccactacagccgaaaattcacccccgaaatagcaaaacgcccaaaagtaagagaccaagaaggcagaatcaactactactggacgctattagaaccaggcgacaccatcatcttcgaagcaaacggcaacctcatagcaccccgatacgcgttcgcgctctcgcgaggattcggaagcggaataataaatagcaacgcacccatggacgaatgcgacgccaaatgccagacaccgcaaggggcaataaactccagcctccccttccaaaacgtccacccagtaaccataggcgaatgccccaaatacgtccggagcgcgaaactacgcatggtcacgggcctccgaaacatccccagcatccaatcacgcgggctattcggggcaatcgcaggattcatagagggcgggtggacaggcatggtcgacggctggtacggctaccaccaccaaaacgaacaagggtccgggtacgcagccgaccaaaaatccacacaaaacgcaatcaacggaatcaccaacaaggttaatagcgtaatcgagaaaatgaacacccaattcaccgcagtcggcaaagaatttaacaaactagaacgcagaatggaaaacctcaacaaaaaggtcgacgacggattcatcgatatctggacatacaacgccgaactcctcgtcctgctcgaaaacgaacgcacactcgacttccacgacagcaacgtcaaaaacctctacgaaaaagtaaaaagccaactcaaaaacaacgccaaagaaatcggcaacggctgtttcgagttctaccacaagtgtaacgacgaatgcatggaatccgtcaaaaacggcacctacgactacccaaaatactcagaagaaagcaaactcaaccgagagaaaatagacggagtaaaactagagtcaatgggcgtataccagagcggacgcctagtaccacgcggaagccccggctccggatacatcccggaagcgcccagagacgggcaagcgtacgtaagaaaagacggagagtgggtcctgctatccaccttcctaggaaaaccgataccaaaccccctccttggactggactcaacgggc

SEQ ID NO: 58965 - RNA, 1695 nt, synthetic construct
  misc_feature 1..1695: note = derived and/or modified sequence opt11 from anti-influenza_Chain
  source 1..1695: mol_type = other RNA
caaaactacacgggcaaccccgtaatatgcctaggacatcatgccgtctcaaacggcaccatggtcaaaaccctaaccgacgaccaaatcgaagtcgtcaccgcccaagaactcgtcgaaagccagcacctaccagaactctgccccagtccactccgcctcgtcgacggccaaacctgcgacatcgtcaacggcgccttaggaagtcccggctgcgaccacctaaacggagcggaatgggacgtcttcatagaacgaccaacggcagtcgatacctgctaccccttcgacgtgcccgactaccaaagcctccgatccatacttgccaacaacggcaaattcgaatttatagcagaagagttccaatggaacaccgtaaaacagaacggaaaatcaggcgcatgcaaacgcgcaaacgtcaacgacttcttcaaccggctcaactggctcaccaagagcgacggtaacgcctaccccctccagaacctcacaaaagtcaacaatggcgactacgcccgcctctatatctggggcgtacaccacccaagcacagacacagaacaaaccaacctctataaaaacaaccccggccgcgtcacagtatcaacccaaacctcccagacctccgtcgtcccaaacatcggatcgcgcccctgggtccgcggccttagctcccggatatccttctactggacaatcgtcgaacccggcgaccttatagtcttcaacaccataggaaacctaattgcaccacggggccactacaaacttaacagccaaaagaaatccaccatcctcaacaccgccgtccccataggctcatgcgtttcaaaatgccacacggacaaggggtcaatctcaactaccaaacccttccaaaacatctcccgcatatccatcggagactgtcccaagtacgtaaaacaaggaagcctgaaactagcaaccggcatgcgatccatcctcgaaaaagccacacgcgggctgttcggcgccatcgcgggcttcatcgaaaatggctggcaaggcctcatcgacggttggtacggcttccgacaccaaaacgccgaaggaaccggaaccgccgctgacctcaaaagcacgcaagccgcaatcgaccaaataaacggcaagctaaaccgcctcatcggcaaaccaaacgaaaaataccaccaaatcgaaaaagaatttgaacaagtcgaaggccgcatacaagacctagaaaaatacgtcgaagacacaaaaatagacctctggagctacaacgccgaactactcgtcgccctagaaaaccaacacaccatagacgtaaccgactcggaaatgaacaaactcttcgaacgagtacgacaccaactccgtgaaaacgccgaagacaaaggcaatggctgcttcgaaatcttccaccaatgcgacaactcctgcattgaaagcatacgcaacggcacatacgaccacgatatatacagagacgaagcaataaacaaccgctttcaaatacaaggggtaaaactaatccagggttacaaagactcaggccgcctcgtaccccgaggcagccccggcagcggctacatccccgaagcaccccgagacggccaggcttacgtccgaaaagacggcgaatgggtcctcctaagcacctttctgggcaaaccaatacccaaccccctcctgggactcgactcaaccgga

SEQ ID NO: 58966 - RNA, 1695 nt, synthetic construct
  misc_feature 1..1695: note = derived and/or modified sequence opt11 from anti-influenza_Chain
  source 1..1695: mol_type = other RNA
gaccaaatctgcatcggttaccacgctaacaacagcaccgaacaagtcgacaccatcatggaaaaaaacgtcaccgtcacccacgcccaagacatcctagagaaaacccacaacggcaaactctgtaacctcgacggagtcaaacccctcatcctcaaagactgctccgtagccggctggcttctcggaaacccaatgtgcgacgaatttctaaacgtatccgaatggtcctacatagtcgaaaaagcctcccctgccaacggcctctgctaccccggcgacttcaacgactacgaagagctaaaacacctcctatccagaatcaaccacctcaaaaaaataaaaatcatccccaaaagctactggtcaaaccatgaagccagctcgggagtcagcgcagcctgctcctatctcggcgaaccatccttcttcagaaacgtagtatggcttatcaaaaagaacaacacctacccccccatcaaagtaaactatacgaacaccaatcaagaagacctcctcgttctctggggaatacaccaccccaacgacgaaaaagaacagatccgcatataccaaaaccccaacacgtccataagcgtgggaaccagcactctgaaccaacgacttgtcccgaaaatcgccaccagacctaaagtaaacggacagagcggcagaatggaattcttctggacaatcctgaaaccaaacgacagcattaacttcgactccaacggcaacttcatcgcccccgagtacgcctacaaaatcgccaaaaagggggacagcgtaataatgaaatcagaactcgaatacggcaactgcaacacaaaatgccaaacacccatgggcgcaatcaactcaagcatgcccttccacaacatccacccactcaccataggcgagtgccccaaatacgtcaaatcgaaccgattagtcctagccaccggcctgcgaaacgccccccaaacggaaacccgaggcctcttcggagccatcgcaggcttcatcgaagggggatggcaaggaatggtcgacggttggtacggataccaccactcaaacgaacaaggatccggctacgcagcggacaaagagtccacccaaaaagccatagacggcatcaccaacaaagtaaacagcatcatagacaaaatgaatacccaattcgaaatcgtcggacgcgaattcaacaacctcgaacgccgcatcgaaaacctcaacaaaaaaatggaagacggattcctggacgtatggacatacaacgccgaactcctcgtactgatggaaaacgaacgaacactcgacttccacgactccaacgtcaaaaacctgtacgaaaaagtaagactacaactccgcgacaacgccaaagaactcggcaacggctgctttgaattctaccacaaatgcgacaacgaatgcatggaatccgtccgcaacggaacctacgactacccccaatacagcgaagaagcccgactatcccgcgaagaaatcagcggagtaaaaatggagtccatggtaacctaccaaagcggccgcctcgtcccccgcggcagccccggaagcggatacatacccgaggcaccccgagacggacaagcctacgttcgaaaagatggggaatgggtactactgtccaccttcctcggcaaacctatacccaacccactactgggcctcgactcaacaggc

SEQ ID NO: 58967 - RNA, 1695 nt, synthetic construct
  misc_feature 1..1695: note = derived and/or modified sequence opt11 from anti-influenza_Chain
  source 1..1695: mol_type = other RNA
gacaccatctgtatcggataccacgccaacaattcaacagacacagtcgacaccgtgctcgagaaaaacgtcacagtcacccactcagtaaacctactagaagacagccacaacggaaagctctgcctcctaaaagggatagcccctctacaactaggcaactgcagcgtagcaggatggatactcggaaacccggaatgcgaacttctaatatcccgcgaatcatggtcctacatcgtagagaaacccaacccagaaaacggaacgtgctaccccggacacttcgctgactacgaggaactacgagaacaactctcatcggtatccagcttcgaacgattcgaaatattccccaaagaatccagctggcccaaccacaccaccacaggcgtatccgcgagctgctcacacaacggggaatccagcttctacaaaaacctgctgtggctcaccgggaagaacggactatacccaaacttgagcaaatcatacgccaacaataaggaaaaagaagtactcgtcttatggggagtacaccacccacccaacataggcgaccaaagagcactctaccacaaagaaaacgcatacgtctccgtagtctcctcccactacagccgaaaattcacaccggaaatcgcaaaacggccgaaagttcgcgaccaagaaggccgaatcaattactactggacactactggaacccggcgacacaataatctttgaagcaaacggaaacctcattgcaccccgctacgcgttcgcactctccagaggcttcgggtccgggataataaactcaaacgcaccaatggacgaatgcgacgccaagtgccaaacgccccaaggcgccataaactctagcctccccttccaaaacgtccaccccgtcaccatcggcgaatgcccgaaatacgtacggagcgcaaaactacgaatggtcaccggcctacgcaacatcccaagtatacaatctcgcggcctcttcggggcaatagccggctttatcgagggcggctggacaggcatggtagacggctggtacggataccaccaccaaaacgaacaaggctccggatacgccgccgaccaaaagagcacccaaaacgccataaacggaatcacaaacaaagtaaacagcgtcatagagaaaatgaacacgcaattcaccgccgtcgggaaagaatttaacaaactagaacgcagaatggaaaacctcaataaaaaggtcgacgacggcttcatcgacatctggacgtacaacgccgaactactggtacttctcgaaaacgaacgcacactcgacttccacgactcaaacgtcaaaaacctctacgaaaaagtaaaaagtcaactgaaaaacaacgccaaagaaataggcaacggctgcttcgagttctaccacaaatgcaacgacgaatgcatggaatccgtaaagaacggcacttacgactacccaaagtactcggaagagtccaaactcaaccgcgagaaaatcgacggagtaaaactagaaagcatgggcgtgtaccaaagtggacgcctcgtcccacgcggaagtccaggatcgggctacatcccagaagcaccccgcgacgggcaagcctacgtacgcaaagacggggaatgggtcctgctgtcaaccttcctcggcaaacccatcccgaacccactcctaggactagacagcaccggc

SEQ ID NO: 58968 - RNA, 1695 nt, synthetic construct
  misc_feature 1..1695: note = derived and/or modified sequence opt11 from anti-influenza_Chain
  source 1..1695: mol_type = other RNA
caaaactacaccggcaaccccgtaatatgcctcggccaccacgccgtaagcaacggcaccatggtcaaaaccctcaccgacgatcaaatagaagtcgtcacagcccaggagctagtcgaatcccaacacctaccagaactctgcccctcacccctacgactggtagacggccaaacctgcgacatcgtcaacggagcactcgggagccccggctgcgaccatctcaatggagcagaatgggacgtattcatcgaaagacccaccgcagtcgatacctgctacccattcgacgtcccagactaccaaagcctacgatccatactcgccaacaacggcaaatttgagttcatcgcagaagagttccagtggaacaccgtcaaacaaaacggcaagtcgggagcatgcaagcgcgcaaacgtaaacgacttcttcaaccgcttaaactggcttaccaagagtgacggcaacgcataccccctccaaaatctaacaaaagtcaacaacggagactacgcgcgcctatacatatggggcgtccaccaccctagcacagacacagaacaaaccaatctatacaaaaacaacccaggcagagtcaccgtcagcacccaaacctcacaaacgagcgtcgtccccaacatcggctcacgcccatgggtccgaggcctctccagcaggatcagtttctactggaccatcgtagaaccaggggacctaatcgtcttcaacaccatcggcaacctaatcgcaccccgcggccactacaaactcaactcccagaagaaatcaacaatcctcaacacggccgtccccataggctcctgcgtctcaaaatgtcacacagacaaaggctccatcagcacgaccaaacccttccaaaatatttcgcgaattagcatcggcgactgcccgaaatacgtaaaacaaggcagtctaaaactagccaccggtatgcgatccatcctcgaaaaagcaacccgcggactcttcggcgccatcgccggcttcatcgaaaacgggtggcaaggtctcatcgacggctggtacggattccggcaccaaaacgccgaaggaaccgggaccgccgccgacctcaaaagcacacaagccgccatcgaccaaataaacggcaaactaaaccgcctaatcggcaagccaaacgaaaaataccaccagatcgaaaaggagttcgaacaagtcgaaggtcgaatccaagacctcgaaaaatacgtcgaagacaccaaaatcgacctctggtcctacaacgccgaactcctagtcgcgctagaaaaccaacacaccatcgacgttaccgacagcgaaatgaacaaactcttcgaaagagtaagacaccaactaagagaaaatgccgaagacaaaggaaacggctgctttgagatattccaccaatgcgacaacagctgcatagaatcaatccggaacggaacctacgaccacgacatatacagagacgaagccatcaacaacagattccaaatccaaggggtcaaacttatccaaggatacaaagactcaggccgcctcgtaccacgaggatcaccaggaagcgggtacatccccgaagcaccccgcgacggacaggcctatgtacgcaaagacggcgagtgggtactcctcagcaccttcctaggcaagcccataccaaaccccctcctaggcctcgactccacaggt

SEQ ID NO: 58969 - RNA, 1695 nt, synthetic construct
  misc_feature 1..1695: note = derived and/or modified sequence opt11 from anti-influenza_Chain
  source 1..1695: mol_type = other RNA
gaccaaatctgcatcggataccacgccaacaactcaacagaacaggtagacaccataatggaaaaaaacgtgaccgtcacccacgcgcaagacatactagaaaaaacacacaacggcaaactatgcaacctcgacggggtcaaacccctcatcctaaaagactgctccgtcgccggctggctcctgggaaaccccatgtgcgacgaattccttaacgtaagcgaatggtcctacatagtcgaaaaagcctcgcccgcaaacggactttgctaccccggagacttcaatgactacgaagaactaaaacacctactaagccgaataaaccacctcaaaaaaatcaaaatcatcccaaaatcctactggtccaaccacgaagcatcctccggcgtcagcgccgcttgcagctacctaggagaaccatcattcttccggaatgtcgtctggctcataaaaaaaaacaacacctatccccccatcaaagtaaattacaccaacacgaaccaagaagacctcctcgttctatggggcatccaccaccccaacgacgaaaaagaacagatccgcatctaccagaaccccaacacctcaatctccgtgggaacctccaccctcaaccaacgactagtccccaaaatagcaacccgccccaaagtcaatggccaaagcggccgaatggaattcttctggaccatactaaaaccgaacgactcgattaacttcgacagcaacggcaacttcatagcaccagaatacgcctacaaaatcgccaaaaaaggcgattcagtcatcatgaaaagcgaactcgaatacggcaactgcaacaccaaatgccaaacacccatgggagcgatcaactcctcaatgccattccacaacatccaccccctcaccatcggggaatgcccaaaatacgtcaaaagcaaccgtctagtcctcgccaccggcctccgaaacgccccccaaacagaaacccgaggcctcttcggtgccatagccggattcatagaaggcggctggcaaggaatggtcgacggatggtacggctaccaccacagcaacgaacaaggctcaggctacgcagccgacaaagagagcacacaaaaggcaatagacggaataaccaacaaagtaaactcaattatagacaagatgaacacccagtttgaaatcgtcggaagagagttcaacaacctcgaacgccgaatcgagaacctaaacaaaaaaatggaagacggcttcctagacgtctggacctacaacgccgaacttctcgtactcatggaaaacgaacgcaccctcgacttccacgactccaacgtcaagaacctatacgaaaaagttcgcctccaactccgcgacaacgcaaaagaactcggcaacggctgcttcgagttctaccacaaatgcgacaacgagtgcatggaatcagtccgcaacggcacatacgactacccccaatactcagaagaagcccgactctcccgagaagaaataagcggagtgaaaatggaatccatggtcacataccagagcggacgcctcgtgccccgaggcagcccaggcagcggctacattccagaggcccctcgcgacggccaagcctacgtacgcaaagacggcgaatgggtactcctctccacctttttaggaaaacccatacccaacccactgctaggcctcgacagcaccggc

SEQ ID NO: 58970 - RNA, 1698 nt, synthetic construct
  misc_feature 1..1698: note = derived and/or modified sequence opt11 from anti-influenza_Chain
  source 1..1698: mol_type = other RNA
gacacactatgtataggctaccacgccaacaacagtacagacacagtagacaccgtcctcgagaaaaacgtcacagtaacacactccgtaaacctactcgaagacaaacacaacggcaaactctgcaaactccgcggagttgcacccctgcacctgggaaaatgtaacatcgccggctggatcctgggaaaccccgaatgcgaatccctatccacggcctcgagctggagctacatagtagaaacacccagctcagacaacggcacttgctaccccggcgacttcatagactacgaagaactccgcgaacaactctcaagcgtatcatcattcgaacgcttcgaaatattccccaaaacctcctcctggccgaaccacgactccaacaaaggggtcacagccgcctgcccccacgccggggcaaaatccttctacaaaaacctaatctggctagtaaagaaaggcaactcctaccctaaactcagcaaatcctacatcaacgacaaaggcaaagaagtcctcgtactgtggggaatacaccaccccagcaccagcgcagaccaacaatcactgtaccagaacgcggacacctacgtcttcgtcggcagctcgcgatatagtaaaaagttcaaaccagaaatcgccatacggcccaaagtccgagaccaagaaggacgcatgaactactactggaccctagtagaacccggcgacaaaatcaccttcgaagccacagggaacctcgtggtcccacgatacgccttcgccatggaacgcaacgcaggcagcggaatcatcatctcagacacacccgtgcacgactgcaacaccacatgccaaacccccaaaggcgccatcaacaccagccttcccttccaaaacatacaccccatcaccataggcaaatgccccaaatacgtcaaatcaaccaaactacgcctcgccacaggactacgcaacatccccagcatacaatcacgaggactcttcggagcaatcgccggtttcatcgaaggcggctggaccggcatggtcgacggctggtacggataccaccaccagaacgaacaaggcagcggctacgccgccgacctcaaaagcacccaaaacgccatagacgaaatcacaaacaaagtaaactccgtcatcgaaaagatgaatacccaatttaccgccgttgggaaagagttcaaccacctagaaaaacgcatagaaaacctcaacaagaaagtcgacgacggcttcctcgacatatggacatacaacgctgaattattagtactactcgaaaacgaaagaaccctcgactaccacgactccaacgtcaaaaacttatacgaaaaagtacgaagtcaactcaaaaacaacgccaaagagataggaaacggatgcttcgagttctaccacaaatgcgacaatacctgcatggaatcagtcaaaaacggcacctacgactacccaaaatactccgaagaagcaaaactaaaccgcgaagaaatagacggagttaaactcgaatccacacgaatctaccaatccggacgcctcgtaccacgcggctctcccggatccggctacatcccagaagcaccccgagatggccaggcctacgtccgaaaagacggcgaatgggtcctcctctccaccttcctcggcaaacccataccgaaccccctcctcggcctcgactcgacaggc

SEQ ID NO: 58971 - RNA, 1698 nt, synthetic construct
  misc_feature 1..1698: note = derived and/or modified sequence opt11 from anti-influenza_Chain
  source 1..1698: mol_type = other RNA
gaccgtatctgcatcggctaccaaagcaacaacagcaccgacacggtaaacacactcatcgaacaaaaagtccccgtcacacaaaccatggaattggttgaaacagaaaaacaccccgcatactgcaacaccgacctcggagcaccactcgaactcagagactgcaaaatcgaagcagtcatatacggaaaccccaagtgcgacatacacctaaaagaccaaggatggagctacatcgtcgagcgccccagcgcacccgaaggaatgtgctacccaggaagcgtcgaaaacctggaagaactccgattcgtattctcctcggccgcatcatacaaacgcatcagactattcgactacagccgatggaacgtaacctcaagcggcaccagcaaggcctgcaacgcatcgacaggcggccagagcttctaccgaagcataaactggctcaccaaaaagaaacccgacacatacgacttcaacgaagggacgtacgtcaacaacgaagacggcgacatcatattcctttggggaatccaccaccctcccgacaccaaagaacaaaccacactatacaaaaacgcaaacaccctcagcagcgtcacaaccaacaccataaaccgcagctttcaacccaacatcggcccccgccccctagtccgaggacaacaaggccgaatggactactactggggcatcctaaaacgcggcgaaacactcaaaataagaaccaatggcaacctcatcgctcccgagttcggctacctcctaaaaggcgaatcccacgggcgaaccatacaaaacgaagatatccccataggcaattgctacaccaaatgccaaacctacgccggagcaatcaactccagcaaacccttccaaaacgcctccagacactacatgggcgagtgcccaaaatacgtaaagaaagcatccttaagactcgccgtcggactacgcaacaccccctcagtcgaaccacgcggactcttcggcgccatcgcgggattcatagaaggcggctggtccggcatgatcgacggctggtacggcttccaccactcaaactccgaaggaacaggaatggcggccgatcaaaaatccacccaagaagcgatagacaaaataaccaacaaagtcaacaacatcgtagacaaaatgaaccgagagttcgaagtcgtaaaccacgagttctccgaagtcgaaaagagaataaacatgataaacgacaaaatcgacgaccaaatagaagacctctgggcctataacgccgaactactcgtactcctagaaaaccaaaagacactcgacgaacacgactcaaacgtcaaaaacctgttcgacgaagtgaaacgccgactctcagccaatgccatagacgccggcaacgggtgcttcgacatcctccacaagtgcgacaacgaatgcatggaaaccataaagaacggtacctacgaccacaaagaatatgaagaagaagcgaaactagagcgatccaaaataaacggcgtcaaactcgaagaaaacacaacgtacaaaagcggacggctagtaccacgcggctcccccggcagtggttacatccccgaagcccccagagacggacaagcgtacgtccgcaaagacggcgaatgggtcctcctctccacctttctgggaaaacccataccaaaccccctcctaggcctagactcaaccggc

SEQ ID NO: 58972 - RNA, 1698 nt, synthetic construct
  misc_feature 1..1698: note = derived and/or modified sequence opt11 from anti-influenza_Chain
  source 1..1698: mol_type = other RNA
gacaccttatgcatcggataccacgccaataacagcacagacaccgtcgacaccgtacttgaaaagaacgtcacagtcacccactccgtaaacctgctcgaagacaaacacaacggcaaactctgtaaactccgaggcgtcgcaccgctacacctgggcaagtgcaacatagcaggctggatcctaggaaaccccgaatgcgaaagcctatccacggcctcatcctggtcctacatcgtggaaacccccagcagcgacaacggtacctgctaccccggcgacttcatcgactacgaagaactacgagaacaactctcatccgtctcatccttcgaacgattcgaaatcttccccaaaacatcctcatggcccaaccatgactccaacaaaggcgtgaccgccgcctgcccccacgccggcgcaaaatccttctacaaaaacctaatatggctcgtcaagaaaggcaacagctaccccaaactctccaaatcctacattaacgacaaaggaaaagaagtcctcgtcctctggggaatccaccaccccagcaccagcgccgaccaacaatcgctctaccaaaacgcagacacctacgtcttcgtcggctccagccgatactccaagaaattcaaacccgaaatcgccatacgacccaaagtacgcgaccaagagggccgcatgaactactactggaccctcgtggagccgggcgacaaaatcaccttcgaagcaaccggaaacctggtcgttccccgctacgcctttgccatggaacgtaacgccgggagcgggataatcatctcagacacaccagtacacgactgcaacacaacctgccagaccccaaaaggcgcaataaataccagcctacccttccaaaacatccacccaatcaccataggcaaatgcccaaaatacgtaaaatccacaaaactccgcctagcaacaggcctgcgaaacatcccatccatccaatcccgaggcctattcggcgcaatcgccggcttcatcgaaggcggatggaccggcatggtagacggctggtacggctaccaccaccaaaacgaacagggcagcggatacgcagccgaccttaaaagcacccaaaacgcaatagacgaaatcacgaacaaagtcaacagtgtaatcgagaaaatgaacacacaattcacagcagttgggaaagagttcaatcacctcgaaaaacgaatagaaaacctaaacaaaaaggtagacgacgggttcctcgacatatggacctataacgccgaactcttagtcctattagaaaacgaaagaactctagactaccacgattcaaacgtcaaaaacctatacgaaaaagtccgaagccaactcaagaacaacgccaaagaaattggcaacggctgtttcgagttctaccacaaatgtgacaacacatgcatggaaagcgtcaagaacgggacatatgactacccaaagtactccgaagaagccaaacttaacagagaagaaatagacggagtcaaacttgaaagcaccagaatataccagtccggtcgtctagtcccacgcggaagcccgggctcaggctacatcccggaagctccccgggacggacaagcgtacgtccgaaaagacggagaatgggtcctcctctcaaccttcttaggaaaaccaataccaaaccccctcctaggcctagactccacaggg

SEQ ID NO: 58973 - RNA, 1698 nt, synthetic construct
  misc_feature 1..1698: note = derived and/or modified sequence opt11 from anti-influenza_Chain
  source 1..1698: mol_type = other RNA
gatcgaatatgcatcggataccaatccaacaattcaacagacaccgtaaacaccctcatcgaacaaaaggtaccagtcacccaaaccatggaactcgtagaaacagagaaacacccagcatactgcaacacagacctgggagccccactagaactgcgcgattgcaagatcgaggccgtcatatacggcaacccaaaatgcgacatccacctcaaagaccaaggctggagctacatcgtagaacgaccatcagctcccgaaggaatgtgttaccccggatcagtcgaaaaccttgaagaactccgcttcgtcttctcatccgccgcctcctacaaaagaatacgcctcttcgactactcccgctggaacgtaacctcctccggcacctcaaaagcctgcaacgctagcaccggaggacaatcattctaccgctccataaactggctcactaaaaagaaaccagacacatacgacttcaacgaaggtacatacgtcaacaatgaagacggagacatcatattcctctggggcatccaccacccaccggacaccaaagaacaaacaaccctatacaaaaacgccaacaccctctcctccgtgacaacaaacaccatcaaccgctcattccaacccaacataggcccccgccccctagtcagaggacaacaaggccgcatggactactactggggcatccttaaacggggtgaaaccctaaaaatccgaacaaacggcaacctaatcgcccccgagttcggctacctactaaaaggagaatcccacggacgcaccatccagaacgaagacatccccataggcaactgttacaccaaatgccaaacctacgccggcgcgataaattccagcaaacccttccaaaacgccagccgacactacatgggcgaatgccccaaatacgtcaagaaagcaagcctcagactcgccgtaggacttagaaacacccccagcgtagaaccccgcgggctattcggcgcaatcgccggcttcatcgaaggaggttggagcggcatgatcgacggatggtacgggtttcaccactccaactcagaagggaccggcatggctgcagaccaaaaatccacccaggaagcaatcgacaaaatcaccaacaaagtaaacaacatcgtagacaaaatgaaccgagagttcgaagtcgtcaaccacgagttctccgaagtcgaaaaacgcatcaacatgatcaacgacaagatcgacgaccagatcgaagacctctgggcatacaacgccgaactactcgtcctgctcgaaaaccagaaaaccctcgacgaacacgacagcaacgtcaaaaacctcttcgacgaagtaaaacgcagactctcggctaatgccatcgatgcgggcaacggatgctttgacatactccacaagtgcgacaacgaatgtatggaaacgatcaaaaacggcacctacgaccacaaagaatatgaagaagaagcaaaactcgaacgcagcaaaatcaacggagtaaaactagaagaaaacaccacatacaagtccggcagactcgtcccacgaggcagccccggctcgggatacatcccagaagcccccagagacggacaagcctacgtccgtaaagacggcgaatgggtcctcctgtcaaccttcctaggcaaaccgataccaaaccccctcctcggactagactcaaccgga

SEQ ID NO: 58974 - RNA, 1701 nt, synthetic construct
  misc_feature 1..1701: note = derived and/or modified sequence opt11 from anti-influenza_Chain
  source 1..1701: mol_type = other RNA
gacaaaatctgcatcggttaccacgccaacaactcaaccacccaagtagacaccatcctcgagaaaaacgtcaccgtcacacactctgtcgagctactggaaaaccaaaaagaagaacgcttctgcaaaatactcaacaaagccccactcgacctacgcggctgcacaattgagggatggatcctcgggaacccccaatgcgacctactcctaggcgaccaatcatggtcttacatcgtcgaacgcccgaccgcccaaaacggaatatgctaccccggcgccctcaacgaagtcgaagaactaaaagccctcatcggctcgggagaacgcgtcgaacgcttcgaaatgttcccaaaatccacatggaccggcgtagacaccagcagtggagtaaccaaagcctgtccctataactccggaagctcattctaccgaaacctgctttggatcataaaaaccaaatcagcagcctaccccgtcataaaaggcacctacaacaacacaggcagccagccaatcctctacttctggggagtccaccacccaccagacaccaacgaacaaaacaccctctacggaagcggtgacagatacgtacgaatgggcacagaatctatgaacttcgcaaaatccccagaaatcgcggccagaccagcggtcaacggacaacgcggacgaatcgactactactggagcgtactcaaaccaggagaaacgctcaacgtcgagagcaacggcaaccttatagccccctggtacgcctacaaattcgtgtcaaccaacaacaaaggcgcaatcttcaaatccaacttaccaatagagaactgcgacgcaacctgccaaaccatcgccggcgttctccgtaccaacaaaaccttccaaaacgtctcgcccctgtggatcggagaatgcccaaaatacgtcaaaagtgagtccctacgcctggccacgggactcagaaacgtaccacaaatcgaaacccgcggcctcttcggcgccatcgcaggattcattgaaggaggatggaccggaatgatagacggctggtacggatatcaccacgagaactctcaagggagcggatacgctgcagacaaagaaagcacccaaaaagcaatcgacggaatcaccaacaaggtaaacagcataatagacaaaatgaacacccaattcgaagcagtagaccacgagttctccaatctagaacgacgcatcgataacctgaacaagcgcatggaagacggcttcctcgacgtgtggacctacaacgcagaactcctcgtccttctcgagaacgagcgcacactcgacctacacgacgcaaacgtgaaaaatctctacgaaaaagtcaaatcacaactccgcgacaatgccaacgacctcggcaatggctgcttcgagttctggcacaaatgcgacaacgaatgcatcgaatcggtcaaaaacgggacatacgactacccaaaataccaagacgaaagcaagctcaaccgtcaagaaatagaaagcgtaaaactcgacaacctcggcgtataccaaagcgggcgcctcgtcccacgcggaagccccggctcaggctacatccccgaagcaccacgcgacggacaagcatacgtccgaaaagacggcgaatgggtactcctaagcaccttcctaggcaaacccataccaaaccccctattaggcctcgactcaaccgga

SEQ ID NO: 58975 - RNA, 1701 nt, synthetic construct
  misc_feature 1..1701: note = derived and/or modified sequence opt11 from anti-influenza_Chain
  source 1..1701: mol_type = other RNA
gataaaatctgcatcggataccacgcaaacaactccaccacccaagtcgacacaattctcgagaaaaacgtaacagtaacccattccgtcgaactcctcgaaaaccaaaaagaagaacgcttctgcaaaatccttaacaaagcacccctggacctccgcggctgcaccatcgaaggctggatcctcggcaacccccaatgcgacctcctcctcggcgaccaaagctggagttacatcgtcgaacgtcccaccgcccaaaacggaatctgctaccccggcgccctcaacgaagtagaagagttaaaagccctaatcggttcaggcgaacgagtcgaacgattcgaaatgttccccaaatccacctggacaggcgtcgacacatccagcggcgtaaccaaagcatgtccctacaacagcgggtcctcattctacagaaacctcctgtggatcatcaaaaccaagtcagccgcctacccagtcatcaaaggcacctacaacaacacgggcagccaacccatcctctacttctggggagtacaccacccaccggacaccaacgaacaaaacacactttacgggtccggcgaccggtacgtccgcatgggaacagaatccatgaacttcgcaaaatccccagagatcgcagcccgacctgccgtcaacggccagcgcggccgcatcgactactactggtcggtcctaaaacccggtgaaacactaaacgtcgaatccaacggaaacctaatagccccctggtatgcatacaagttcgtatcaacaaacaacaaaggcgccatcttcaaaagcaatctcccgatcgaaaactgcgatgcaacctgccaaacaatagccggcgtcctccgaaccaacaaaaccttccaaaacgtctcacccctctggataggcgaatgcccaaaatacgtcaagtccgaatccctccgactcgccacaggtctacgcaacgtcccacaaatcgaaacacgcggcctatttggcgcaatagccggtttcatcgaaggaggctggacagggatgatcgacggatggtacggctaccaccacgaaaactcccaaggttccggctacgccgcagacaaagaatccacacaaaaagccatagacggcataaccaacaaggtaaacagcataatcgacaaaatgaacacccaattcgaagccgtcgaccacgagttcagcaacctagaacgccgcatcgacaacctcaacaaacgcatggaagacgggttcctcgacgtatggacgtacaacgcagaactcctcgtcctactggaaaacgaacgtacactagacctacacgacgccaacgtcaagaacctctacgaaaaagtcaaatcacaactccgtgacaatgcaaacgacctaggcaacggatgcttcgagttctggcacaagtgcgacaacgaatgcatagaatccgtcaaaaacggcacctatgattaccccaaataccaagacgaatctaaactcaaccgccaagaaatagaatccgtaaaactcgacaacttaggcgtataccaatcaggacgcctagtcccccgaggaagccccggatccggctacatccccgaagcaccccgagacggccaagcctacgtccgaaaagacggcgaatgggtcttactctccacattcctaggcaaaccgatacccaaccccctcctcggactcgactcaacaggc

SEQ ID NO: 58976 - RNA, 1704 nt, synthetic construct
  misc_feature 1..1704: note = derived and/or modified sequence opt11 from anti-influenza_Chain
  source 1..1704: mol_type = other RNA
gaccacatctgcatcggctaccatgccaacaactccaccgagcaagtcgacacaatcatggagaaaaacgtcaccgtcacacacgcccaggacatactcgagaaaacccacaacggcaaactatgcgacctaaacggtgtaaaacccctaatactaaaagactgctctgtggcaggatggctgctcggcaacccaatgtgtgatgaatttatcaacgtccccgaatggtcatatatagtcgaaaaagctaacccagcaaacgacctctgctaccccggcaacttcaatgactacgaagaactcaaacacctactaagccgaataaaccatttcgagaaaatccaaatcatcccaaaagactcctggagcgaccacgaagcatcgctcggagtatcctccgcgtgcccctaccaaggcaattcctcattcttccgaaacgtcgtctggctcatcaagaaaggaaacgcatacccaacaataaagaaaagctacaacaacaccaaccaagaagaccttctagtcttatggggcatacaccaccctaacgacgaagcagaacaaacccgcctataccagaacccaacaacctacatctccatcggcacgagcacgctaaatcaacgcctcgtacccaaaatcgccacccgaagcaaagtcaacggccaatccggccgcatagacttcttctggaccatacttaaacccaacgacgccatcaacttcgaaagcaacggcaacttcatcgcaccggaatacgcctacaaaatcgtcaagaaaggagactcaacaataatgaaaagcgaagttgaatacgggaactgcaacacacgctgtcagacgcccatgggcgccataaacagttccatgcctttccacaacatccaccccctcacaatcggcgaatgtcccaaatacgtgaaatcaaacaaactcgtcctagcaaccggcctacgaaactcaccccaacgcgaacgcagacgaaaacgcgggctattcggagcgatcgcgggattcatcgaaggaggctggcaaggcatggtcgacggctggtacggctaccaccactccaacgaacaaggaagcggatacgcggcagacaaagaaagcacccaaaaagccatcgacggagtcacaaacaaagtcaacagcataatcgacaaaatgaacacccaattcgaagccgtcgggcgcgagttcaacaacctcgaacgacgaatagaaaacttaaacaagaaaatggaagacggcttcctagacgtctggacatacaacgccgaactactcgtactaatggaaaacgaacgcacgctcgacttccacgactcaaacgtcaaaaacttatatgacaaagtacgcctacaactccgagacaacgcaaaagaactgggcaacggttgcttcgagttctaccacaaatgcgacaacgaatgcatggaatcagtccggaacggcacctatgactacccacaatactccgaagaagcacgcctcaaacgagaagaaatcagcggagtcaaactcgagtccatcggcacataccagagcggacgactcgtcccacgcgggtcacccggctcaggctacatcccagaagcgccccgagacggccaagcctacgtacgtaaagacggcgaatgggtactactcagcaccttcctaggaaaacccatcccaaacccgctcctgggactcgactcaacaggg

SEQ ID NO: 58977 - RNA, 1704 nt, synthetic construct
  misc_feature 1..1704: note = derived and/or modified sequence opt11 from anti-influenza_Chain
  source 1..1704: mol_type = other RNA
gaccagatctgcatcgggtaccacgcaaacaactcgaccgaacaagtcgacaccatcatggagaaaaatgtcacagtaacccatgcccaagacatcctagagaaaacgcataacggaaaactttgcgacctagacggcgtcaaacccctcatcctccgcgactgctccgtcgcaggatggctcctcggcaaccccatgtgcgacgagttcatcaacgtccccgaatggtcatacatagtagaaaaagccaacccagcgaacgacctctgctacccaggaaacttcaacgactacgaagaactcaaacacctcctctcccgcataaaccacttcgagaaaatccaaatcatccccaaatcaagctggagcgaccacgaagcatccagcggcgtatcgtcagcctgcccgtaccaaggcacaccatcattcttccgcaacgtcgtctggctcataaagaaaaacaacacctaccccaccataaaacgctcctacaacaacaccaaccaagaagacctcctgatcctctggggcatccaccactccaacgacgccgcagaacaaacaaaactctaccaaaaccctactacctacataagcgtcggcaccagcaccctcaaccaacggctcgtcccaaaaatagcaacacggtcaaaagtaaacggccaatccggccgaatggacttcttctggaccatcttaaaaccaaacgacgcgataaacttcgaatccaacggaaacttcatagccccggaatacgcatacaaaatcgtcaagaaaggagactccgcaatcgtaaagagcgaagtagaatacggcaactgcaacaccaagtgccagacccccatcggcgcaataaacagctcaatgcccttccacaacatccacccactaaccatcggagaatgcccaaaatacgtcaaatcaaacaagctagtcctcgcaaccggcctcagaaactccccactaagagaacgacgacgcaaaagaggcctgttcggagctatagcaggcttcatagaaggcggatggcaaggcatggtcgacggctggtacgggtaccaccactcaaacgaacagggcagcgggtacgccgccgacaaagaatccacacagaaagccatcgatggagtcaccaacaaagtaaacagcatcatcgacaaaatgaacacacaattcgaagccgtcggacgagagttcaacaacctcgaacgacgaatagaaaacctcaataagaaaatggaagacggattcctcgacgtctggacctacaacgcagaactgctcgtcctaatggaaaacgaacgaaccctcgacttccacgactccaacgtcaaaaacctatacgacaaagtccgactccaactcagagataacgcaaaagaactgggcaacggctgtttcgagttctaccacaaatgcgacaacgaatgcatggaaagcgtacgaaacggcacatatgactacccccaatactcagaagaagcccgactaaaacgagaagaaataagcggagtgaaactcgaatccatcggcacctaccaatccggccgcctagtcccacgagggtcgccaggctccggatacatccccgaagcaccacgcgacggccaagcctacgtccgcaaagacggcgaatgggtactactctccaccttcctcggaaaaccaatacccaaccctctactcggccttgattccaccgga

SEQ ID NO: 58978 - RNA, 1704 nt, synthetic construct
  misc_feature 1..1704: note = derived and/or modified sequence opt11 from anti-influenza_Chain
  source 1..1704: mol_type = other RNA
gaccacatatgcatcggctaccacgcaaacaacagcacagaacaagtcgacacaatcatggaaaagaatgtcaccgtgacccacgcgcaagacatcctagagaaaacacacaacggcaaattatgcgacctcaacggagtaaaacccctcatcctaaaagactgcagcgtagcaggctggctcctcggcaaccccatgtgcgacgagttcatcaacgtacccgaatggtcatacatcgtcgaaaaggccaaccctgcaaacgacctctgctatcccggcaacttcaacgactacgaagaactcaaacacctcctaagccgaatcaatcacttcgagaaaatccagatcatccccaaagactcctggagcgaccacgaagcaagcctcggagtctcctcagcatgcccgtaccaaggcaactcctcattcttccgaaacgtcgtctggcttataaagaaaggtaacgcctaccccaccatcaagaaatcatacaacaacaccaaccaagaagacctgctcgtgctctggggaatccaccaccccaacgacgaagcagagcaaacccgactataccagaaccccaccacatacatctccatcggaacgtccacgctcaaccaacgactcgtccccaaaatcgcaacccgttccaaagtcaacggccagtccggcaggatcgatttcttctggaccatcctaaaacccaacgacgcaatcaacttcgaatcaaacggcaacttcatcgcccccgaatacgcatacaaaatagtcaagaaaggagactccaccatcatgaaatccgaggtcgaatacggtaactgtaacacccggtgccaaacacccatgggcgcaataaacagctccatgccattccacaacatccaccccctaacaattggggaatgcccaaaatacgtcaaatccaacaaactggtcctcgcgaccggcctccgaaactcaccccaacgagaacgccgccgaaaacgcggccttttcggcgcaatagcaggcttcatcgaaggcggctggcaaggcatggtcgacggatggtacggataccaccactccaacgaacaaggctccggatacgccgccgataaagagtccacccaaaaagccatcgacggagtaacaaacaaagtcaactcaatcatcgacaaaatgaacacacaattcgaagcagtcggccgcgaatttaacaacctggaaaggcgcatagaaaacctcaacaagaaaatggaagacgggttcctcgacgtctggacctacaacgccgaactcctcgtcctcatggaaaacgaacgaacactagacttccacgacagcaacgtcaaaaacctctacgacaaagtacgactacaactaagagacaacgccaaagaactcggaaacggctgcttcgagttctaccacaaatgcgacaacgaatgcatggaatccgtacggaacggcacctacgactaccctcaatactccgaggaagcccgactcaaacgcgaagaaatcagcggagtcaaattagaaagcatcggcacctaccagtctggacgcctcgtccccagaggatcacccggcagcggatacatccccgaagcaccccgagacggccaggcctacgttaggaaagacggagaatgggtactactgtccacattcctaggaaaaccaataccaaaccccctactaggactcgacagcactggc

SEQ ID NO: 58979 - RNA, 1704 nt, synthetic construct
  misc_feature 1..1704: note = derived and/or modified sequence opt11 from anti-influenza_Chain
  source 1..1704: mol_type = other RNA
gaccaaatctgcataggctaccacgcaaacaactctaccgaacaagtcgacaccataatggaaaagaacgtcaccgtcacccacgcccaggacatactagagaaaacacacaacggcaaactctgtgacctagacggagtcaaacctctgatcctccgcgactgcagcgtcgcaggatggctcctcggaaaccccatgtgcgatgagttcataaacgtcccagaatggtcatacatagtcgaaaaagccaaccccgccaacgacctatgctaccccggcaatttcaacgactacgaagaactcaaacacctcctcagccgcataaaccacttcgagaaaatccaaatcatccccaaatcctcatggtccgaccacgaagcctcaagtggagtaagcagcgcctgcccctaccaaggaacaccctccttcttccgcaacgtcgtctggctgataaagaaaaacaacacataccccacaatcaaaagaagctacaacaacaccaaccaggaagacctcctgattctctggggcatacaccactctaacgacgcagccgaacagaccaaactctaccaaaaccccaccacatacatcagcgtgggcacatcgacgctcaaccagcgcctcgtgcccaaaatcgccacccgcagcaaagtaaatggccaaagcgggcgaatggatttcttctggaccatactcaaacccaacgacgcaatcaacttcgaatcaaacggcaacttcatagcccccgaatatgcctacaaaatagtaaagaaaggcgactccgccatcgtcaaaagcgaagtcgaatacggcaactgcaacacaaaatgccaaacacccataggcgcgatcaacagctccatgcccttccacaacatccacccattaacaataggggaatgcccaaaatatgtaaaatcaaacaaacttgtactcgccaccggcctacgcaactcaccactccgagaacgccgacgcaaacgaggcctcttcggagccatagccggtttcatagaaggcggatggcagggcatggtagacggctggtacggctaccaccatagcaacgaacagggctcaggatacgccgccgacaaagaatcaacacaaaaagcaatagacggcgtaacgaacaaagtcaacagcataatcgacaaaatgaacacacaattcgaagccgtaggcagagagttcaataatctcgaacgccgcatcgaaaacctcaacaagaaaatggaagacggcttcctcgacgtatggacctacaacgccgagcttctcgtcctgatggaaaacgagcgtaccctcgacttccacgactccaacgtcaaaaacctatacgacaaagttcgcctccagctccgcgacaacgcaaaagaacttggcaacggctgtttcgagttctaccacaaatgcgacaacgaatgcatggaatccgtccgcaacggcacatacgactacccacagtactccgaagaagcccgactcaagagagaagaaatatctggagtcaaactcgagagcattggcacataccagtctggccgcctcgtaccccgcggatccccaggcagcggctatatccccgaagcccccagagacgggcaagcctatgtacgaaaagacggcgaatgggtcctcctctcaaccttcctcggcaaaccaatacccaacccactactcggcttggattcaaccgga

SEQ ID NO: 58980 - RNA, 1707 nt, synthetic construct
  misc_feature 1..1707: note = derived and/or modified sequence opt11 from anti-influenza_Chain
  source 1..1707: mol_type = other RNA
gaccaaatctgcatcggctaccacgcgaacaactccacggaacaagtagacacaataatggagaaaaacgtcaccgtcacccacgcccaagacatcctcgaaaagaaacacaacggtaaactatgcgacctggacggagtcaaacccctaatactacgcgactgctccgtcgccggctggctactcggaaaccccatgtgcgacgagttcatcaacgtacccgaatggagctacatcgtcgaaaaggccaaccccgttaacgacctctgctaccccggagacttcaacgactacgaagaacttaaacacctactctcccgcatcaaccacttcgaaaagatacaaattataccgaaatcctcatggagttcacacgaagcctccctcggagtcagcagcgcctgcccctaccaaggcaaaagctcattcttccgcaacgttgtctggctcatcaagaaaaacagcacttaccccacaatcaaacgctcatacaacaacaccaaccaagaagaccttctcgtcctttggggaatccaccatcccaatgacgcagccgagcaaaccaaactctaccagaacccaaccacctacatttccgtaggcacttccacactaaaccaacggctagtcccacgaatcgccacccgaagcaaagtcaatggccagtccggccgaatggagttcttctggactatcctcaaacccaacgacgccatcaacttcgaatccaacggaaacttcatagctccagaatacgcctacaaaatagtcaagaaaggcgactccacaataatgaaaagcgaattagaatacggcaactgcaacaccaaatgccaaacaccaatgggcgccattaacagctcaatgccattccacaacatacacccactcaccataggcgaatgcccaaagtacgtaaaatccaaccgcctcgtactcgccaccggcctccgaaacagcccccaaagagaacgcagacggaaaaagcgcggcctattcggagccatagccgggttcatcgaaggcggctggcaaggcatggtagacggctggtacggctaccaccactccaacgaacaaggctccggatacgccgccgacaaagaatcaacccaaaaagcaatcgacggagtcaccaacaaagtaaactccattatcgacaaaatgaacacacagtttgaggccgttggccgagagttcaacaacctcgaacgccgcatcgaaaacttgaataagaaaatggaagacggcttccttgacgtatggacctacaacgccgaactcctcgtcctcatggaaaacgaacgcacgctagacttccacgacagcaatgtcaaaaacctgtacgacaaagtacgcctccaactacgcgacaacgccaaagaactcggaaacggatgcttcgagttctatcacaaatgcgataacgaatgcatggaaagcgtacgcaatggaacatacgactacccccagtactccgaagaagcccgcctcaaacgagaagaaatcagcggagtaaaactcgaaagcatcggcatctaccaatcaggccgtctcgtaccccggggatcccccggttccggctacataccggaagccccgagagacggccaggcttacgttagaaaagacggcgaatgggtcctactctccaccttcctgggaaagccaatacccaacccactactcggactagactccaccggc

SEQ ID NO: 58981 - RNA, 1707 nt, synthetic construct
  misc_feature 1..1707: note = derived and/or modified sequence opt11 from anti-influenza_Chain
  source 1..1707: mol_type = other RNA
gaccaaatctgcataggttaccacgccaacaactccaccgaacaagtcgacaccatcatggagaaaaacgtaaccgtcacccacgcacaagacattctagaaaagacccacaacgggaaactatgcgaccttgacggagtcaagcccctaatactccgcgactgctcagttgcagggtggctcctaggcaaccccatgtgcgacgaattcataaatgtccccgaatggtcctacatcgtcgaaaaagccaacccaacaaacgacctctgctaccccggctcattcaatgactacgaagaactcaaacacctgctctcccggataaaccatttcgaaaaaatccagattatccccaaaagctcctggtcggaccacgaggcaagctccggcgtatcatcagcctgcccatacctcggctctccctccttcttccgcaacgtcgtgtggctaatcaaaaaaaacagcacctatccaaccatcaaaaaatcctacaataacacaaaccaggaggacctactcgtcctctgggggatccaccaccccaacgacgccgccgagcagacccgactatatcaaaaccccacaacgtacatctccatcggaacatccaccctcaaccaacgcctagtaccaaaaatagccacccgctccaaagtcaacggtcaatcaggccgcatggaattcttctggaccatcctcaaacccaacgacgccatcaacttcgaatcaaacggcaacttcatcgcccccgaatacgcctacaaaattgtgaaaaaaggcgactccgcaattatgaaatcagaactcgaatatggcaactgcaacacaaaatgccaaacgccaatgggcgcaataaacagctcgatgccattccacaacatacaccccctcaccatcggggaatgccccaaatacgtaaaatcgaaccgactagtactagccacaggcctacgcaactccccccaacgcgaaagccgccgtaaaaaacgcggcctcttcggcgcaattgccgggtttatcgaaggcggctggcaaggaatggtcgacggatggtacggataccaccactcaaacgaacaaggatccggatacgccgcggacaaagaatccacccagaaagccatcgacggcgtcacaaacaaagtaaactcgatcatagacaaaatgaacacccaattcgaagccgtaggccgcgagttcaacaacttggaacgccgaatcgaaaacctcaacaagaaaatggaggacggattcctcgacgtctggacctacaacgccgaactcctagttctaatggaaaacgagcgaactctagacttccacgactccaacgtcaaaaacctctacgacaaagtaagacttcaactccgcgacaatgctaaagaactcggcaacggctgctttgaattctaccacaaatgtgacaacgaatgcatggagtccatccgcaacggaacctacaattacccacaatacagcgaggaagcacgactcaaacgagaagaaatctcaggagtcaaactggaatccataggaacctaccagtcaggccggcttgtaccccgcggcagtccaggctccggatacatccccgaagcaccgcgagacggccaagcatacgtcagaaaagacggagaatgggtactgctaagcacattcctaggcaagcccatccccaacccactactcggactagactccaccggc

SEQ ID NO: 58982 - RNA, 1707 nt, synthetic construct
  misc_feature 1..1707: note = derived and/or modified sequence opt11 from anti-influenza_Chain
  source 1..1707: mol_type = other RNA
gaccaaatatgcataggctaccacgccaacaactccaccgagcaagtcgacaccatcatggagaaaaacgtcaccgtcacacacgcccaagacatcctcgagaaaacccacaacggcaaactatgcgacctcgacggcgtcaaaccgctcatcctacgagactgcagcgtcgctgggtggctactaggaaaccccatgtgcgacgagttcctgaacgtcagcgaatggtcctacatcgtcgagaaaataaacccagccaacgacctctgctacccaggaaacttcaataactacgaagaactcaaacacctactctcccgtatcaaccgattcgagaaaatccaaatcattccaaaatccagctggcccgaccacgaagcaagcctcggcgtatccagtgcctgcccctaccaaggcggcccatccttctaccgcaacgtagtctggctaataaagaaaaacaacacctacccaaccatcaagaaatcatatcacaacaccaaccaggaagacctgctagtactctggggaatccaccacccaaacgacgaagcggaacaaacacgaatctacaaaaaccccaccacctacatctccgtaggcacctcaaccctcaaccagcggctggtcccaaaaatcgcgacccgctccaaagtgaacggacaaagcggcagagtagagttcttctggacgatcctgaaatcaaatgacaccataaacttcgaatcaaacggcaacttcatcgcacccgaaaacgcctataaaatcgtaaagaaaggcgacagcactatcatgaaatccgaactagaatacggcaactgtaacacaaaatgccaaacaccgatcggcgcaattaacagctcaatgccattccacaacatccatccactcaccatcggcgaatgcccgaaatacgtcaaatcaaacaggctggtcttggccacaggccttcgcaacagcccccaaggcgaaaggcgacgaaagaaacgcggcctcttcggcgcaatcgccggattcatcgaaggaggctggcaaggcatggtcgacggctggtacggctatcaccactctaacgaacaaggatccgggtacgccgccgacaaagaatcaacccagaaagccatagacggagtcacaaacaaagtgaactctatcatagacaaaatgaacacccaattcgaagccgtcggacgcgagttcaacaacctagaaagacgcatagaaaacctaaacaagaaaatggaagacggcttcctagacgtctggacctacaacgcagaactcctagtccttatggaaaacgaacgcacactcgacttccacgacagcaatgtcaaaaacctatacgacaaagtaaggctccaactaagagataacgccaaagaactcggcaatggctgcttcgagttctaccaccggtgcgacaacgaatgcatggaaagcgtacgaaacggcacatacgactacccccaatactcagaagaagctcgactcaaacgggaagaaatcagcggcgtgaaactcgaatcgataggcacctaccaatccggacgactcgtcccccgaggatcacccggaagtggctacatccccgaagcaccccgcgacggccaagcatacgtccgaaaagacggcgaatgggtcctcctgtctactttcctaggaaaacccatcccaaacccactcctcggactcgacagcaccggc

SEQ ID NO: 58983 - RNA, 1707 nt, synthetic construct
  misc_feature 1..1707: note = derived and/or modified sequence opt11 from anti-influenza_Chain
  source 1..1707: mol_type = other RNA
gaccaaatatgcatcggctaccacgccaataacagcaccgagcaagtcgataccatcatggagaaaaacgtaacagtgacccacgcccaagacatactggaaaagaaacacaacggcaaactgtgcgacctcgacggagtcaaacccctcatcctacgagattgctccgtagcaggatggctcctagggaaccccatgtgcgacgaatttatcaacgtccctgaatggagctacatcgtagaaaaagccaacccagtaaacgacctatgctatccaggcgacttcaacgactacgaagaactcaaacacctactatcccgaatcaaccacttcgagaaaatccaaatcatccccaaaagcagctggagctcacacgaagcatcgctcggggtatcctcagcatgcccctaccaagggaaatcctccttcttccgcaacgtagtctggctaataaagaaaaacagcacctacccaacaatcaaacgaagctacaacaacaccaaccaagaagacctgctggtactctggggaatacaccaccccaacgacgcagcagaacaaactaaactttaccaaaacccaaccacgtacataagcgtcggcaccagtaccctcaatcaacgacttgtcccacgcatcgcgacaagatccaaagtaaacggccaatctggcagaatggagttcttctggaccatactcaaacccaacgacgcgataaacttcgaatccaacggaaacttcatcgcccccgaatacgcctataaaatagtaaagaaaggagactccacaatcatgaaatccgaactagaatacggcaactgcaacaccaaatgccaaacacccatgggagcaatcaactccagcatgcccttccacaacatacaccccctcactataggagaatgcccaaaatacgtcaaatccaaccgactggtacttgcaacaggcctcagaaatagcccccaaagagagcgcagaagaaagaaacgaggactcttcggcgccatcgccggcttcatcgaaggtggatggcaaggcatggtcgacggctggtacgggtaccaccactccaatgaacaaggatccggctacgccgcagacaaagaaagcacacaaaaagccatcgacggcgtaaccaataaagttaactccatcatagacaaaatgaacacccaattcgaagcagtgggacgcgagttcaataacctcgaacgccgcatcgaaaacctcaacaagaaaatggaagacggattcctagacgtatggacatacaacgcagaactcctagtactcatggaaaacgaacgaacgctcgacttccacgacagcaacgtcaaaaacctctacgacaaagtacgcttacaactacgcgacaacgctaaagaactcggcaacggttgcttcgagttctaccacaaatgcgataacgaatgcatggaaagcgtacgaaacggcacctacgactacccccagtacagcgaagaagcccgcctcaaacgcgaagaaatctccggagtaaaacttgaatccatcggaatctatcaaagcggcagactcgtcccacgtggctcacccggcagcggctacatcccagaagcaccccgggacggacaagcctatgttagaaaagacggcgaatgggtcctccttagtaccttcctaggcaaacccatacctaaccccctcctaggactcgactcaacagga

SEQ ID NO: 58984 - RNA, 1707 nt, synthetic construct
  misc_feature 1..1707: note = derived and/or modified sequence opt11 from anti-influenza_Chain
  source 1..1707: mol_type = other RNA
gaccaaatatgtatcggctaccacgccaacaacagcaccgaacaggttgacaccatcatggaaaagaatgtgaccgtaacccacgcacaagacatcctagaaaaaacccacaacggaaaactttgcgacctcgacggcgtgaaaccactcatcctacgggactgctccgtagccggctggctcctgggcaaccccatgtgcgacgaattcatcaacgtgcccgaatggtcctatatcgtcgaaaaagccaacccgacaaacgacctctgctacccaggatctttcaacgactacgaggagctaaaacacctcctctcaaggataaaccacttcgaaaaaatacaaatcatccccaaatcaagctggtccgaccatgaagcgtcctccggcgtatcctccgcctgcccctacctaggctcaccaagcttcttcagaaacgtagtctggctaatcaaaaaaaactccacctacccaactataaaaaaatcctacaacaacactaaccaagaagacctcctcgtactctggggcatccaccacccaaacgacgcagcggaacaaacccgcctctaccagaaccccacaacatacatctcaatcggaacaagcaccctaaaccaacggttagtcccaaaaatcgcaacgagatccaaagtgaacggacaatccggtcgtatggaattcttctggaccatcctaaaaccgaacgacgccataaacttcgaatcgaacggaaacttcatcgcccccgaatacgcctacaaaatcgtcaaaaaaggagacagcgcaatcatgaaatccgaactagaatacggcaactgcaacaccaaatgccaaactcccatgggcgccattaacagtagcatgccattccacaacatccacccactaaccatcggcgaatgcccaaaatacgtcaaatccaaccgactcgtcctcgccaccggcctccgaaacagcccacaacgcgaatcccgacgcaaaaaacgcggacttttcggagcaatagcaggcttcatcgaaggtggctggcaaggaatggtcgacggctggtacggctaccaccacagcaacgaacaaggaagcggctacgccgctgacaaagaatccacccaaaaagccatcgacggagtcacaaacaaagtcaattccataattgacaagatgaacacccaattcgaagccgtgggccgcgaatttaacaacctagaacgccgaatcgaaaacctcaacaaaaagatggaagacggcttcctagacgtgtggacatataacgcagaactgctggtcctaatggagaacgaaagaacactagacttccacgacagcaacgtaaaaaatctctacgacaaagtccgcctacagctccgagacaacgctaaggaactaggaaacggctgtttcgaattctaccacaagtgcgacaacgaatgtatggaatcgatccgcaacggcacatacaattacccgcaatactcggaagaagcgaggctcaaacgagaagaaatcagcggagtaaaactcgaaagcatcggcacctaccaatccggacgactcgtacctcgaggcagccccgggtcaggctacatccccgaagcccccagagacggacaggcctacgtccgcaaagacggagaatgggtcctactcagcactttcctcggaaagcccatcccaaaccccctcctaggcctcgactcgaccggc

SEQ ID NO: 58985 - RNA, 1707 nt, synthetic construct
  misc_feature 1..1707: note = derived and/or modified sequence opt11 from anti-influenza_Chain
  source 1..1707: mol_type = other RNA
gaccaaatatgcataggctaccacgcaaacaactccaccgaacaagttgataccatcatggaaaagaacgtgaccgtcactcacgctcaagacatcctagaaaaaacacacaatggaaaactatgcgacctcgacggcgtcaaacccctaatcctccgagactgctccgtcgcaggctggctcctaggcaaccccatgtgcgacgaattcctcaacgtctccgagtggtcctacatagtcgaaaaaatcaaccctgccaacgacctctgctaccccggcaacttcaacaactacgaagagctaaaacacctcctcagccgaataaacagattcgaaaaaatacaaataatcccaaaatccagctggccggaccacgaagcctccctgggcgtatcgtccgcctgcccataccagggcggcccctccttctaccgcaacgtcgtctggctcatcaaaaaaaacaacacatacccgaccatcaaaaaatcctaccacaacacgaaccaagaagacctactcgtcctctggggaatccaccacccaaacgacgaggcagaacagacccgaatctacaaaaaccccaccacatacatatccgtaggcacctccaccctaaaccaacgcctcgtccccaagatcgccacacgatcaaaagtcaacggccaaagcggcagagtcgaattcttctggaccatcctaaaaagcaacgacacaatcaacttcgaatccaacggcaacttcatcgcacccgagaacgcctacaagatcgtaaaaaaaggcgactccacaataatgaaaagtgaactcgaatacggcaactgtaacacaaaatgccaaacccccataggcgctatcaactcctcaatgccattccacaacattcacccactcaccataggcgaatgccccaaatacgtcaaatcaaaccgactagtcctagccacgggcctgcgaaactcaccacaaggagaacgccgccgaaaaaaacgaggcctcttcggggccatagccggcttcatcgaaggcggctggcaaggaatggtcgacggctggtacggctatcaccatagcaacgaacaaggctctggctacgccgcagacaaagaatcaacccagaaagcaatagacggcgtcaccaacaaagtaaattccataatagacaaaatgaacacacaattcgaagccgtcggcagagaattcaacaacctcgaacgccgaatagaaaacctaaataaaaaaatggaagacggcttcctcgacgtctggacatacaacgcagagctactagtccttatggaaaacgaaagaacactggacttccacgactcaaacgtcaaaaacctatacgacaaagtccgcctacaactccgagacaacgccaaagaactcggtaacggctgcttcgagttctatcaccgctgcgataacgaatgcatggagtccgtccgcaacggcacctacgactacccacaatacagcgaggaagcacgcctcaaacgcgaagaaatctctggagtaaagctagagtccatcggaacataccaaagcggcagactcgtaccacgcggctcaccaggctcaggctacatccccgaagcccccagagacggccaagcctacgtccgaaaagacggcgaatgggtgcttttatccaccttcctcggcaaacccatccccaaccccctcctcggacttgacagcaccggc

SEQ ID NO: 58986 - RNA, 1728 nt, synthetic construct
  misc_feature 1..1728: note = derived and/or modified sequence opt11 from anti-influenza_Chain
  source 1..1728: mol_type = other RNA
atatgcatcggctaccacgccaacaactctaccgaacaagtcgataccattatggaaaagaacgtaaccgtcacccacgcacaggacatcctcgagaaaacccacaacggaaaactatgcgacctcgacggcgtcaaaccactcatattacgcgactgctctgtagcaggctggctcttagggaacccaatgtgcgacgagttcatcaacgttcccgaatggtcctacatcgtagaaaaagccaaccccgccaacgacctgtgctaccccggaaacttcaatgactatgaagaactcaaacacctcctatcccgaatcaaccacttcgagaaaatccaaatcatccccaaatcttcctggtccgaccacgaagcctcatctggcgtatcctcagcctgcccataccaaggaacaccatcctttttccgcaacgtagtatggctaatcaaaaagaacaacacctaccccaccatcaaacgttcgtacaacaacactaaccaagaagacctactaatcctatggggcatccaccactccaacgacgccgccgaacaaaccaaactctaccagaaccccaccacatacatcagcgtcggcacctccactttaaaccaacgcctagtaccaaaaatcgccacccgcagcaaagtcaatggacagaatggacgcatggacttcttctggaccatacttaaaccaaacgacgccatcaacttcgaatctaacggcaacttcatcgccccagaatacgcctacaaaatcgtcaaaaagggcgattctgccatagtaaaatcagaagtcgaatacggcaactgcaacacaaaatgccaaacccccatcggcgccatcaactctagcatgccattccacaacatccacccgctaaccatcggcgaatgccccaagtacgtgaaatccaacaagctcgtactcgcaaccgggttacgaaactcacccctcggatacatccccgaagcaccccgagacggccaggcctacgttcgcaaagacggagaatgggtactactctccaccttcctacgctccgacaaaacacacacgtgcccaccctgccccgctcccgaactattaggcggcccctccgtattcctcttcccacccaaacctaaagacaccctcatgatttccagaactcccgaagtcacatgcgtagtagttgacgtatcccacgaagaccccgaagttaaattcaactggtacgtagacggcgtagaagtccacaacgccaaaaccaaaccccgagaagaacaatacaactccacctaccgcgtcgtctccgtcctcacagtcctccaccaagactggctcaacggcaaagaatacaagtgcaaagtctcaaacaaagccctccccgccccaatcgagaaaaccatatccaaagcaaaaggacaaccaagagaaccccaagtctacacgctacccccttcacgcgaagaaatgactaaaaaccaggtgtccctcacatgcctcgtcaagggtttctatccatccgacatcgcagtcgaatgggaatccaacggccaacccgaaaacaactacaaaaccacacccccagtactcgactccgacggctcattcttcctttatagcaaactcaccgtcgacaaatcacgttggcaacaaggtaacgtcttctcctgctccgtaatgcacgaagcccttcacaaccactacacccaaaaatcactctctctatcacccggcaaa

SEQ ID NO: 58987 - RNA, 1728 nt, synthetic construct
  misc_feature 1..1728: note = derived and/or modified sequence opt11 from anti-influenza_Chain
  source 1..1728: mol_type = other RNA
atggtcgtcacctcaaacgcagaccgcatctgtacaggaataacaagctcgaactcaccccacgtcgtcaaaacggccacacaaggggaagtgaacgtaaccggggtcatacctctaaccaccacacccaccaaatcccacttcgcaaacctaaaagggaccgaaaccaggggcaaactctgtcccaaatgcctcaactgcaccgacctcgacgtagcgctaggacgccccaaatgcacaggaaacataccttccgctcgggtgtcaatactacacgaggtacgccccgtgacctcgggatgcttcccaatcatgcacgaccgcacgaaaatacgacaactcccgaaccttctacgcggctacgaacacataaggctctcgacccacaatgtgatcaacgccgaaaacgcgccaggaggcccatacaaaatcggtacctcgggctcatgcccaaacgtgaccaacggcaacggattcttcgcgaccatggcctgggccgtccccaagaacgataacaacaaaacagccaccaactcactcacgatagaggtcccctacatctgcactgaaggagaagaccaaataaccgtctggggcttccacagcgacaacgaaacacaaatggcgaaactatacggcgactcaaaaccacaaaaattcacgagctccgcaaacggagtaaccacgcactacgtctcacaaatcggcggcttcccgaaccaaaccgaagacgggggactaccccaaagcggacgaatagtcgtagactacatggtacaaaagagcggcaaaactggcaccatcacttaccagcgaggcattctactcccacaaaaagtctggtgcgcgagcggaaaatccaaagtaatcaaaggttcgctccccctaataggcgaagccgactgccttcatgaaaaatacggcggactcaacaaatcaaaaccgtactacaccggcgaacacgcaaaagccatcggcaactgcccaatctgggtaaaaaccccactcaaactagcaaacggcaccaagtacaggccgcccgccaaactcctcaaagaacgcggcttcttcggcgcgatcgcaggcttcctagagggcggatgggaaggcatgatcgcaggctggcacgggtatacaagccatggtgcccacggggtagccgtcgcagccgacctcaaaagcacacaagaagcaataaacaagataacgaaaaacctcaactccctgagcgaacttgaggtcaaaaacctacaaagactctcaggagcaatggatgaactacacaacgaaatcctcgaactcgacgaaaaagtcgacgacctacgagcagacacgatctccagccagatcgaactcgcggtcctactatcaaatgaaggtatcatcaattccgaagacgaacaccttctggccctcgaacgcaagctcaagaaaatgctaggaccatcagcggtagagatcggcaatggatgctttgagacaaaacacaaatgcaaccaaacatgcctagacaggatcgcggccggcaccttcgacgcaggagagttctcgctcccaaccttcgactccctcaacataaccgccgcgagcctaaacgacgacggccttgacaaccacacaatactcttatactacagcacggccgcaagctcactcgccgtcaccctaatgatagcaatcttcgtcgtttacatggtatcccgcgacaacgtcagctgcttccacagc

SEQ ID NO: 58988 - RNA, 1728 nt, synthetic construct
  misc_feature 1..1728: note = derived and/or modified sequence opt11 from anti-influenza_Chain
  source 1..1728: mol_type = other RNA
atggtcgtcacatcaaacgcagatcggatctgcaccggtataacgagctcaaactcgccacacgtcgtaaaaacggccacccaaggggaagtcaacgtaacaggagtaatccccctgaccacgacaccaaccaaaagccacttcgcgaacttaaaagggacagaaacacgcggcaaactctgccccaaatgcctaaactgcaccgacctcgacgtagcactcggaagacccaaatgcaccggaaacataccctcggccagagtctcaatcctgcacgaagtccgaccagtaacctcaggatgtttcccaataatgcacgatcgaacaaaaatacgccaactcccgaacctacttcgaggctacgaacacatcagactatcaacacacaacgtgatcaacgccgaaaacgcaccaggcggcccgtacaaaatcggcacctcaggctcatgcccaaacgtgaccaacggcaacggtttcttcgcaacaatggcatgggccgtacccaaaaacgacaacaacaaaaccgccacaaactcgctcacaatcgaagtcccatacatatgcacggaaggcgaagaccaaataaccgtttggggcttccacagcgataacgagacccagatggccaaactttacggggactcaaaaccacaaaagttcacaagctcggcaaacggcgtcaccacacactacgtctcacaaataggcggcttccctaatcaaaccgaagacggcggactaccccaatccgggcgcatagtcgtcgactatatggtgcaaaaatccggcaaaacaggcacgatcacataccaacgtggaatactactcccgcaaaaagtatggtgcgcgagcggaaaatcaaaagtcatcaagggcagcctacccttaataggcgaagccgactgcctgcacgaaaaatacggcgggctcaacaaatcgaaaccatactacaccggcgaacatgcgaaggccatcggcaactgcccgatctgggtaaagacacccctaaaactcgcaaacggcaccaaatacaggccaccggccaaactactaaaagaacgcggattcttcggagccatcgcagggttcctcgagggcggctgggaaggaatgatcgcaggctggcacggatacacaagccacggcgcgcacggggtagcagtcgcggcagatctcaaaagcacccaagaagccataaacaaaatcacgaaaaatctcaacagcctaagcgagctagaagtcaaaaacctgcaacggctctcaggcgcgatggacgaactccacaatgaaatactcgaactagatgaaaaggtcgacgacttaagagccgacaccatctcaagccaaatcgagctcgcagtactcctctcgaacgagggcataataaactccgaagacgaacacctactcgcgctcgagcgcaaacttaagaaaatgctcgggccctcagccgtagaaataggtaacggctgcttcgagaccaaacacaaatgcaatcaaacctgcctagaccgaatcgccgccgggaccttcgacgctggagagttctccctcccgaccttcgacagcctcaacatcactgccgcgagcctaaacgacgacggcctcgacaaccacaccatactactctactactctacagccgcatcatccctagcagtcacgctaatgatagcaatcttcgtagtatacatggtctcccgagacaacgtctcatgcttccacagc

SEQ ID NO: 58989 - RNA, 1728 nt, synthetic construct
  misc_feature 1..1728: note = derived and/or modified sequence opt11 from anti-influenza_Chain
  source 1..1728: mol_type = other RNA
atctgcataggataccacgccaacaactccacagaacaagtagacacaataatggaaaagaacgtcaccgtcacccacgcccaagacattcttgaaaagacccacaacggaaaactctgcgacctcgacggagtcaaaccactcatactcagagactgctcagtagccggatggctcctgggaaatcccatgtgcgatgagttcataaacgtcccggaatggtcctacatagtagaaaaagccaatcccgcaaacgacctgtgctatccagggaacttcaacgactacgaagaacttaaacacctcctaagccgcataaaccacttcgaaaagatccagataatacccaaatcctcctggtccgaccacgaagcctccagcggcgtctcaagcgcatgcccctaccaaggtaccccttccttcttccgaaatgtcgtctggctaataaagaaaaacaacacctacccaaccataaaacgatcatacaacaacacgaaccaagaagacctcctaatcctctggggcattcaccactccaacgacgccgcagaacaaaccaaactctaccaaaacccaaccacatacatctcagtcggaacctctactctcaaccaacgactcgtgccaaaaatagccacacgctccaaagtaaacggccaaaacggacgaatggacttcttctggacaatcctcaaaccaaacgacgccatcaacttcgaatccaacggcaatttcatagcccccgaatacgcatacaaaatcgtcaagaaaggcgactcagcgatcgtcaaatccgaagtcgaatacggaaactgcaacacgaaatgtcaaaccccgatcggagcaataaactcatcaatgccattccacaacatccaccctctcaccatcggagaatgccccaaatacgttaaatccaacaaactcgtcctagcaaccggactcagaaactctcccctaggatacatcccagaagcgcctcgagacggccaggcatacgtccgcaaagacggtgaatgggtcctgctcagcacattcctacgctccgacaaaacccatacctgcccaccttgccccgcccccgaactcctaggaggcccaagcgtcttcctctttcccccaaaacctaaagacacactaatgatctcgcgcacccccgaagtgacctgcgtcgtcgtcgacgtctcacacgaagaccccgaagtaaaattcaactggtacgtcgacggcgtagaagtccacaacgccaaaaccaaaccccgcgaagaacaatacaactccacataccgtgtagtcagcgtactcacagtcctccaccaagactggctaaacggaaaagaatacaaatgcaaagtctcaaataaagcacttcccgccccaatcgagaaaactatctccaaggccaaaggccaacctagagaaccccaagtctacaccctaccaccatcacgagaagaaatgaccaagaaccaagtctcacttacgtgcctagtcaaaggcttctacccgtccgacatcgccgtagaatgggaatcaaacggtcaaccagaaaacaactacaagaccacccctcccgtcctcgactccgacggatcattcttcctatactcaaaactcaccgtcgacaaaagtcgctggcaacaaggcaacgtcttcagctgctccgtaatgcacgaagccctccacaaccactacacccagaaaagcctctcactcagccccggcaaa

SEQ ID NO: 58990 - RNA, 1731 nt, synthetic construct
  misc_feature 1..1731: note = derived and/or modified sequence opt11 from anti-influenza_Chain
  source 1..1731: mol_type = other RNA
gccaaagccggagtccaatcagtcaaaatggagaaaatcgtcctactgttcgccatcgtcagcctagtcaaatcggaccaaatatgcatcggataccacgcaaacaactcaacagaacaagtcgacaccatcatggagaaaaacgtcaccgtaacacacgcacaagacatactggagaaaacgcacaacggcaaactatgcgacctagacggcgtcaaaccactcattctccgagattgcagcgtcgcgggctggctattagggaaccccatgtgcgacgaatttatcaacgttcccgaatggtcctacatcgtcgaaaaagcaaaccccgtaaacgacctctgctaccccggcgacttcaacgactatgaagaactcaaacacctcctatcccgaatcaaccacttcgagaaaatccaaataatcccgaaatcctcctggtcgtcccacgaggcttcactaggcgtaagctccgcctgcccataccaaggaaaatctagcttcttccgcaacgtcgtctggctcataaagaaaaactccacataccccaccataaaacgctcctacaacaacaccaaccaggaagacctccttgtcctctggggaatccaccacccaaacgacgcagcagaacaaacaaaactgtaccaaaacccaaccacatacatctccgtgggcacctccaccctcaatcaaaggctagttccgcgaatcgcaacccgatcaaaagtcaacggccaatccggccgaatggagttcttttggacgatcctcaaacccaacgacgccatcaacttcgaatcaaacggcaacttcatcgcccccgaatacgcatacaaaatcgtcaagaaaggagactccacaatcatgaaaagcgaactagaatacggcaactgcaacaccaaatgccaaacccccatgggggcaatcaactccagcatgccattccacaacatacacccactgacaatcggagaatgccccaaatacgtcaaaagcaaccgcctcgtcctagctaccggtctccgaaacagcccgcagcgcgaacgccgccgtaagaaacgcggactcttcggcgccatagcaggcttcatagaaggcggctggcaaggcatggtcgacggctggtatggctaccaccactccaacgaacaaggatccggatacgccgccgacaaagaatcaacacaaaaagcaatcgacggcgtaaccaacaaagtcaacagcatcatcgacaaaatgaacacccagttcgaagcagtcggacgagagttcaacaacctagaacgccgcatcgaaaacctcaacaagaaaatggaagacggcttcctagacgtatggacctacaacgccgaactattagtactaatggaaaacgaaagaaccctagacttccacgacagcaacgttaaaaacctctacgacaaagtccgactccaactccgcgacaacgccaaagaactgggaaacggctgcttcgagttctaccacaaatgcgataacgaatgtatggaatccgtaagaaacggaacctacgactacccacagtactcagaagaagcacgcctcaaacgcgaagaaatctccggcgtcaaactcgaatcaataggtatataccaaatcctgtccatctactccacagtagccagctcactcgccctagcgctcatggtcgcaggactcagcctctggatgtgctcaaatggctcactccaatgccgcatctgcatc

SEQ ID NO: 58991 - RNA, 1731 nt, synthetic construct
  misc_feature 1..1731: note = derived and/or modified sequence opt11 from anti-influenza_Chain
  source 1..1731: mol_type = other RNA
gccaaagcaggcgtacaatccgtaaagatggaaaaaatcgtactcctattcgctatcgtgtccctcgttaaaagcgaccaaatatgcatcggctaccacgcaaacaacagcaccgaacaagtcgacacgattatggaaaaaaacgtcaccgtcacacacgcacaagacatcctcgaaaaaacccacaacggcaaactatgcgacctcgacggcgtaaaacccctaatcctccgagactgctcggtcgcagggtggctactcggcaaccccatgtgcgacgaattcatcaacgtaccagaatggtcctatatagttgaaaaagccaaccctgtcaacgacctctgctaccccggcgacttcaacgactacgaagaactcaaacacctcctctctcgcatcaaccacttcgaaaaaatccaaataatcccaaaaagctcatggtcctcccacgaagccagcctcggagtctcctccgcctgcccctaccaaggcaaatcatcattcttccggaacgtggtatggctaatcaaaaaaaacagcacctaccccacaataaaaagatcatacaacaacaccaaccaagaagacctcctcgtactgtggggcatccaccacccaaacgacgcggccgaacagaccaaactataccaaaaccccaccacatacatctccgtcggcacgtccacactaaaccagcgcctagtcccccgcatcgccacccgatccaaggtaaacggccaaagcggccgcatggagttcttctggaccatcctcaagcccaatgacgccataaacttcgaatcaaacgggaatttcatcgcccccgagtacgcctacaaaatagtaaaaaagggcgactccaccatcatgaaatcagaactcgaatatggcaactgcaacaccaaatgccaaacaccaatgggtgcaataaacagctctatgccgttccacaacatccaccccctcacgataggagagtgccccaaatacgtcaaatcaaaccgcctagtcctggccaccggcctccggaacagcccacaacgagagagaagacgcaaaaaacgaggcctattcggagctatagcaggattcatcgaaggaggctggcaaggcatggtcgacggctggtacgggtaccatcactcaaacgaacaagggagtggctacgccgcagacaaagaatcgacccaaaaagccatagacggcgtaacaaacaaagtgaactccatcatagacaaaatgaacacacaattcgaagcggtaggacgagaattcaataacctcgaacgacgcatcgaaaatctcaacaaaaaaatggaagacggcttcctagacgtctggacctacaatgccgaactactcgtccttatggaaaacgaacggacactggacttccacgacagcaacgtcaaaaacctctacgacaaagtccgcctacaactacgtgacaacgcaaaagaactaggcaacggatgcttcgaattctaccacaaatgcgacaacgaatgcatggagagcgtccgcaacggtacatacgactacccccaatacagcgaagaagcccggcttaaacgcgaagaaatctccggcgtaaaacttgagagcatcgggatctaccaaatactcagcatatacagtaccgtagcatcaagcctcgcccttgccctcatggtcgccggtctatccctgtggatgtgcagcaatggcagcctccaatgccgaatatgcata

SEQ ID NO: 58992 - RNA, 1737 nt, synthetic construct
  misc_feature 1..1737: note = derived and/or modified sequence opt11 from anti-influenza_Chain
  source 1..1737: mol_type = other RNA
atggtcgtcaccagcaacgccgaccgcatctgcacaggaatcacctccagcaacagcccacacgtagtcaaaaccgcaacccaaggcgaagtcaacgtcacaggagtcatccccctcacaacaacacccaccaaatcccacttcgcaaacctcaaaggaacccagacccgtggaaagctatgcccaaattgtctcaactgcacggacctagacgtcgcactcgggaggcccaaatgcatgggaacgatcccaagcgcgaaagcatccatacttcacgaagtaaaacccgtaacaagcggatgcttcccaataatgcatgaccgcaccaaaatcagacaactcccaaacctcctgcgagggtacgagaacatacgactctcagcacgcaacgtcataaacgcagaaaccgcacccggaggaccatacatagtaggtacaagcggcagctgcccgaacgtaacaaacggcaaaggattctttgccaccatggcctgggcggtccccaaaaacaaaaacaaaaccgctaccaacccactaacggtagaagtcccgtacatttgcacaaagggcgaagaccaaatcaccgtatggggattccacagcgacaacgaagcccagatggtcaccctctacggcgactccaaaccacaaaaattcactagctccgcaaatggagtcaccacacactacgtctcgcaaatcggcggcttcccaaatcaaaccgaagacgaaggcctgcaacaaagcggccgaatcgtagtagattacatggtccaaaagcccggaaaaaccggaacgatcgtataccaacgcggcgtactcctcccccaaaaagtatggtgcgcatccggacgttcaaaagtcatcaaaggttcgctaccactcataggcgaagcggactgcctgcacgagaaatacggcggactcaacaaatcaaaaccttactacacaggagaacacgccaaagcaatcggcaattgcccgatctgggtaaagacaccactcaaactagcgaacggaaccaaataccgaccaccagccaaactactgaaagaacgaggattcttcggcgcaatcgcaggatttctcgagggagggtgggagggcatgatcgccggatggcacggatacaccagccacggcgcgcacggagtcgcggtagcagcagacctcaaatccacacaagaagcaataaacaagatcaccaaaaacctcaacagcctatccgagctcgaagtcaaaaacctacaaagactcagcggcgcgatggacgaactacacaacgaaatactggagctcgatgaaaaagtagacgaccttcgcgcagacacaatctcatcacagatcgaactcgcagtactactctccaacgaaggcataataaacagcgaagacgaacacctactcgccctagagcgtaaactaaagaaaatgctaggacccagcgccgtagatataggcaacggctgcttcgagacaaaacacaaatgcaatcaaacgtgcctagaccgcatagcggcaggcacattcaacgccggcgagttctcgctccccaccttcgactccctaaatatcacggccgcatccctcaatgacgacggactagacaaccacaccatactcctgtactacagcacagccgcaagctccctcgcggtaacgctcatgatcgcaatcttcatcgtctacatggtatcacgcgataacgtgttcctactccatctctccatcaggaaa

SEQ ID NO: 58993 - RNA, 1737 nt, synthetic construct
  misc_feature 1..1737: note = derived and/or modified sequence opt11 from anti-influenza_Chain
  source 1..1737: mol_type = other RNA
atggtcgtcaccagcaacgccgaccgaatctgcaccggcataacatcgtccaacagcccacacgtcgtaaaaaccgcaacccaaggcgaagtcaacgtcaccggcgtaatccccctcacgaccacccccacaaaatcccacttcgcaaacctaaagggcacgcaaacccgcggaaaactctgcccaaactgcctcaactgcacagacctcgacgttgccctaggccgacccaaatgcatgggaaccatccccagcgcaaaagcaagcatactccacgaagtaaaacccgtcacatcaggatgcttcccaatcatgcatgaccgcaccaaaatccggcaactcccaaacctactccgaggctacgaaaacatccgcctgagcgcccgtaatgtcatcaacgcggaaacagccccaggcggcccatacatcgtgggcaccagcggctcttgccccaacgtcacaaatgggaaagggttcttcgccacaatggcctgggcagtccccaaaaataaaaacaaaacagcaaccaaccctctcacagtcgaagtcccgtacatatgcaccaagggtgaagaccaaatcaccgtgtgggggttccactcagacaacgaagcccagatggtaaccctatacggcgactcaaaaccacaaaaattcaccagctcggccaacggcgtcacaacccactacgtatcccaaataggcggattccccaaccaaaccgaagacgaaggactccaacaatcaggccgcatagttgtagactacatggtccaaaaacccggaaaaactggcaccatagtataccaacgcggcgtcttattaccccagaaggtatggtgcgcttccggccgttccaaagtaataaagggctcgctaccgctcataggagaagccgactgcctacacgaaaaatacggcggccttaataaatcgaagccctattacaccggagaacacgccaaggccataggaaactgcccaatctgggtcaaaaccccactcaaacttgctaacggaactaaatacagaccacccgccaaactcctaaaagaaagaggcttcttcggcgcaatcgcaggcttcctcgaaggaggatgggagggcatgatagccggctggcacggctacaccagccacggagcacacggcgtcgcagtcgccgctgacctcaaatccacccaagaagccataaacaaaatcaccaaaaacctaaactctctttccgaactcgaagtcaaaaacctacaacgcctgtcaggagccatggacgaactgcacaacgaaatcctagagctcgacgaaaaggtagacgacctacgcgccgacacaatatcatcacaaatcgaattagcagtccttctatcaaacgaaggaatcatcaacagcgaggacgaacacctcctcgccctcgaacgcaaactaaagaaaatgctgggaccctcagcagtagacatcggaaacggatgcttcgaaaccaaacacaaatgcaaccaaacctgcctagacaggatcgcagcaggaaccttcaacgcaggcgagttctccctccccaccttcgactcgctaaacatcaccgcagcgagcctcaacgacgacgggctcgacaatcacaccatcctcctatactactccacagccgcatcctcgctagccgtaacactcatgatcgccatcttcatcgtttacatggtctcgcgcgataacgtgttcctactccatctctccatccgaaaa

SEQ ID NO: 58994 - RNA, 1731 nt, synthetic construct
  misc_feature 1..1731: note = derived and/or modified sequence opt11 from anti-influenza_Chain
  source 1..1731: mol_type = other RNA
atggaaacaatttccctcataaccatcctcctagtcgtaacagctagcaacgccgacaaaatatgcatcggccaccaatcgacaaatagcacagaaaccgtagacacactgaccgaaacaaacgtcccagtaacacacgccaaagaactcctgcacaccgaacacaacggaatgctctgcgcgacctccctcgggcaccctctcatactcgatacctgcaccatcgaaggactggtctacggaaacccttcatgcgacctcctcctaggaggccgagagtggtcatacatagtcgaacgttcatcagcagtcaacggaacatgctaccccggcaacgtcgaaaaccttgaagaactacgcaccctcttcagctcagcctcaagctaccaacgcatacaaatcttcccagacacaacgtggaacgtaacatacacaggcacctccagggcctgcagcgggagcttttacaggtccatgcgctggctaacacaaaaatccggattctatcccgtacaagacgcacaatacacaaacaaccgcggcaaatccatcctattcgtgtggggaatacaccaccctcccacgtacaccgaacaaaccaacctctacatcagaaacgacaccacaacctccgtaacaaccgaagaccttaacagaaccttcaaacccgtaatcggccctcgacccctcgtcaatggcctccaaggacgcatcgactactactggtcagtactaaaacccggccaaaccctccgcgtccgctcaaacggaaacctgatcgcaccatggtacgggcacgtgctctccggcggcagccacggccgcatactcaagaccgacctaaaaggcggcaactgcgtagtacaatgccaaacagagaaaggcggcctaaactccaccctccccttccacaatatctcaaaatacgccttcggcacgtgcccaaaatacgtccgcgtcaacagcctcaaactcgcagtgggcctgcggaacgttccagcacggagctcccgcggcctcttcggagccatagcaggcttcatcgagggaggatggcccggcctagtagccggctggtacggcttccagcactccaacgaccaaggcgtcggaatggcggccgacagagacagcacccaaaaagccatcgacaagatcacctccaaagtcaacaacatcgtcgacaaaatgaacaagcaatacgaaatcatcgaccacgagttcagcgaagtagaaacccgactcaacatgataaacaataagatcgacgaccaaatccaggacgtatgggcctacaacgccgaactcctagtgctcctcgaaaaccagaaaaccctcgacgaacacgacgccaacgtgaacaatctatacaacaaagtcaaacgcgccctcggcagcaacgccatggaagacggcaaaggctgcttcgagctctaccacaaatgcgacgaccaatgcatggaaactatccgaaacggaacatacaaccgacgcaaataccgagaagaaagccgcctagaacgacagaaaatcgaaggagtcaagctggaatccgaaggcacatacaagagcgggcgactggtacccagaggaagccccggatcaggctacatacccgaagcgccccgcgacggccaagcatacgtgagaaaagacggggaatgggtactactctcaacattcctcggaaaacctatccccaacccactcctcggactggactcaacaggg

SEQ ID NO: 58995 - RNA, 1731 nt, synthetic construct
  misc_feature 1..1731: note = derived and/or modified sequence opt11 from anti-influenza_Chain
  source 1..1731: mol_type = other RNA
atggagacgatcagcctcatcaccatcctactggtagtcaccgcttccaacgcagacaaaatatgcatcggacaccaatccaccaacagcaccgaaaccgtcgacacactcacagaaacaaacgtaccagtcacccacgcaaaagaactcctccatacagaacacaacggcatgctctgcgccacaagcctaggccaccccctcatactcgatacctgcaccatcgaaggcctcgtatacggcaaccccagttgcgacctcctcctcggaggccgcgagtggtcctacatcgtcgaacgatcaagcgccgtcaacggaacatgctaccccggcaacgtagaaaacctagaagaactacgcaccctcttctcgtcggcctccagctaccaaagaatacaaatattccccgacacaacctggaacgtcacctacaccggcacctcacgagcgtgcagcggcagcttctacagaagcatgcgctggctaacccagaaaagcggcttctacccagtccaagacgcccaatacacaaacaaccgcggcaaatctatactattcgtatggggcatccaccacccgccaacctacacagaacaaacaaacctctacatccgcaacgacacaaccacctcagtcaccaccgaagacctaaaccgcacctttaagccagtaataggcccgcgccccctagtcaacggcctacaagggcgcatcgactactactggtctgtcctcaaaccgggccaaacactccgagtacgttccaacggcaacctaatcgcaccttggtacggccatgtactcagcggtggatcccacggcagaatcctcaagaccgacctcaaaggcggcaactgcgtcgtacaatgccaaaccgaaaagggaggactaaactccaccctcccctttcacaacatctcaaaatatgccttcggcacatgccccaagtacgtccgagtcaatagcctcaaactagccgtgggcctaagaaacgtccccgcccgcagctcccgcggactattcggcgcaatagcaggcttcatcgagggaggatggccaggcctagtagccggatggtacggattccaacactcaaacgaccaaggagtcggcatggccgccgaccgcgactccacccaaaaagccatcgacaaaatcacctccaaagtcaacaacatcgtcgacaaaatgaacaaacaatacgaaataatcgaccacgagttctcagaagtcgaaacacgcctcaacatgataaataacaaaatcgacgaccaaatacaggacgtatgggcgtacaacgccgaactactcgtcctactcgaaaaccagaaaaccctagacgaacacgacgccaacgtaaacaacctatacaacaaagtaaaacgcgccctaggatcaaacgccatggaagacggcaagggatgcttcgaactctaccacaaatgcgacgaccaatgcatggaaaccatccgaaacggaacctacaaccgccggaaatacagagaagaatcccggctagagcgtcagaaaatagaaggcgtaaaacttgaaagcgaaggaacatacaaaagcggacgtcttgtcccacgcggctcccccggatccggctacatacctgaagcaccgagagacggccaagcatacgtccgcaaggacggagaatgggtcctactctcaacgttcctggggaaaccaatcccaaaccccctcctcggattagacagcacagga

SEQ ID NO: 58996 - RNA, 1752 nt, synthetic construct
  misc_feature 1..1752: note = derived and/or modified sequence opt11 from anti-influenza_Chain
  source 1..1752: mol_type = other RNA
atgaaagcaataatcgtcctcctaatggtggtcacctccaacgcagaccgcatttgcacgggcataacctccagcaacagcccgcacgtcgtaaaaacagcgactcaaggcgaagtcaacgtaaccggcgtgatcccactcactaccacgcccaccaaatcacattttgccaatctcaaaggcacccaaacaagaggcaaattatgcccaaactgcttcaactgcaccgacctagacgtagccctgggtcgaccaaaatgcatgggcaacaccccaagcgcaaaagtgagtatcctccacgaagtgaaacccgcaacctccggctgcttccccatcatgcacgacaggaccaaaatcagacaactccccaacctcctacgaggctacgaaaacatccgcctaagcacgagcaatgtaataaacaccgagacagcgcccggcggaccatataaagtgggaacttccggtagctgccccaacgtagcaaacggcaacggatttttcaacaccatggcatgggtaatcccgaaagacaacaacaaaacagccatcaacccagtcacagtggaggtcccctacatatgcagcgaaggagaagaccaaattactgtgtgggggttccacagcgacgacaaaactcaaatggaacgcttatacggggactcgaacccgcaaaagttcacctcctcggccaatggcgtgactacccactacgtctcccaaatcggaggattccccaaccaaaccgaagacgaaggcctcaaacaaagcgggagaatagtcgtagactacatggtgcaaaagcccggaaaaacaggcacgatcgtataccaacgcggaatcctactcccccaaaaagtctggtgcgcatccggccgctcaaaagtaatcaaaggctccctcccactcataggcgaagccgattgcctccatgagaaatacggcggactcaacaagtcaaaaccatactacaccggagaacatgccaaggcaataggcaactgccccatctgggtcaagaccccgctcaaactcgcaaacggaaccaaatacagacccccagccaaactcctaaaagaacgtggattcttcggagcaatagcaggctttctcgaaggcggctgggaaggcatgatagcgggctggcacgggtacaccagccacggcgcccacggcgtcgcagtcgcggccgacctcaaaagcacacaagaagccatcaacaaaatcactaaaaatctaaactacctctcagagcttgaagtcaaaaacctccagagactctcaggcgccatgaacgaactacacgacgaaatacttgagctagacgaaaaagtagacgacctacgcgccgacaccatctcaagccaaatcgaactcgcagtactgctatccaacgaaggaataatcaacagtgaagacgagcacctcctagcactcgagcgaaagctaaagaaaatgctaggaccctctgcagtcgaaatcggcaacggctgcttcgagaccaaacacaaatgcaaccaaacatgcttagaccgaatcgccgctggaaccttcaacgctggcgacttctcactaccaaccttcgactccctaaacatcaccgcagccagcctcaacgacgatggcctcgacaaccacaccatcctcctatactacagcacagccgcctcatcgctcgcggtcacactcatgatagcaatctttatagtctacatggtatcaagagataacgtgtcctgctccatatgtctc

SEQ ID NO: 58997 - RNA, 1752 nt, synthetic construct
  misc_feature 1..1752: note = derived and/or modified sequence opt11 from anti-influenza_Chain
  source 1..1752: mol_type = other RNA
atgaaagccatcatcgtgctcctcatggtcgtcaccagcaacgccgaccgtatatgcacaggcataacctcaagcaactcaccgcacgtcgtcaaaaccgccactcagggagaagtcaacgtaacaggcgtaatacccctcacaaccacccccacaaaatcatacttcgccaacctaaaaggaaccaaaactagaggaaaattatgccctgactgcctcaactgcacagacctcgatgtagctctgggcagacccatgtgcgtgggaacaaccccaagcgcaaaagccagcatactacatgaagtccgaccagtaaccagcggatgcttccccataatgcatgaccgaacaaaaataagacaactagcaaacctactccgcggatacgaaaacatcagactcagcacacaaaacgtcatcgacgccgaaaaggcccccggaggaccctaccgcctaggcacgagcggctcctgccccaacgccacgtccaaaagcggattctttgccacaatggcatgggcagttccgaaagacaacaacaaaaacgccacaaacccactcacagtcgaagtaccctacatctgcacggaaggggaagaccaaataaccgtatggggattccactccgacgacaagacccaaatgaaaaacctatacggagactcaaacccacaaaaattcaccagctccgccaatggcgtaaccacacactatgtcagccaaatcggaggattccccgaccagaccgaggatggcggcctgccccaaagcggacgcatagtcgtggactacatgatgcaaaaacctggaaaaacgggcacaatcgtataccaacgcggggtcctgctaccgcaaaaagtctggtgcgcatcagggcgttccaaagtgatcaaaggctcactcccgctcatcggcgaggcagactgcctacacgagaaatacggcgggctcaacaaatccaaaccgtactatacaggagaacacgcaaaagccataggcaactgcccgatctgggtaaagacaccgctcaagctggcgaatggtaccaagtacaggcccccagccaagctactcaaagaacgcggattcttcggcgcgatcgccggcttcctcgaaggtgggtgggaaggaatgatcgccggctggcacggctacacatcccacggcgcccacggcgtagccgtcgccgccgacctcaaaagtacacaagaagccatcaataaaatcaccaaaaaccttaactccctgagcgaactcgaagtcaaaaacctacaacgcttatcaggcgccatggacgaactccacaacgaaatcctcgaactagacgaaaaggtagacgacctacgcgcagacaccatctcgagccaaatagaactcgctgtactcctatcgaacgaaggaataatcaactccgaagacgaacacctactcgcactagaacgcaagctcaagaaaatgctaggcccctcagccgttgacatcggcaacggctgcttcgaaaccaaacacaaatgcaaccaaacgtgcctggacaggatcgcagccggcaccttcaacgcaggcgagttctcgctcccgacattcgactcactcaacatcaccgccgcaagcctgaacgatgatggcctagataaccacaccattctcctctactactctacggcagccagctcactcgccgtaacgctaatgctcgccatcttcatagtctacatggtctcgcgagacaacgtatcctgctccatatgcctg

SEQ ID NO: 58998 - RNA, 1752 nt, synthetic construct
  misc_feature 1..1752: note = derived and/or modified sequence opt11 from anti-influenza_Chain
  source 1..1752: mol_type = other RNA
atgaaagcaataatcgtcctcctcatggtcgtcacctcaaacgccgacagaatttgcacggggataacttcgtccaacagtccccacgtcgtaaaaacagccacccaaggcgaagtcaacgtaaccggtgtcattcccctcacaaccacccccaccaaatcttacttcgccaaccttaaaggcacacgcacccgaggcaaactgtgcccggactgcctcaactgcacggacttagacgtcgctctcggaaggcccatgtgcgtcggcacgacacccagcgccaaagctagcatccttcacgaagtcaaaccagtaacaagcggatgcttccccatcatgcacgaccggacgaagatccgccaacttcccaacctcctccgcgggtacgaaaacatccgcctctccacacaaaacgtcatcgacgccgaaaaggccccgggaggaccctaccgccttggcacctcaggctcatgtcccaacgctacatccaaaagcggattcttcgccaccatggcatgggccgtccccaaagacaacaacaagaacgccacaaaccccctaaccgttgaagtcccatacatatgcacagaaggagaagaccaaataacagtctggggattccacagcgacgacaagacacaaatgaaaaacctctacggagactccaacccccaaaagttcacctcctcagccaacggcgtaacaacacactacgtatcacaaatcggatcattccccgaccaaaccgaagacggcggcctaccccaaagcggccgcatcgtcgtcgactacatgatgcaaaagcccggaaaaacgggcacaatcgtctaccaacgcggcgtactcctcccccaaaaggtctggtgcgcctccggccgctccaaagtcatcaaaggctcgctgccactaataggtgaagccgactgcctacacgaaaaatatggcggcctcaacaaatccaaaccatactacacaggcgaacacgcaaaagccatcggcaactgcccaatctgggtaaaaacaccactaaaactcgccaacggcacaaaataccgaccgcccgcaaagctactaaaagaacgcgggttcttcggcgcgatcgccggcttcctcgaaggcgggtgggaaggcatgatcgccggctggcacggctacaccagccacggtgcacacggcgtagcggtcgcagccgacctcaagtcaacccaagaagcaatcaataaaatcaccaaaaacctgaatagcctcagcgaactcgaagtcaaaaacctacaacgtctctccggcgccatggacgaactacacaacgaaatcctagaactcgatgagaaagtagacgatctacgagccgacacaatatcatcccaaatcgagctagcagtactcctctcgaacgaaggcataatcaacagcgaagatgaacacctcctagcactcgagcgcaaactcaagaaaatgctcggcccctctgcagtcgagatcggaaacggctgcttcgagaccaaacacaaatgtaaccaaacctgcctagaccgcatagccgccggcaccttcaacgcgggcgagttctcactacccacattcgactctctaaacatcaccgcagcctccctcaacgacgacggcctcgacaaccacaccatactcctctactactccaccgccgcctccagcctagccgtcacacttatgctagcgatcttcatcgtctacatggtctcaagagacaatgtatcatgctccatctgcctc

SEQ ID NO: 58999 - RNA, 1752 nt, synthetic construct
  misc_feature 1..1752: note = derived and/or modified sequence opt11 from anti-influenza_Chain
  source 1..1752: mol_type = other RNA
atgaaagctatcatcgtgctactcatggtggtcaccagcaacgcagatcggatatgcacaggcataacaagcagcaactcgccccacgtagtcaaaacagcaacccaaggagaagtcaacgtcacaggcgtcatcccactcacgaccacgcccacaaaatcccacttcgccaatctaaaaggcacccaaacgcgaggaaaactctgcccaaactgtttcaactgcacagacctggacgtagcccttggccgccccaaatgcatgggaaacaccccaagcgcaaaagtaagcatactccacgaagtaaaacccgcaacaagcgggtgcttcccaataatgcacgacaggaccaaaataaggcaactacccaatctcctacgcggctacgaaaacatacgcctatccacctccaacgtcataaacacagaaacagccccaggcggaccctacaaagtcggcacgagcgggagctgcccaaacgtcgccaacgggaacggattctttaacacaatggcgtgggtgatcccgaaagacaacaacaaaacagccataaacccggtcaccgtagaagtcccctacatctgctcagaaggagaagatcaaatcacagtgtggggcttccacagcgacgacaaaacccagatggaacgactatacggcgactcgaacccccaaaaattcaccagcagcgcaaacggcgtaaccacgcactacgtgtcgcaaataggcggattcccaaatcaaaccgaagacgagggcctcaaacagagcggccgcatagtcgtagattacatggtacaaaaacccggcaaaacaggcacaatcgtctaccaacgcgggattctcctcccccaaaaagtctggtgcgcatcaggacgatcgaaagtaatcaaaggctcactccccctcataggcgaggccgactgcctacacgaaaaatacggaggacttaacaaatccaaaccgtactacaccggggaacacgccaaagcaatcggcaactgccccatatgggtcaaaacaccgctcaaacttgcaaatggcaccaaataccgcccaccggccaaacttctgaaagaacgaggctttttcggcgcaatcgcaggcttcctcgaaggtggctgggagggaatgatcgcgggctggcacggatacacgtcccatggcgcacatggagtagcagtcgcggccgacctcaagagcacacaagaagccataaacaaaatcaccaaaaaccttaactacctcagcgaactcgaagtcaaaaacctccaaaggctctcaggagcgatgaacgaactgcacgacgaaatactcgaactcgacgaaaaagttgacgacctaagagccgacacaatatcaagccaaatcgagctcgctgtcttactatccaacgaaggcataatcaactcagaagacgagcatctgctagcgctcgaacgcaagctcaagaaaatgctcggaccatccgcagtagaaataggcaacggatgcttcgaaacaaaacacaaatgcaatcaaacctgccttgacaggatcgcagccggaaccttcaacgccggagacttctcactacccaccttcgactcacttaacataaccgccgccagcctcaacgacgacgggctcgacaaccacactattctcctatactactcaacagccgctagctcactcgcggtcacactgatgatcgccatcttcatcgtctacatggtctctagagacaacgtgagctgtagcatctgcctc

SEQ ID NO: 59000 - RNA, 1752 nt, synthetic construct
  misc_feature 1..1752: note = derived and/or modified sequence opt11 from anti-influenza_Chain
  source 1..1752: mol_type = other RNA
atgaaggcaataatcgtgttactgatggtagtcacaagcaatgcagaccgcatatgcaccggcataacatcctcaaatagcccgcacgtcgtaaaaaccgcaacacaaggcgaagtaaacgtaaccggcgtcatccccctaacgaccaccccaaccaaatcatacttcgccaacctcaaaggcacaaaaacacgcggcaagctatgccccgactgcctcaactgcacagacctcgacgtagccctgggccggccaatgtgcgtgggcacaaccccaagcgcgaaggcttccatactccacgaagtacgaccagtcacatccgggtgcttccccataatgcacgaccgcaccaaaataagacaactcgccaatctcttacgcggctacgaaaacatacgacttagcactcaaaacgtcatcgacgcggaaaaggcacccggcggaccctatcggttaggcaccagcggctcatgccccaatgcaaccagcaagtccggtttcttcgccacaatggcatgggccgtacccaaagacaacaacaaaaacgccacgaacccactcaccgtagaagtcccctacatatgcacagaaggggaagaccaaataacagtatggggattccatagcgacgacaaaacacagatgaagaacctgtacggagactcaaacccccaaaagttcacaagctcagccaacggcgtgaccacccactacgtctcacagataggaggattcccagaccaaaccgaagacgggggcctcccacaatccggacgcatcgtagtagactacatgatgcaaaaaccaggaaaaacaggcacaatcgtctaccagcgcggagtcctgctcccacaaaaagtatggtgcgccagcggccgatcgaaagtcatcaaaggctcgctaccactaataggagaagcagactgcctacacgaaaaatacggcggtctcaacaaatccaaaccatactacaccggagaacacgccaaagccataggcaactgcccgatatgggtcaaaacaccactcaaactcgccaacggaaccaaatacagacccccagcaaaactactaaaagaacgcgggttcttcggagcgatcgccggcttccttgagggcggatgggaaggcatgattgcaggctggcacgggtacacctcccacggcgcccatggcgtcgcagtcgcagctgacctaaaatccacgcaagaggccatcaacaaaattaccaaaaaccttaactccctatcagaactagaagtcaaaaacctccaaagactcagcggcgcgatggacgaactacacaacgaaatcctcgagctcgatgaaaaggtagacgacctacgtgcggacacaatctcatcccagatagagctcgccgtactactatccaacgaaggcatcattaatagcgaagacgaacatctgctcgccctcgaacgaaaactcaagaaaatgctcggaccctccgccgtggacatcggcaacggctgcttcgaaacaaagcacaaatgtaaccaaacatgcctagaccgcatcgccgccggaaccttcaatgccggtgagttctcactcccgacattcgactcactcaacataaccgcagcctcactaaacgacgacggcctcgataaccacaccatcctactgtactatagcacagccgcatcatccctcgcagtcacgcttatgctcgcaatctttatagtatacatggtctcacgcgacaacgtaagctgcagtatctgccta

SEQ ID NO: 59001 - RNA, 1752 nt, synthetic construct
  misc_feature 1..1752: note = derived and/or modified sequence opt11 from anti-influenza_Chain
  source 1..1752: mol_type = other RNA
atgaaggccatcattgtcctcctcatggtagtcacatccaacgcagaccgcatatgcacaggcatcacctcttccaactccccacacgtggtcaaaaccgcaacccaaggagaagtcaacgtcacaggcgtaatccccctcacgaccacacccacgaaatcctacttcgccaacctcaaaggtacacgcacacgcggaaagctctgcccagactgcctaaactgcacggacctcgacgtggccctcggtagacccatgtgcgtgggaaccacaccctccgccaaagccagcatactccacgaagtcaaacccgtaacatccggctgcttccccataatgcacgaccgaaccaaaataagacaactgcccaacctactcagaggatacgaaaacatccgcctaagcacacaaaatgtaatagatgccgaaaaagcccccggcggcccctaccgcctgggaactagcggatcttgtcccaacgccacaagcaaaagcgggttcttcgccacaatggcatgggcagtccccaaagacaacaacaaaaacgcaacgaacccactaacagtagaggtcccatacatctgcacagaaggggaagaccaaatcaccgtatggggcttccactcagacgacaagactcaaatgaagaacctgtacggagactcaaacccacaaaaattcacatcctccgccaacggagtaaccacccactacgtatcccaaataggatcattcccggaccagaccgaagacggaggtctcccccaatcaggcagaatagtcgtagactacatgatgcaaaagcccggaaaaaccggtacaatcgtataccagcgtggagtcctattaccacaaaaagtctggtgcgccagcggaagatccaaggtaatcaaaggctcactcccgctgataggcgaagccgactgcctacacgagaaatacggcggcctcaataaatcaaaaccctactacacaggagaacacgcaaaggccataggcaactgccccatctgggtcaaaactcctctaaaactcgccaacggcacaaaatacaggcccccagccaaactactaaaagaacgcggattcttcggcgcaatcgcaggcttcctcgaaggaggctgggagggaatgatcgccgggtggcacggctatacaagccatggagcccacggagtcgccgtcgccgccgacctaaaatccacacaagaagccataaacaaaatcaccaaaaacctcaactcactaagcgagctggaggtcaaaaacctacaacgactctccggagcaatggacgaactacacaatgaaatccttgaactcgacgaaaaagtcgacgaccttcgagccgacaccatctcctcacaaatcgaactagcagtattactctccaacgagggcatcatcaacagcgaagacgaacaccttctcgcactcgaacgcaaactaaagaaaatgctcggaccatcagcagtagaaatcggcaacggctgcttcgaaaccaagcacaaatgcaatcaaacctgcctagaccgcatcgcggccgggacattcaacgcaggcgaattttcgctcccaacattcgactcgctcaacataacagccgcttctttaaacgacgacggtctcgacaaccacaccatactactgtactacagcacggccgccagctccctcgccgtcacgctcatgctcgcgatcttcatcgtctacatggtctcccgcgacaacgtaagctgcagcatatgccta

SEQ ID NO: 59002 - RNA, 1758 nt, synthetic construct
  misc_feature 1..1758: note = derived and/or modified sequence opt11 from anti-influenza_Chain
  source 1..1758: mol_type = other RNA
atgaaagcaataatcgtactactcatggtcgtaacatcaaatgcagaccgcataatatgcaccggaatcacaagctcgaacagtccccacgtcgtaaaaacagccacccaaggcgaagtcaacgtaacaggggtaatcccgctcacaaccacaccaacaaaaagccacttcgcaaacctaaaaggaaccgaaacccgtggaaaactatgtccaaaatgcttaaactgcaccgacctcgatgtcgcactcggccgcccaaaatgcacaggcaacatcccatccgcacgcgtcagcatcctccacgaagtccggcccgtcacctcaggctgctttcccatcatgcacgaccgtaccaaaatccgccaactccccaacctactacgcggatatgaacacattcgcctttcaactcacaacgtcatcaacgcagaaaacgcccccggaggaccatacaaaataggcacctccgggtcgtgcccaaacgtcacaaacggaaacggattcttcgccaccatggcgtgggccgtgcccaaaaacgacaacaacaaaacagccaccaactccctcaccatagaagtaccctacatctgcacagaaggcgaagaccaaataacagtctggggcttccacagcgacaatgaaacacagatggcaaagctctacggcgactccaaaccccaaaagttcaccagctcagccaacggcgtcacaacccactacgtatcccaaatcggcggcttcccaaaccaaaccgaagacggcggtctgccacaatccggccggatagtagtagattatatggtacaaaaatccggcaaaacaggcacaatcacctaccaacgaggcatcctcctaccccaaaaagtctggtgcgcctcagggagaagcaaagtcatcaaaggctcactccctctaataggcgaggccgactgcctccacgaaaaatacggcggactcaacaaaagcaaaccatactacaccggcgaacacgccaaagcaataggcaactgtccaatctgggtcaaaacacccctcaaactcgcaaacgggaccaaataccgacccccagctaaactcctaaaagaacgtggatttttcggcgccatagccggcttcctcgaaggcggatgggaaggcatgatcgcgggctggcacgggtacacatcccatggagcgcacggtgtcgcggtcgccgcagacctcaaaagcacccaagaagcaatcaacaaaatcaccaaaaacctcaactccctatccgaactcgaagtcaaaaacctccagagactcagcggcgcgatggacgaactacataacgaaatactcgaacttgacgagaaagtagacgacctacgcgccgacacaatctcatcccaaatcgaactcgccgtcctcctatctaacgaaggcatcatcaactctgaagacgaacacctcctagccctcgaacgcaaactaaagaaaatgctcggccccagcgccgtcgaaatcggcaatggctgcttcgaaaccaaacacaaatgcaatcaaacctgcctcgaccgaatagcagccgggaccttcgacgccggcgagttctccctaccaacattcgactcactcaacataaccgccgcctcactaaacgacgacggacttgacaaccacaccatcctcctctactattcaactgcagcctcctcactagccgtcaccctaatgatcgccatctttgtagtatacatggtctcacgcgacaacgtgagctgcagcatatgctta

SEQ ID NO: 59003 - RNA, 1758 nt, synthetic construct
  misc_feature 1..1758: note = derived and/or modified sequence opt11 from anti-influenza_Chain
  source 1..1758: mol_type = other RNA
atgaaagcaataatcgtcctcctaatggtagtcacaagcaacgcggacagaatcatatgcacaggcatcacaagctccaactccccacacgtcgtaaaaaccgcaacccaaggcgaagtcaacgtcaccggagtcatccccctaaccacgaccccaaccaaatcccacttcgccaacttgaaaggcaccgagacccgcggcaaactctgccccaaatgcctcaactgcaccgacctcgatgtagccctcggacgcccgaaatgcactggaaacataccctcagcccgagtatcgatattacacgaagtcagacccgtcacatccggctgcttcccaataatgcacgaccgtacaaagatccgccaacttcccaacctacttagaggatacgaacacatacgactttcaactcacaacgtaatcaacgcagagaacgcacccggcggcccgtacaaaatcggcacctcgggatcatgccccaatgtcaccaacggcaacggcttctttgcaacaatggcctgggccgtacctaaaaacgacaacaacaaaaccgccaccaactcgctcacaattgaggtcccctacatatgcacagaaggcgaggaccaaatcaccgtctggggcttccactcagacaacgaaacccaaatggcgaaactctacggagactcaaaaccccaaaaattcacaagctcggcaaacggcgtaaccacccactacgtatcccaaataggcggattcccgaaccaaaccgaagacggaggactaccacagagcggacgaatcgtagtcgactatatggtacagaaaagcggcaagaccggaacaatcacataccaacgaggcatcttactcccccaaaaagtctggtgcgcatccggccgctccaaagtcatcaagggctcactgcctctcataggcgaagcagattgcctacacgagaaatatggcggcctcaacaaatccaaaccgtactacaccggggaacacgccaaagcaatcggcaactgccccatctgggttaaaaccccgcttaagttagcaaacggaaccaaatacagacccccggccaaactactgaaagaacgcggattcttcggagcaatcgccggcttcctcgagggcggttgggaaggcatgatcgccggctggcacggatacacgagccacggcgcacacggcgtcgcggtcgcagctgacctcaagagcacccaagaagcaatcaacaagatcaccaaaaaccttaacagcctttccgagcttgaagtcaaaaacctccaacgcttatcaggcgcaatggacgaactacacaacgaaattctagaactagacgaaaaggtcgacgacctacgcgccgacaccatttcatcacaaatcgaactcgcagtactcctctccaacgaaggaatcatcaacagcgaagacgaacacctcctcgcactcgaacgcaaactcaagaaaatgctcggaccctccgcagtagaaatcggtaacggctgcttcgaaaccaaacacaaatgcaaccaaacatgtctcgacagaatcgcggccggcaccttcgacgccggcgagttctcactacccaccttcgactccctcaacatcactgccgccagcctaaacgacgacggtctcgacaatcacaccatactcctctactactcaacagccgcctcatcactagccgtcaccctcatgatcgccatattcgtcgtctacatggtctcccgcgacaacgtctcctgcagcatctgcctc

SEQ ID NO: 59004 - RNA, 1749 nt, synthetic construct
  misc_feature 1..1749: note = derived and/or modified sequence opt11 from anti-influenza_Chain
  source 1..1749: mol_type = other RNA
atggaagcacgcttactcgtattattgtgcgcattcgcggccacaaacgcggacaccatctgtatcgggtaccacgcaaacaactcaaccgacaccgtcgacaccgtcctggaaaagaacgtaacagtcactcacagcgttaacctactcgaagactcccacaatggcaagctctgcaaactcaaaggaatcgcgccactccaactaggaaaatgcaatatcgcaggatggctcctaggcaaccccgaatgcgacctccttctcaccgcctcctcctggagctatatcgtagaaaccagcaactccgaaaacggtacctgctaccccggagacttcatagactacgaagaactccgagaacagctctcaagcgtaagctccttcgaaaaattcgaaatattcccgaaaaccagctcatggcccaaccacgaaacgacaaagggcgtgaccgcagcctgcagctacgcaggggcaagcagcttctacaggaacctgctctggctcaccaagaaaggctccagctatcccaaactctcaaaatcatacgtaaacaacaaaggcaaagaagttctagtactatggggcgtccaccacccacccacaggcacagaccaacaaagcctctaccaaaacgccgacgcctacgtctcagtaggctcatcaaaatataaccgccgtttcacccccgaaatagcagccagacccaaggtccgcgaccaagcaggaaggatgaactactactggacactgctagaaccaggcgacaccatcacattcgaagcgaccggcaatttaatcgcgccatggtacgcattcgccctcaaccgcgggagcggaagcggaatcataacctcagacgcccccgtacacgactgcaacaccaagtgccaaactccacacggcgcaatcaactcctcactccccttccaaaacatccaccccgtaacaataggagaatgccccaaatacgtaaggagcacaaaactgcgaatggccaccggcctacgcaacatcccaagcatccaatcacgcgggctattcggcgcaatcgcaggcttcatcgaaggcggatggactggaatgatcgacggatggtacgggtaccaccaccaaaacgaacaaggcagcgggtacgccgctgaccaaaaatcaacacaaaacgctatagacgggatcacaaacaaggtaaacagcgtaatcgagaaaatgaacacccaattcaccgcagtagggaaagagttcaacaacctcgaacgacgcatagaaaaccttaacaagaaagtcgacgacgggtttctagacatctggacctacaatgccgaactcctagtcctactcgaaaacgaacgcacactcgacttccacgactcgaacgtccgcaacctatatgaaaaagtcaaaagccaactcaaaaacaacgccaaagaaataggcaacggctgctttgagttctaccacaaatgcgatgacgcgtgcatggaatcagtcagaaacggtacctacgactaccccaaatactcagaagaatccaaactaaatagagaagaaatagacggcgttaaactagaaagcatgggcgtctatcaatccggacgcctagtccccagaggatccccgggatcgggatatatcccagaagcaccccgcgacggacaagcatacgtccgaaaagacggagaatgggtcctcctctccactttcctcggaaaaccgatcccgaacccactcctcggcctggactccaccggg

SEQ ID NO: 59005 - RNA, 1749 nt, synthetic construct
  misc_feature 1..1749: note = derived and/or modified sequence opt11 from anti-influenza_Chain
  source 1..1749: mol_type = other RNA
atggaagcccgcctactggtcctcctatgtgcattcgccgctaccaacgccgacacaatctgcataggataccacgccaacaactccacagacaccgtcgacaccgtcctcgagaaaaacgtgactgtcacccactccgtgaacctgttagaagacagccataacggaaaactatgcaaactgaaaggaatagcgcccctacaactaggaaaatgtaacatagcgggatggctactgggcaacccggaatgcgacctcctactcaccgcttcaagctggagctacatcgtcgaaacatcaaactcagaaaacggaacgtgctaccccggcgactttatcgactatgaagaactacgagaacaactatccagcgtgtcctcattcgaaaagttcgaaatattccctaaaacgagcagctggccgaaccacgaaacgaccaaaggcgtcaccgcagcctgcagctacgcaggcgcctctagcttctaccgcaatctactatggctcaccaagaagggctcatcataccccaaactctcaaaatcctacgtaaacaacaaaggaaaagaagtactcgtcctctggggagtacatcacccacccacaggaacggatcaacaatccctctaccaaaacgccgacgcgtacgtatccgtcggctccagcaaatataaccgccgcttcacccccgaaatcgcagcacgtccaaaagtgcgagaccaagccggccgaatgaactactactggaccctcctcgagccaggagacaccataacattcgaagcaacaggcaacctaatcgcaccatggtacgccttcgctctaaaccgcggaagcgggtcaggaatcatcacatctgacgcacccgtgcacgactgtaacaccaaatgccaaaccccacacggagccatcaactcgagcctcccattccaaaacatacaccccgtcaccataggcgaatgcccgaaatacgtccgatccacgaaactccgtatggcaacaggactaagaaacatccctagcatccaaagccgcggcctcttcggggcaatcgcagggttcatcgagggaggctggacaggcatgatcgacggctggtacggctaccaccaccaaaacgaacaaggctccgggtacgccgccgaccaaaagagcacccaaaacgccatcgacggcatcacgaacaaagtcaacagtgtcatcgagaaaatgaacacccaattcaccgcagtcggcaaagagttcaataacctcgaacgccgcatcgaaaacctcaacaagaaagtcgatgacggcttcctcgacatatggacatacaacgccgaactcctagttctactcgaaaacgaacgaaccctagacttccacgactcaaacgtccgaaacctctacgaaaaagtcaaaagccaactcaaaaacaacgcaaaagaaatcggcaacggatgcttcgagttctaccacaaatgcgacgacgcatgtatggaatccgttcgcaacggaacctacgactacccaaaatactccgaagaaagcaaactcaaccgcgaagaaatcgacggcgtgaaactagaaagcatgggcgtataccaaagcggccgcctcgtcccaagaggcagcccaggatcaggttacatcccagaagcccccagggacggccaagcctacgtgcgaaaggacggagaatgggtcctcctatcaacatttctaggaaaaccaatccccaaccctctactgggcctcgattcaaccggc

SEQ ID NO: 59006 - RNA, 1755 nt, synthetic construct
  misc_feature 1..1755: note = derived and/or modified sequence opt11 from anti-influenza_Chain
  source 1..1755: mol_type = other RNA
atggagagaaccgtcctactcctcgccacggtatccctcgtcaaatcagaccaaatctgcatcggctaccacgcgaacaactctacagaacaagtcgacacaattatggagaaaaacgtaaccgtcacccacgcccaagacattctcgaacgaacccacaacggcaaactctgcgacctcaacggagtcaaacccttaatcctccgcgactgctccgtcgccggctggctcctcggaaaccccatgtgcgacgagttcatcaacgtccccgaatggagttatatagtcgaaaaagcaagccccgcaaacgacctctgctaccccggcaatttcaacgactacgaagaactaaaacacctcctcagcaggatcaaccacttcgagaaaatacaaataatcccaaaatcatcatggagcaaccacgacgcgagctcaggagtctcaagcgcatgtccctacctaggcagatcatcctttttccgcaacgtcgtctggctcatcaagaaaaacagcgcctaccccaccatcaaacgatcctacaacaacaccaaccaagaagacctgctagtcctctggggcgtgcaccacccaaacgacgccgcagaacaaactaaactctaccagaacccaacgacatatatctcagtcggcaccagcacactcaaccaacgcctcgtccccgaaatagccacccgacccaaagtcaacggccaaagcggcagaatggaatttttctggaccatactcaaaccaaacgatgcgatcaacttcgaatccaacggtaacttcatcgccccagaatacgcctacaaaatagtcaagaaaggtgactcaaccatcatgaaatccgaactcgaatacggcaactgcaacaccaaatgccagacccccatgggcgccattaactcttccatgccattccacaacatacaccccctcaccataggcgaatgccccaaatacgtaaaaagcaaccgacttgtcctagccaccggcctcagaaacacccctcaacgcgaacgccgccgcaagaaacgcggccttttcggagcaatagccggattcatcgaagggggatggcaaggaatggtagacggctggtacggataccaccactccaacgaacaaggctcatgctactccgcagacaaagaatccactcaaaaagcaatcgacggtgtgaccaacaaagtcaattccatcataaacaaaatgaacacacaatttgaagccgtgggcagagagttcaacaacctagaaagacgaatcgaaaacctcaacaagaaaatggaagacggcttccttgacgtctggacctacaacgccgaactgctagtcctcatggaaaacgaacgcacactagacttccacgactccaacgtcaaaaacctctacgacaaagtccgcctccaactgagagacaacgcaaaagaactcggaaatggctgctttgagttctaccacaaatgcgacaatgaatgtatggaaagcgtcaaaaacggcacttacgactacccccaatactccgaagaagccaggcttaaccgcgaagaaataagtggagtcaaactcgaatccatgggcacgtaccaatccggccgcctcgtaccccggggctcacccggctcgggatacatccccgaagcaccacgcgacggccaagcctacgtccgcaaagacggcgaatgggtactactctcgacgttcctaggaaaacccatccccaaccccctcttaggactcgactccaccggc

SEQ ID NO: 59007 - RNA, 1755 nt, synthetic construct
  misc_feature 1..1755: note = derived and/or modified sequence opt11 from anti-influenza_Chain
  source 1..1755: mol_type = other RNA
atggaacgcacggtgctcctcctagcgaccgtatccttagtaaaatccgaccaaatctgcataggatatcacgccaacaactcaacagaacaggtcgataccataatggaaaaaaacgtcaccgtcacacacgcccaagacatcctggaaagaacccacaatggaaaactctgcgacctcaacggggtcaaaccactcatcctccgtgactgtagcgtcgccggctggctactcggcaaccccatgtgcgacgaattcataaacgtccccgaatggtcctacatagtagaaaaagcctcgcccgccaacgacctctgctaccctgggaacttcaacgactacgaagaactgaagcacctcctctccagaatcaaccacttcgaaaaaatccaaatcataccaaaatcctcctggtccaaccacgacgcatccagcggagtcagctccgcctgcccctacctcggaagaagctcattcttccgaaatgtcgtatggttaataaaaaaaaactccgcctaccccacaatcaaacgcagctacaacaacaccaaccaagaagacctactcgtcctctggggcgtacaccaccccaacgacgcagccgaacaaacaaaactataccaaaacccaaccacctacatctcagtaggcacctcaactctcaaccaaagacttgtccccgaaatcgccacccgccccaaagtaaacggccaatctggccgcatggaattcttctggaccatcctcaaacccaacgatgccatcaacttcgagtccaacggaaacttcatagctcccgaatacgcctacaagatagtaaaaaaaggcgactccacaatcatgaaatccgaattggaatacggcaactgcaacacaaaatgccaaaccccgatgggagccatcaacagctccatgccattccataacatacaccccctaaccataggcgaatgccccaaatacgtcaagagcaaccgcctcgtgctggccaccggtctccgaaacaccccccaacgcgaacgccgcagaaaaaaacgcggactgttcggagccatcgccggtttcatcgaaggcggatggcagggaatggtcgacggatggtacggctaccaccactctaacgaacaaggctcctgctactccgccgacaaagagtcaacacaaaaagccattgacggagtaaccaacaaagtcaactccatcatcaacaaaatgaatactcaatttgaagcagtaggacgtgaattcaacaacctagaacgcagaatcgaaaacctcaacaaaaaaatggaagacggcttcctagacgtatggacatacaacgcagaactactcgtcctgatggaaaacgaacgtacactcgacttccacgactccaacgtcaaaaatctctacgacaaagtccgactacagctacgcgacaacgctaaagaactaggcaatggctgcttcgaattctaccacaaatgtgacaacgaatgcatggaatccgtcaaaaatggcacctacgactacccccaatactctgaagaagctagactcaacagagaagaaatctccggcgtaaaactcgaatccatgggcacataccaaagcggccgactagttccccgcggcagccccggcagcggatacatccccgaagcaccaagagacggacaagcctacgtccgcaaagacggcgaatgggtactactcagcaccttcctcggaaaaccaatccccaacccactactcggattagactccacagga

SEQ ID NO: 59008 - RNA, 1947 nt, synthetic construct
  misc_feature 1..1947: note = derived and/or modified sequence opt11 from anti-influenza_Chain
  source 1..1947: mol_type = other RNA
atgggcgacaaaatcaacttcatcttcggcatacacaatcaccagcccctcggcaacttcggctgggtcttcgaagaagcatacgagaaatgctactggcccttcctagaaaccctcgaagaatatccaaacatgaaagtcgcaatccacacctccggacccctgatcgagtggctacaagacaaccgacccgagtacatcgacctcctacgtagcctcgtaaaacgcggccaagtcgaaatagtcgtcgccggcttctacgaaccagtcctagcgtcaatcccgaaagaggaccggatcgaacaaatccgactgatgaaagaatgggccaaaagcataggtttcgacgcgcgaggagtctggcttacagaacgcgtttggcaaccagagctagtcaaaaccctaaaagaatccggaatagactacgtcatcgtcgacgactaccacttcatgtcagccggactaagtaaagaagaactatactggccctactacaccgaagacggaggagaagtgatcgccgtcttcccaatagacgaaaaactccgatacctaatccccttcaggccagtagacaaagtcctcgaatacctacactcactcatcgacggagacgaaagcaaagtagccgtttttcacgacgacggagaaaaattcgggatctggcccggcacatacgaatgggtctacgaaaaaggctggctacgagagttcttcgacaggatatcgtccgacgaaaagatcaacctgatgctctacacagaatacctggaaaaatacaaaccccgcgggctagtctacctcccaatcgcaagctacttcgaaatgagcgaatggagcctccccgccaaacaagcccgactattcgtcgagttcgtcaacgaactcaaagtaaaaggcatcttcgaaaaataccgcgtgttcgtgcgcgggggcatatggaagaacttcttctacaaataccccgaaagcaactacatgcacaaacgcatgctgatggtctccaagctagtccgcaacaaccccgaagcacgcaaatacctactccgagcacagtgtaacgacgcctactggcacggactcttcggcggcgtatacctcccccacctacgacgagccatctggaacaatctcatcaaagcgaactcctacgtctcgctaggcaaagtaatccgcgacatagactacgacggattcgaagaagtccttatcgagaacgacaacttctacgcggtcttcaaaccaagctacggaggcagcctagtagagttcagcagcaagaaccgcctagtaaactacgtcgacgtcctcgcacgacgctgggagcactaccacggctacgtggagtcccaattcgacggagtggcctcaatacacgaactcgagaaaaagatccccgacgaaatacgcaaggaagtagcatacgacaaataccgacgcttcatgctccaagaccacgtcgtaccgctcggaaccacactagaagacttcatgttcagtcgtcaacaagaaatcggagagttcccacgtgtaccctacagctacgaactcctcgacggcggcatccgcctgaaacgcgaacacctaggaatcgaagtagaaaagacagtcaaactcgtcaacgacggattcgaagtagaatacatagtaaacaacaagaccgggaaccccgtcttattcgcagtagagctgaacgtagccgtccagtccataatggagagccccggcgtgctccgcggcaaggaaatagtcgtagacgacaaatacgcggtcggaaaattcgcactaaaattcgaggacgaaatggaggtatggaaataccccgtcaagaccctctcgcaatcagaaagcggctgggacctgatccagcaaggcgtctcctatatagtcccaataagactagaagacaagatccgcttcaaactgaagttcgaagaagccagcggg

SEQ ID NO: 59009 - RNA, 1947 nt, synthetic construct
  misc_feature 1..1947: note = derived and/or modified sequence opt11 from anti-influenza_Chain
  source 1..1947: mol_type = other RNA
atgtcccgcatgaccctgaaaagctccatgaaaaagcgggtgctatccctcctaatcgcagtcgtcttcctctcgttaaccggcgtattcccgtcaggactcatcgaaacaaaggtctccgccgccaaaatcacagaaaactaccaattcgactcacgcatccgcctgaacagcataggcttcatccccaaccactcaaagaaagccaccatcgccgctaactgctccaccttttacgtagtaaaagaagacggaacaatcgtctacacaggaaccgcaacatcaatgttcgacaacgacacgaaagaaaccgtctacatagccgacttctcctccgtcaacgaagaaggcacatactacctcgcagtacccggagtcggaaaatccgttaacttcaaaatcgccatgaacgtatacgaagacgcattcaaaactgccatgctagggatgtacttactacgatgtggcacatccgtctctgccacctacaacggcatccactactcccacggcccgtgccacaccaacgacgcctacctcgactacataaacggccagcataccaaaaaggactcaacaaaaggctggcacgacgccggcgactacaacaaatacgtcgtcaacgcggggatcaccgtcggatccatgttcctagcatgggaacacttcaaagaccaacttgaaccagtcgccctcgaaatccccgagaaaaacaactccatccccgacttcctcgacgaactaaaatacgaaatcgactggatcctcaccatgcaataccccgacggctcgggccgggtcgctcacaaagtctccacccgcaacttcggcggattcatcatgccagaaaacgaacacgacgagcgcttcttcgtcccctggtcatcagccgccaccgccgacttcgtagccatgaccgccatggccgcccgcatattccgcccctacgaccctcagtacgcagaaaaatgcatcaacgccgccaaggtctcatatgagttcctcaaaaacaaccccgccaacgtcttcgccaaccaaagcggcttcagcaccggggaatacgcaaccgtcagcgacgcagacgaccgactatgggccgcagccgaaatgtgggaaactctaggcgacgaagagtacctccgggacttcgaaaacagagccgcccaattctccaagaaaatagaagcagacttcgactgggacaacgtagcaaacctaggcatgttcacatacctcctatccgaacgtccaggcaaaaaccccgccctagtccaaagcatcaaagacagcctcctctccaccgcagactccatcgtacgtacaagccaaaaccacggttacggccgaactctaggtaccacatactactggggctgcaacggcactgtcgtgcgccaaacaatgatcctacaagtcgcaaacaaaatctcacctaataacgattacgtaaacgcagccctagacgccatatcacacgtcttcggacgaaactactacaacagatcatacgtaaccggcctaggcatcaaccctcccatgaacccccacgacagacgttcaggcgccgacggtatctgggaaccatggcccgggtacctagtcggcggcggctggccaggacccaaagactgggtcgacatccaagactcctaccagaccaacgaaatcgcaatcaactggaacgcggcactcatctacgccctcgcaggattcgttaactataactcaccacaaaacgaggtcctatatggagacgttaacgacgacggaaaagtcaactcaactgacctcacactactaaagcgctacgtactcaaagccgtaagcaccctaccctcatcaaaagcagagaaaaatgccgacgtcaaccgcgacggccgcgtaaactcctccgacgttacaatcctctcccgctacctgatccgagtaatcgaaaagctccctatc

SEQ ID NO: 59010 - RNA, 1947 nt, synthetic construct
  misc_feature 1..1947: note = derived and/or modified sequence opt11 from anti-influenza_Chain
  source 1..1947: mol_type = other RNA
atgggagacaaaatcaacttcatcttcggcatccacaaccaccaaccgctgggcaacttcggctgggtattcgaggaagcctacgagaagtgctactggcccttcctcgagaccctcgaagagtacccaaacatgaaggtagccatccacaccagcggcccactaatcgaatggctacaagacaacagaccagaatacatagacctattacgcagcctagtcaaacgaggacaagtcgagatagtagtagccggcttctacgaaccggtactagcatccatccccaaggaggacagaatcgaacaaatacgcctcatgaaggagtgggccaaatcaataggattcgacgcacgaggggtatggctcacggaaagagtctggcaacccgagctagtcaaaaccctaaaagaatccggaatagactacgtgatcgtggacgactatcacttcatgagcgcaggtctctcaaaagaagaactctactggccatactacacagaagacggcggcgaagtgatcgcggtcttccccatagacgaaaaactcagatacctcataccattccgccccgtcgacaaagtcctggaatacctccactccctaatcgacggcgacgaatcaaaagtagccgtcttccacgacgacggggaaaagttcggcatatggccaggaacctacgaatgggtctacgaaaaaggctggttacgggagttcttcgaccgaataagctcagacgagaaaatcaacctcatgctatacaccgaataccttgaaaaatacaagccacggggtctagtgtatctacccatcgcgagttacttcgaaatgtcagaatggagcctgccagccaagcaagcccgactattcgtcgagttcgtcaacgaactaaaagtaaaaggaatattcgaaaagtaccgagtgttcgtccgaggaggaatatggaagaacttcttctacaaatacccagaatcgaactacatgcacaaacgcatgctcatggtaagcaagctagtccgcaacaacccagaggcaagaaaatacctgctacgcgcccagtgcaacgacgcctactggcacggcctattcggaggagtatacctcccacacctaagacgagcaatatggaacaacctcatcaaagcaaactcctacgtcagcctgggaaaagtcatacgagacatagactacgacggcttcgaagaagtcctcatagaaaacgacaatttctacgccgtgttcaagccatcctacggcggaagcctagtcgaattttcatccaagaacagactggtaaactacgtcgacgtgctagcaaggaggtgggaacattaccacgggtacgtagagagccaattcgacggggtcgccagtatacacgagctagaaaagaagataccagacgaaatccgaaaagaggtagcatacgacaaatacagacgcttcatgctgcaagaccacgtcgtccccttaggaaccacgctcgaagacttcatgttctcaagacaacaagagatcggagagttcccacgcgtaccctacagctacgaactactggatggaggcatcagactcaaacgcgaacacctaggaatcgaagtcgagaaaaccgtaaaactggtaaacgacggcttcgaagtcgaatacatcgtaaacaacaaaacaggaaatcccgtactcttcgcagtagaactaaacgtcgccgtccaaagcatcatggaaagccccggagtcctacgaggcaaagaaatagtcgtagacgacaagtacgcagtcggcaaattcgccctcaaatttgaagacgaaatggaagtgtggaaataccccgtcaaaaccctaagccaatccgaaagcggatgggacctgatacaacagggagtcagctacatcgtacccatccgcctcgaagacaaaatcaggttcaagttaaaattcgaggaagccagcggg

SEQ ID NO: 59011 - RNA, 1947 nt, synthetic construct
  misc_feature 1..1947: note = derived and/or modified sequence opt11 from anti-influenza_Chain
  source 1..1947: mol_type = other RNA
atgtccaggatgacccttaaatcatccatgaagaaacgggtactctccctcctgatcgcagttgtcttcctgtcactcacaggcgtattcccctcaggtctgattgaaaccaaagtctcagcagccaaaataactgaaaactaccaattcgacagccgtatccgcctaaactcaatcggattcatccccaaccactcaaagaaagccacgatcgccgccaactgctccacattctacgttgtcaaagaagatggaaccatcgtctacacaggaacggccacctccatgttcgacaatgacacaaaagaaaccgtttacatcgcggacttttcatccgtaaacgaagaaggcacatactacctcgccgtccccggcgtcggcaaatccgttaactttaaaatagccatgaacgtctacgaagacgccttcaaaaccgccatgctcggaatgtatctcctccgctgcggaacctcagtctcagccacgtacaacggtatccactactcacacggcccatgccacacaaatgacgcctacctcgactacatcaatggccaacacaccaagaaagacagcacaaaaggctggcacgacgccggcgattacaacaaatacgttgtcaatgccggaatcaccgtcggctcaatgttcctcgcatgggaacacttcaaagaccaactcgaacccgtggccctggaaataccggagaaaaacaacagcatacccgacttcctcgatgaactcaaatacgaaatcgactggatacttaccatgcaataccccgatggctcaggccgggtcgcccacaaagtctcgacacgcaacttcggcggattcatcatgcccgaaaacgaacacgacgaacgattcttcgtcccctggagctctgcagcaaccgccgatttcgtcgccatgaccgccatggcagcccgaatcttcagaccatatgacccccaatacgccgaaaaatgcatcaacgccgccaaagtctcatacgagttcctcaaaaacaaccccgccaacgtattcgcaaaccagtccggcttctccacaggcgaatacgcaaccgtctccgacgccgacgaccgcctctgggcagcagcagaaatgtgggagacactaggcgacgaagaatacttaagagatttcgaaaacagagcagcgcaattcagcaagaaaatcgaagccgacttcgactgggacaacgtcgctaatctgggcatgttcacctaccttctttccgaacgccccgggaaaaaccccgccctcgtccaatcaatcaaagactccctcctttccacagcagactctatcgtcagaacaagccaaaaccacggatacggccgaaccctcggaaccacatactactggggctgcaacggcaccgtcgtccgccaaaccatgatcctccaagtcgccaacaaaatctcccccaacaacgactacgtcaacgcagcactcgatgccatatcccacgtattcggccgcaactactataaccgttcatatgtcactggactcggaatcaaccctcccatgaacccccacgaccgcagatccggtgccgatggaatctgggaaccctggcccggctacctcgtcggcggcggctggccggggccgaaagactgggtagacatacaagacagctatcaaaccaacgaaatagccataaactggaacgccgccctaatctacgccttagctggattcgtaaactacaactcccctcaaaacgaagtcctctacggcgacgtcaacgacgacggcaaagttaactccaccgacctaaccctcctcaaacgctacgtcctcaaagccgtctccacccttccatcctcgaaggcagagaaaaatgccgacgtcaacagagacggccgagtaaattcatccgacgtcacaatcctgagccgatacctcatacgcgtgatcgaaaaactacccata

SEQ ID NO: 59012 - RNA, 2046 nt, synthetic construct
  misc_feature 1..2046: note = derived and/or modified sequence opt11 from anti-influenza_Chain
  source 1..2046: mol_type = other RNA
atgaaaccctcacatttcaccgaaaagcgattcatgaagaaagtgctcggactgttcctagtcgtagtcatgttagcgagcgtaggagtgttacccaccagcaaagtgcaagccgcaggaaccacagtaacctccatggaatattttagccccgcggacgggcccgtaatctccaaatcaggcgtcggcaaagcctcctacggcttcgtaatgcccaaattcaacggaggctcagccacgtggaacgacgtatacagtgacgtgggcgtcaacgtcaaagtaggtaacaactgggtcgacatcgaccaagcaggcggatacatctacaaccaaaactgggggcactggtccgacggcggcttcaacggctactggttcactctcagcgccaccactgagatacaactatactccaaagccaacggcgtcaaactcgaataccaactcgtcttccaaaacataaacaaaactaccatcacagcaatgaacccaacccaaggaccacaaataaccgcctccttcaccggaggcgcaggcttcacctaccccacattcaacaacgacagcgcggtcacatacgaagccgtagcagacgacctcaaagtatacgtcaaaccagtaaattcatccagctggatcgacatagacaacaacgccgcatccggatggatatacgaccacaacttcggacaattcacagacggaggaggaggatactggtttaatgtaacagaatcgatcaatgtcaaactcgagtccaagacctcatcagcaaacctcgtctacaccatcaccttcaacgaaccaacccgcaactcctacgtcatcactccgtacgaaggcacaacattcaccgcagacgcaaacggatccataggtatacccctacccaagatcgacggaggcgcaccaatagcaaaagaacttggcaacttcgtctaccaaatcaacatcaacggtcaatgggtcgatctctccaactcttctcaaagcaaattcgcctactccgccaacggctataacaacatgtctgacgcgaaccagtggggctactgggccgactacatatacggcctatggttccagccaatccaagaaaacatgcaaatccgaataggctacccgcttaacggccaagccggcggaaacataggcaacaacttcgtaaactataccttcatcggcaacccaaacgcaccgcgccccgacgtcagtgaccaagaagacatctccataggcacaccaacggacccggccatagcagggatgaacctcatatggcaagacgagttcaacggcaccaccctcgacacctcaaagtggaactacgaaaccggatactacctaaacaacgaccccgcaacatggggctggggcaacgcagaactccaacactacaccaacagcacacaaaacgtctacgtccaagacggcaaacttaacatcaaagccatgaacgactcaaagagcttcccacaagacccaaaccgctacgcccagtactcgtccgggaaaatcaacacaaaagacaaactttcactcaaatacggaagagtcgacttccgggccaaactccccaccggcgatggagtctggccagccctatggatgctacccaaagacagcgtatacggcacatgggcagcatcaggcgaaatagacgtcatggaagcccgcggacgcctccccggctcagtatccggcaccatacatttcggaggccagtggccagtaaaccaaagctccggcggagactatcacttcccggaaggccaaacctttgccaacgactaccacgtgtactccgtagtatgggaagaagataacatcaaatggtacgtagacggcaaattcttctacaaagttacgaatcaacaatggtactcaaccgccgcccccaacaacccaaacgcacccttcgacgaaccattctacctgatcatgaacctcgccgtcggcggtaacttcgatggcggacgaaccccaaacgccagcgacataccggccacaatgcaagtcgactacgtccgcgtctacaaagaacaa

SEQ ID NO: 59013 - RNA, 2046 nt, synthetic construct
  misc_feature 1..2046: note = derived and/or modified sequence opt11 from anti-influenza_Chain
  source 1..2046: mol_type = other RNA
atgaagccctcacacttcaccgagaaacgcttcatgaagaaagttctaggtctattcctagtcgtcgtcatgctcgcatccgtaggcgtcctacccacatccaaagttcaagcggccggcaccacagtaacgtccatggaatacttctctcccgccgacgggcccgtaatcagcaaatccggcgtcggcaaagccagctacggattcgttatgccaaaattcaacgggggaagcgccacatggaacgacgtatacagcgacgtcggcgtaaacgtaaaagtcggcaacaattgggtagacatcgaccaagccggtggctacatatataaccaaaactggggccactggtccgatggcggattcaacggctactggttcaccctcagcgccaccaccgaaatccagctatacagcaaagccaatggagtcaaactagaataccaactcgtcttccaaaacatcaacaaaacaacaataacagccatgaacccgacccaagggccccaaatcaccgcttctttcaccggaggcgcaggcttcacatacccaacatttaacaatgactcagccgttacatacgaggccgtggccgacgacctaaaagtctacgtaaaacccgtcaacagttcatcatggatcgacatcgataacaacgccgcctccggatggatttacgaccacaacttcggccaattcaccgacggcggcggcggatactggtttaacgttactgaatcaataaacgtcaaactagaaagcaagacctcctccgccaacctagtctacaccatcacattcaacgaacctacccggaactcatacgtcataaccccgtacgaaggaaccaccttcaccgccgacgccaatggctccataggcatcccactccctaagatcgacgggggagccccgatcgctaaggaactcggaaacttcgtctaccaaatcaacatcaacggtcaatgggtcgacctctcaaactcaagccaatccaaattcgcctactccgccaacggctacaacaacatgtccgacgccaaccaatggggatactgggcagactacatctacgggctatggttccaaccaatacaagaaaacatgcagatccgcatcggctacccacttaacggacaagcgggcgggaacatcggcaacaacttcgtcaactacacattcataggcaacccaaacgcaccccgcccagacgtctccgaccaagaagacatctcaataggcacgcctacagaccccgccatagccgggatgaacctcatatggcaggacgagttcaacggaacaacactcgacaccagcaagtggaactacgaaaccggatactacttaaacaacgaccccgccacctggggctggggcaatgcagaactccaacactacaccaactcaacgcaaaacgtctacgtccaagacggcaaactcaacataaaagcgatgaacgactccaaatcgttcccacaagacccaaaccgatacgcccaatacagctcaggaaaaataaacaccaaagacaaactttcccttaagtacggcagggtagacttccgcgctaaacttcccacaggggacggagtctggccagccctttggatgctccccaaagactcagtatacggcacctgggcggcatccggcgaaatcgacgtcatggaagcacgtggacgcctacccggctcagtaagcggcacaatccacttcggcggccaatggcctgtaaaccaaagctccggcggagactaccacttccccgaaggtcagaccttcgccaacgactaccacgtatactccgtggtatgggaagaagacaacataaagtggtacgtcgacggcaaattcttctacaaagtaaccaaccaacaatggtactccaccgcagcccccaacaacccaaacgcacccttcgacgaaccattctacctaataatgaacctcgccgtcggtggaaacttcgacggcggacgaactcccaacgcctcagacataccagctaccatgcaagtcgactacgtccgggtctacaaagagcaa

SEQ ID NO: 59014 - RNA, 2058 nt, synthetic construct
  misc_feature 1..2058: note = derived and/or modified sequence opt11 from anti-influenza_Chain
  source 1..2058: mol_type = other RNA
atgaccaaatccatctacttctccctgggcatccacaaccaccaacccgtcggcaacttcgacttcgtcatcgaacgtgcctacgaaatgagctacaaacccctaatcaacttcttcttcaaacacccggacttcccaatcaacgtccacttctcggggttcctactcctatggctagaaaagaaccacccggaatacttcgaaaaactaaagatcatggccgaacgcggacaaatcgagttcgtatccggcggcttctacgaacccatcctaccaataatccccgacaaggacaaagtccaacaaattaagaaactaaacaaatacatctatgacaaattcggacaaacacccaaaggcatgtggcttgccgaacgagtgtgggaaccccacctcgtcaaatacatcgccgaagccggcatcgaatacgtcgtcgtcgacgacgcccacttcttctcagttggcctcaaagaagaagacctattcggctactacctcatggaagaacaagggtacaaactagccgtcttccccataagcatgaagctccggtacctgatccccttcgccgaccccgaggaaacaataacgtacctagacaaattcgcctcggaagacaaatcgaaaattgccttactcttcgacgacggcgagaaattcggcctctggcccgacacataccgcaccgtctacgaagagggatggctcgagacattcgtcagcaagattaaagagaacttcctacttgtcacccccgtcaacctgtacacctatatgcaacgcgtgaaaccgaaaggccgaatttaccttcccaccgcatcctaccgcgagatgatggagtgggtcctcttccccgaagcccaaaaagaactcgaagaactcgtcgaaaaactcaagaccgaaaacctctgggacaaattcagcccctacgtcaaaggcggcttctggcgcaacttcctagccaaatacgacgaatcaaaccacatgcaaaagaaaatgctatacgtctggaagaaggtccaagactctccaaatgaagaagtcaaagaaaaggccatggaggaagtattccaaggccaagccaacgatgcctactggcacggcatattcggcggcctctacctcccacacctccgcaccgccatatacgaacacctcataaaagccgaaaactacctagaaaactcggaaatccgattcaacatcttcgatttcgactgcgacggcaacgacgaaatcatagtagaatcccccttcttcaacctctacctatcccccaaccacggtggatcagttctggaatgggacttcaaaacaaaagccttcaacctcacaaacgtcctcacccgccgcaaggaagcctaccactccaagctctcatacgtcacctccgaagcccaaggaaaaagcatacacgaacgatggaccgctaaagaagaaggcctagaaaacatcctcttctacgacaaccacagacgcgtctcctttaccgagaaaatcttcgaaagcgaaccagtcttagaagacctctggaaggactcatcacgcctcgaagtggactccttctatgaaaactacgactacgaaatcaacaaggacgaaaacaaaatccgcgtactgttctccggggtatttcgcggattcgaactctgcaaatcctacatactatacaaagataaatccttcgtcgacgtcgtgtacgaaatcaaaaacgtctcggaaacaccaatttccctcaacttcggctgggaaatcaacctcaatttcctagcccccaatcacccggactactacttcctgatcggcgaccaaaaataccccctatcctcattcggcatcgaaaaagtcaataactggaagatcttcagtggcatcggaatagaactcgagtgcgtcctcgacgtcgaggcatccctctaccgatacccaatcgaaaccgtaagtttgtccgaagagggcttcgagcgcgtctaccaaggctcagccctcatacacttctacaaagtggacctgcccgtaggatcaacctggcgcactacgatccgcttctgggtcaag

SEQ ID NO: 59015 - RNA, 2058 nt, synthetic construct; identical to SEQ ID NO: 13162
  misc_feature 1..2058: note = derived and/or modified sequence opt11 from anti-influenza_Chain
  source 1..2058: mol_type = other RNA

SEQ ID NO: 59016 - RNA, 2115 nt, synthetic construct
  misc_feature 1..2115: note = derived and/or modified sequence opt11 from anti-influenza_Chain
  source 1..2115: mol_type = other RNA
atgcccaccaacctcttcttcaacgcccaccactctcccgtaggcgcattcgccagttttacactcggtttccccgggaaaagcggaggcctcgacctcgagctagcccgcccgcccagacaaaacgtcctgatcggagtcgaatccctccacgagtcaggtctataccacgtactacccttcctggagaccgcagaggaagacgaatccaaacgatacgacattgaaaaccccgatccgaacccccaaaaaccaaacatactaatcccattcgccaaggaagaaatacaacgcgagttccatgtggccaccgacacatggaaggcaggagacctcaccttcacaatatactcccccgtcaaagcagtcccgaatcccgaaaccgctgacgaagaagagttaaaactggccctcgtccccgcagtcatagtcgagatgaccatagacaacaccaacggcacacgtgcacgccgagcattcttcgggtttgaaggcacggatccgtacacgtccatgaggcggatcgacgacacctgtccacagttacgtggcgtaggacaaggacgaatcctgtcaatagtcagcaaagacgaaggcgtccggagcgccctacactttagcatggaagacatcctgacagcacaactagaagaaaattggacttttggtctcggcaaagtaggagcactcatcgtcgatgtccctgccggagaaaagaaaacctaccagttcgccgtatgcttctaccgcggcggctatgtaaccgccggaatggacgcctcatacttctacacccgcttcttccaaaacattgaagaagtcggactctacgccctagaacaagcagaagtactaaaagaacaatcattccgctccaacaaacttatagaaaaggaatggctaagcgacgaccagacattcatgatggcgcacgccatacgatcatattacggaaacacacagctactcgaacacgagggcaaacctatctgggtcgtaaacgaaggcgaataccgcatgatgaatacattcgacctcaccgtagaccaactcttcttcgagctcaaactaaacccgtggacagtgaaaaacgtcctagacctatacgtagaacgctactcgtacgaagaccgcgtccgatttccgggcgaggaaaccgaatacccctccggcatatccttcacacacgacatgggcgtggcaaacaccttcagccgcccacactactcaagctacgaactctacggcataagcggctgcttctcccacatgacccacgaacaactggtcaactgggtactgtgcgcagccgtatacatagagcaaacaaaagactgggcctggcgcgacaaacgactcgcaattctggaacagtgccttgaatcgatggtccgcagggatcaccccgaccccgaacaacggaacggcgtcatgggcctcgactcaactcgaaccatgggcggggccgaaatcacaacctacgacagcctagacgtgtccctaggccaggcaagaaacaacctatacctcgccggaaaatgctgggcagcctacgtggctctcgaaaaattattccgcgacgtcggcaaagaagaactcgcggccctcgccggcgagcaagccgagaagtgcgctgcaaccatagtatcccacgtaaccgacgatggatacatacccgccataatgggcgaaggcaacgactcgaaaatcatacctgccatagaaggcctagtattcccctacttcacaaattgtcatgaagccctcgatgaaaacggccgattcggagcctatatccaagccctccgaaaccacctccaatacgtcctacgcgaagggatatgcctcttccccgacggcggctggaagatttccagcacatcaaacaactcttggctatccaaaatctacctatgccaattcatagcccgacacatactcggctgggaatgggacgagcagggtaaaagagcagacgcagcccacgtcgcatggctgacacaccccaccctgtcaatctggtcctggtccgaccaaatcatagccggggaaataacaggctcaaaatactacccacgcggagtaaccagcatactctggctagaagagggagag

SEQ ID NO: 59017 - RNA, 2115 nt, synthetic construct
  misc_feature 1..2115: note = derived and/or modified sequence opt11 from anti-influenza_Chain
  source 1..2115: mol_type = other RNA
atgccaacaaacctattcttcaacgcacaccattccccggtcggagcattcgcatccttcacactcggcttccccggcaaaagcggcggcctcgacctagaactagcccgacccccacggcaaaacgtactgatcggagtcgaatcactacacgaatccggcctctaccacgtcctaccgttcctggaaaccgccgaagaggacgaatccaaacgctacgacatcgaaaatcccgaccctaatccccaaaaacccaacatcctcatcccatttgcaaaagaagaaattcaacgagagttccacgtcgccaccgatacctggaaagccggcgacctcactttcacaatctactcacccgtcaaagcggtaccaaatcctgaaaccgcggacgaagaagaactcaaacttgccctcgtgcccgcggtcatagtcgaaatgacaatcgacaacaccaacggcacgagagcacgtcgcgccttcttcggattcgaaggcaccgacccatacacatcaatgagacgaatcgacgacacatgcccccaactccgaggcgtcggacagggccgcatactatccatcgtgtcaaaggatgagggagtccgctcggcactccacttcagcatggaagacatcctcaccgcacaactcgaagaaaactggacgttcggactaggaaaagtcggcgcccttatagtcgacgtacccgccggagaaaagaaaacctaccagttcgcagtctgcttctatagaggtggatacgtcacagctggcatggacgcctcttacttctacacccgtttctttcaaaacatcgaagaagtaggcctttacgccctagaacaggcagaagtcctgaaagagcaatccttcagatccaacaaactcatcgagaaagaatggctaagcgacgatcaaaccttcatgatggcccacgccataagatcgtactacggcaacacccaactcctcgaacacgaaggcaaacccatatgggtagtcaacgaaggcgaataccggatgatgaacacattcgacctcacagtcgatcaactcttcttcgaactcaaactaaacccgtggaccgttaaaaacgtactcgacctctacgtagaacgctacagctacgaagaccgcgtccgcttcccaggcgaagagaccgaatacccctccggcatctccttcacccacgacatgggagtcgctaacaccttctcgagaccgcactacagctcatacgaactctacggaatatccggatgcttttcccacatgacccacgagcaattagtcaattgggtactatgcgcagccgtctacatcgaacaaaccaaggattgggcatggcgagataaacggctggcaatactcgaacaatgcctagaatccatggtccgacgcgaccaccccgacccagaacagagaaacggagtcatgggactggactcaacacgaaccatgggcggggcagaaatcaccacctacgactccctcgacgtcagcctgggccaagccagaaacaacctctacctcgccggtaaatgctgggccgcatacgtagccctcgaaaaactcttccgcgacgtaggaaaagaagaactcgccgcactcgcaggagagcaagctgaaaagtgcgcagccacgatcgtatcacacgtcaccgacgacggctatatacctgccatcatgggcgaaggcaacgactcaaagataatcccagcgatcgaaggcctagtcttcccctacttcacaaactgccacgaagcactcgacgaaaacggacgcttcggcgcatacatccaagcactccgaaaccacctacaatacgtcctcagagaaggaatatgcctcttccccgacggcggctggaaaatctcctccacaagcaacaacagctggctaagcaaaatatacctctgccaattcatcgcgcgccacatcctcggctgggagtgggacgaacaaggcaaacgcgccgacgcagcgcacgtcgcgtggctaacccacccaacgctctcaatatggtcctggagcgaccagatcatagcaggagaaataaccggctccaaatactatccaagaggtgtcacatccatcctctggctcgaagagggcgag

SEQ ID NO: 59018 - RNA, 2148 nt, synthetic construct
  misc_feature 1..2148: note = derived and/or modified sequence opt11 from anti-influenza_Chain
  source 1..2148: mol_type = other RNA
atggaagatttcgtccgccaatgcttcaacccaatgatcgtagagctcgcagaaaaagctatgaaagagtacggagaagacctcaagatcgaaacaaacaaattcgccgcaatctgcacccacctcgaagtctgcttcatgtactcagacttccacttcatcaatgaacagggcgaaagcataatcgtggaaccggaagacccaaacgccctactcaaacacaggttcgaaataatcgagggacgagaccgcaccatggcctggacagtcgtaaactccatctgtaataccaccggggccgaaaagcccaagttcctacccgacctgtacgactacaaggaaaaccgattcatcgaaataggcgtcacgcgcagggaagtccacatatactatctcgagaaggcgaacaaaataaaaagcgagaaaacacacatccacatattctcattcaccggcgaggagatggcgacgaaagccgactacacactagacgaggaatctcgcgcgcgaataaaaacgcggctattcacaatccgccaagagatggcatcccgaggcctgtgggacagcttccgccaaagcgagcgcggcgaagagacaatcgaagagagattcgaaatcaccggaacaatgcgccggctcgccgaccagtccctgcccccaaacttcagttgcctcgagaacttccgcgcctacgtcgacggcttcgaaccaaacggctacatagagggcaaactatcacaaatgagcaaagaagtcaacgcgcgcatagaaccattcctgagaacaacaccgcgcccgatacgattacccgacggccctccatgcttccaaagatcaaagttcctcctcatggactcgctcaaactatcaatagaagacccaagccacgaaggggaagggataccgctctacgacgccatcaaatgcatgcgcacgttcttcggctggaaagagccgtcagtagtcaaaccccacggaaagggaatcaaccccaactacctcctcagctggaagcaagtgctcgcagaactccaagacatcgaatcagaggagaaaataccacgtaccaaaaacatgaagaaaacaagccaactcaaatgggcactcggagaaaacatggcacccgaaaaagtagacttcgacgactgcaaagacataagcgacctaaaacaatacgacagtgatgaacccgaactcaggagcctgagctcttggatacaaaatgagttcaacaaagcctgcgaactgaccgactccatctggattgaactcgacgaaatcggagaagacgtagcacccatagaacacatcgcatccatgcgaaggaactatttcacggccgaagtctcacactgccgcgcgaccgaatacataatgaaaggtgtgtacataaacacagcactcctcaacgcatcctgcgcagccatggacgactttcaactcataccaatgatcagtaaatgccgcacaaaagaaggccgacgcaaaacaaacctctatggcttcattattaaagggcgctcacacttgcgaaacgacacagacgtagtaaacttcgtatccatggagttcagcctcacagacccacgcctcgaaccccacaaatgggaaaaatactgcgtcctcgaaatcggagacatgttactcagatcagcaatcggccaagtaagcaggccaatgttcctatacgtccgcacgaacggtacctcgaaaataaagatgaaatggggaatggaaatgcgccgctgcctcctccagagcttacaacaaatagaaagcatgatagaagccgaatcgtcggtcaaggaaaaagacatgaccaaagagttcttcgagaacaggagcgagacctggccaatcggcgagagcccaaaaggcgtagaagaaggatccataggaaaagtctgccgcacgctcctggccaaatccgtattcaacagcctgtacgcctccccacagctagaagggttctcggccgaaagccgaaaactgttgctaatcgtccaagcactccgcgacaacctcgaacccggaaccttcgacctaggcggcctatatgaagcaatcgaagaatgcctaataaacgatccctgggtcctcctaaacgccagctggttcaacagcttcctcacgcacgcattacga

SEQ ID NO: 59019 - RNA, 2148 nt, synthetic construct
  misc_feature 1..2148: note = derived and/or modified sequence opt11 from anti-influenza_Chain
  source 1..2148: mol_type = other RNA
atggaagacttcgtacgccagtgcttcaacccaatgatagtagaactcgccgaaaaagcaatgaaagagtacggggaagacctaaagatcgagaccaacaaattcgccgcgatctgcacccacctcgaagtctgcttcatgtactcggacttccacttcatcaatgaacaaggagagagcatcatcgtagaaccggaagaccccaacgctctactcaaacacagattcgaaataatcgaagggcgggatcgtacaatggcatggacagtagtgaactcgatctgcaacacaactggagcggagaaacccaaattccttccagacctatacgactataaagaaaacagattcatcgaaataggcgtaacacgccgagaagtacacatctactacctcgaaaaagccaacaagatcaaatcagagaaaacccacatccacatattctccttcacaggcgaagaaatggccactaaagccgactacacattagacgaagaatcaagagcacgcattaaaacacgcttattcacgatccgccaagaaatggcgtcaagaggcctctgggacagcttccggcaaagcgagagaggggaggagaccatagaagaacgcttcgaaataacaggcacaatgcgccgactcgccgaccagtcactaccaccaaacttcagctgcctagaaaacttccgcgcatacgtcgacggattcgagcccaacggctacatcgaaggcaaactctcccaaatgagcaaggaagtcaacgcacgaatagaaccattcctacgaacgacccctcgcccgatcagactcccagacggacctccctgcttccaacgatccaagttcctactcatggactccctaaaactatccatcgaggacccctcccacgaaggcgaaggaatccccctctacgacgccataaaatgcatgcgaacgttcttcggctggaaggagccctcagtcgtgaaaccgcacggaaaggggataaaccccaactatctgctctcttggaaacaggtcttagccgaactacaagacatagagagcgaagagaaaatcccacggacgaaaaacatgaagaaaacaagccaactaaagtgggcactaggcgaaaacatggcccccgaaaaggtcgatttcgacgactgcaaagacatctcagacctcaaacaatacgactcggacgaacccgagctccgaagcctaagcagctggatacagaatgagttcaacaaagcatgcgaactaacagactcgatatggatagaactagacgagatcggagaagatgtagcacccatcgaacacatagcaagtatgagacgcaactacttcacagcagaagtaagtcactgccgagccacagaatacataatgaaaggcgtatacattaacacagccctactcaacgcctcctgcgccgccatggacgatttccaactaataccaatgatcagcaaatgccgcacaaaagaaggcagaagaaaaaccaacctatacggcttcatcatcaaaggccgctcacacttgcgcaacgacacggacgtggtgaacttcgtatcaatggagttcagcctaacagacccccggctcgaaccccacaagtgggaaaagtactgcgtcctcgaaataggcgacatgctcctccggagcgcgatcggtcaagtcagccgccccatgttcctctacgtcagaacaaacggcacatcaaaaataaagatgaaatggggaatggaaatgcgccggtgcctgctacaaagcctgcaacaaatcgaaagcatgatcgaggcagaaagctctgtcaaagaaaaagacatgacgaaggagttcttcgaaaacagatccgaaacctggccaataggggaaagcccgaagggagtcgaagaaggcagcatcggcaaagtctgccgcactctcttagccaagagcgtcttcaacagcttatacgccagcccgcaacttgagggattctccgcagaaagccgaaaactcctactgatcgtccaagcactacgagacaacctagagcccgggaccttcgacctgggaggcctctacgaagcgatcgaggaatgcctcataaacgacccctgggtacttctaaacgcatcctggtttaactcattcctaacgcacgccctgcgt

SEQ ID NO: 59020 - RNA, 2256 nt, synthetic construct
  misc_feature 1..2256: note = derived and/or modified sequence opt11 from anti-influenza_Chain
  source 1..2256: mol_type = other RNA
atgaacataaatccctacttcctattcatcgacgtgcccatacaagcagccataagcacaaccttcccatacacaggagtcccaccctacagccacggcaccggcaccggctacacaatcgacacagtcatacgcacacacgaatattccaacaaaggcaaacaatatatcagcgatgtaaccggatgcgtaatggtagaccccacaaacggccccctccccgaggacaacgaaccctccgcctacgcgcagctagactgcgtactagaagctctcgaccgaatggacgaagaacacccgggattattccaagcaggcagccaaaacgccatggaagccctaatggtaactaccgtcgacaaacttacccaaggacggcaaaccttcgactggacggtatgccgcaaccaacccgccgcaaccgccctaaacaccacaatcaccagcttccgactcaatgatctcaacggggctgacaaaggcggtctcgtccccttctgccaagacataatcgacagccttgacaaacccgaaatgatcttcttcaccgtgaagaatatcaaaaagaaactacccgccaaaaaccggaaaggcttcctcatcaaacgaatccccatgaaagtcaaagaccgcatcaccagagtcgaatacataaaacgagccctaagcctaaacacaatgactaaagacgccgaacgcggaaaattaaaaagacgagcgatagccaccgcaggcatccaaatccgcggattcgtcctcgtggtcgaaaacctggccaagaacatatgcgaaaacctagaacagtcagggctccccgtaggcggcaacgaaaagaaagccaaactatcaaatgccgtagccaaaatgctatcaaactgcccacccggaggcatatccatgaccgtgacaggggacaacacaaaatggaacgaatgcctcaatccccgaatattcctagcaatgacggaacgcatcacacgagactcgccaatctggttcagagacttttgctcgatcgcccccgtactattcagcaacaaaatagccaggctaggcaaaggtttcatgatcacctccaaaaccaaacgactcaaagcccaaataccctgcccggatctcttcaacatccccctcgaaaggtacaacgaagaaacccgcgccaagctcaagaaactgaaacccttcttcaatgaagaaggtactgccagcctctcccccggaatgatgatgggcatgtttaatatgctttccaccgtactcggcgttgctgcactaggaattaaaaacataggcaataaagaatacctatgggacggcctccagtccagcgacgacttcgcacttttcgtcaacgcgaaggacgaagagacatgcatggaaggcataaacgacttctaccgaacctgcaaactactcggaatcaacatgtccaaaaagaaatcctactgcaacgaaaccggcatgttcgagttcacgagcatgttctaccgggacggcttcgtatccaacttcgccatggaactcccatcattcggcgtagccggcgtcaacgaatccgccgacatggccataggcatgacaatcatcaaaaacaacatgataaacaacggaatgggcccagccacagcccaaaccgcgatccaactgttcatagcagactaccgatatacatacaaatgccacagaggagacagtaaagtcgaaggcaaacgcatgaaaatcatcaaggaactctgggaaaataccaaaggacgtgacggcctgctagtcgcagacgggggccccaacctctacaacctacgcaacctccacattcccgaaatcatcttaaagtacaacataatggaccctgaatacaaaggccgcctcctacacccccaaaacccctttgtaggacacctgtccatcgaaggaataaaagaagccgacataacccccgcccatggaccaataaagaaaatggactacgacgccgtcagcggaacacactcctggaggactaaacgcaaccgcagcatcctcaacaccgatcaacgcaacatgatcctagaagaacaatgctacgcaaaatgctgcaacctattcgaagcctgcttcaactccgcaagctatcgcaaacccgtaggccaacatagtatgctagaagcaatggcccaccgcctacgtatggacgctcgactagactacgaaagcggccgaatgtctaaagaagacttcgaaaaagcaatggcccacctaggcgaaattgggtacatg

SEQ ID NO: 59021 - RNA, 2256 nt, synthetic construct
  misc_feature 1..2256: note = derived and/or modified sequence opt11 from anti-influenza_Chain
  source 1..2256: mol_type = other RNA
atgaacatcaacccctacttcctgttcatcgacgtgccgatccaggccgccatcagcaccaccttcccctacacgggcgtcccgccctactcccacgggaccggcaccgggtacaccatcgacacggtgatccgcacacacgaatacagcaacaagggcaaacagtacatttccgacgtgacggggtgcgtcatggttgacccgaccaacggccccctccccgaggacaacgagcccagcgcttacgcgcagctggactgcgtgctggaggccctcgaccgcatggacgaggagcacccgggcctgttccaggccgggtcccagaacgccatggaggcgctgatggtcacgaccgtcgacaagctgacacagggccgccagaccttcgactggaccgtgtgccggaaccagcccgccgccaccgccctgaacaccaccatcacgagcttccgcctgaacgacctcaacggggctgacaagggcgggctggtccccttctgccaagacatcatcgactccctggacaagcccgagatgatcttcttcaccgtaaagaacattaagaagaagctcccagccaagaaccggaagggcttcctgatcaagcgcatccccatgaaggtgaaggacagaatcacccgcgtcgagtacattaagcgggccctgtctctaaacaccatgacaaaggacgccgagcgcggaaagttgaagcggcgggccatcgcgaccgccgggatccagatccggggcttcgtgctagtcgtggagaacctcgccaaaaacatctgcgagaacctggagcagtccgggctgcctgtcggcggcaacgagaagaaggccaagctcagcaacgccgtagcgaagatgctgtccaactgcccgcccgggggcatcagcatgaccgtcaccggggacaacaccaagtggaacgagtgcctgaacccccgcatcttcctcgccatgaccgagcggatcacccgcgactcccccatctggttccgggacttctgtagcatcgcccccgtgcttttctccaacaagatcgcccgcttaggcaaggggttcatgatcaccagcaagacgaagcggctcaaggcccagataccctgccccgacctgttcaacatccccctggagcgctacaatgaggagacccgggcgaagctcaagaagctgaagcccttcttcaacgaggagggcaccgcctccctgagcccgggcatgatgatggggatgttcaacatgctctccaccgtgctgggcgtagccgccctggggatcaaaaatatcggcaacaaggagtacctctgggacgggctgcagtctagcgacgacttcgcccttttcgtgaacgcaaaggacgaggaaacatgcatggagggcatcaacgacttctaccgaacctgcaagctcctgggcatcaacatgtccaagaagaagtcctactgcaacgagaccgggatgttcgagttcaccagcatgttctaccgcgatggtttcgtgagcaacttcgccatggagctcccatctttcggggtcgccggcgtcaacgagagcgccgacatggcgattggtatgacgatcatcaagaacaacatgatcaacaatggcatgggccccgccaccgcccagaccgccatccaactgttcatcgccgattaccgctacacctacaagtgccaccgcggtgactccaaggtcgagggcaagcggatgaagatcatcaaggagctctgggagaacaccaaagggcgcgacggcctgctcgtggccgacggcgggccaaacctgtataacctgcggaacctacacatcccggagatcatcctgaagtacaacatcatggatcccgagtacaagggccgcctgctgcatccccagaacccgttcgttgggcacctcagcatcgagggaatcaaggaggccgacatcacgcccgcccacgggcctatcaagaagatggattacgacgccgtctccggcacccacagctggcggaccaagcgcaaccgctccatcctgaacaccgaccagcgcaacatgatcctcgaggagcagtgttacgccaagtgctgcaacttgttcgaggcgtgcttcaacagcgcctcctaccggaagcccgtcggccagcactcgatgctggaggctatggcccatcgcctgcggatggacgcccgtctcgactacgaatccgggcggatgagcaaggaggacttcgagaaggcgatggcccacctgggcgagatcgggtacatg

SEQ ID NO: 59022 - RNA, 2265 nt, synthetic construct
  misc_feature 1..2265: note = derived and/or modified sequence opt11 from anti-influenza_Chain
  source 1..2265: mol_type = other RNA
atggccgtggacatcaaaaagataataaaacaaatgaccctcgaagaaaaggcaggactctgcagtggactcgacttctggcacacaaaaccagtagaacgactgggcattccatcaataatgatgacggacggacctcacggcctgcgcaaacagagagaagacgcagaaatcgcagacatcaataacagcgtacccgcgacctgcttcccaagcgcggccggcctagcatgctcatgggaccgcgaactggtggaacgggtaggggccgcactcggcgaagaatgccaagctgaaaacgtgagtatcttactagggcccggcgcaaacatcaaaaggagcccactgtgtggcagaaacttcgaatacttcagcgaagacccatacctctcgagcgagctcgcggctagtcatatcaaaggcgtacaatcccagggcgtaggcgcgtgcctgaaacacttcgcagcaaacaaccaagagcaccgcagaatgaccgtagacaccatcgtagacgaacgaacattgcgagagatatattttgccagcttcgaaaatgcagtcaagaaagccagaccctgggtcgtaatgtgtgcctacaacaaactaaatggagaatactgcagcgaaaacagatacctactcaccgaggtgctcaagaacgaatggatgcacgacggctttgtagtgtcagactggggagccgtgaacgatagagtaagcggcctcgacgcagggctcgacctcgaaatgccaaccagccacggcataacagacaaaaagatcgtcgaggccgtgaaatcaggcaaactatcggaaaacatcctaaacagggcggtagaaaggatactcaaagtcatattcatggcactagaaaacaagaaagaaaacgcccagtacgacaaagacgcacaccaccgcctcgcaaggcaagcagctgccgaaagcatggtcctcctgaaaaacgaagacgacgtgctaccactcaagaaatcgggcacgatcgcgctcataggcgcattcgtcaagaaaccgagataccagggctcaggatcgtcccacatcacacccacacgtctagacgacatatacgaagaaatcaagaaagccggcggcgacaaagtgaacctcgtgtactcagaaggataccgactggaaaacgacggaatagacgaggaactaataaacgaggcgaaaaaggccgcgtcctccagcgacgtagccgtagtgttcgcgggcctgccagacgagtacgaatcagaaggattcgacaggacgcacatgagcattccagaaaaccaaaacagactaatagaagcagtagcagaggtacaaagcaacatcgtagtagtattgctcaacggcagccccgtcgaaatgccctggatcgacaaagtgaaatcagtcctagaagcatacctaggaggacaagcgctaggcggcgcactcgcagacgtactattcggcgaagtcaacccctccggcaaactggccgaaacattcccggtcaagctcagccacaacccatcatacctaaactttcccggggaagacgacagagtcgaatacaaggaaggactcttcgtaggatacagatactacgacacaaaaggaatagaaccactattcccattcggccacgggctctcatacacgaagttcgagtacagcgacatctcagtggacaaaaaggacgtaagtgacaacagcataatcaacgtaagcgtaaaagtgaaaaacgtcggaaagatggccggcaaagaaatcgtacaactctacgtgaaagacgtcaaatcctcagtcagacgcccagaaaaggaactgaaaggtttcgagaaagtcttcctaaaccccggagaggagaaaaccgttaccttcacactagacaagcgcgcattcgcctactacaacacacaaataaaagactggcacgtggaaagcggagagttcctaatactcatcggacgatccagccgcgacatcgtcctaaaggaaagcgtgcgagtaaacagcaccgtcaaaattagaaaacgcttcaccgtgaactccgccgttgaagacgtgatgtccgacagcagcgcggccgcggtactaggcccagtactcaaagaaatcacagacgccctccagatcgacatggataacgcccacgacatgatggccgccaacatcaaaaacatgccacttagaagcctagtcggatactcgcaagggagactcagtgaagaaatgctcgaagaactggtcgacaaaataaacaacgtagaa

SEQ ID NO: 59023 - RNA, 2265 nt, synthetic construct
  misc_feature 1..2265: note = derived and/or modified sequence opt11 from anti-influenza_Chain
  source 1..2265: mol_type = other RNA
atggccgtcgacatcaagaaaataataaaacagatgacactagaagaaaaagcaggcctatgtagtgggctagacttctggcacacaaaaccagtagaacgactgggcataccctcaatcatgatgacggacgggccgcacggcctgcgcaagcaaagagaagacgccgagatcgcagacataaacaacagcgtcccagcgacctgcttcccgagtgcggcaggcctagcgtgcagctgggaccgcgagctcgtggaaagggtcggagccgcgctcggggaagaatgccaggccgaaaacgtaagtattctcctgggaccgggcgcgaacataaaacgaagccccctatgcggaagaaacttcgaatatttctcggaagacccctacctaagctccgagctggcggccagccacataaagggagtacagagccagggcgtaggagcgtgcctaaaacacttcgcggcaaacaaccaagaacaccgcaggatgacagtggacacgatagtagatgaaaggacactgcgcgaaatatatttcgcgagcttcgaaaacgcagtgaagaaggcccgaccctgggtcgtaatgtgcgcctacaacaagctcaacggagagtactgcagtgagaaccgatacctactcacggaagtactcaagaacgagtggatgcatgatggcttcgtggtgagcgactggggtgcggtaaacgatcgcgtaagcggactcgatgctggactcgacctcgaaatgccaacatcgcacgggatcacggataagaaaatagtagaagccgtcaaaagcggcaagctgtcagaaaacatcctgaatagggccgtggagcgaatactaaaagtgatattcatggcgctagagaacaagaaagaaaacgcgcaatacgacaaggacgcccaccacagactagccagacaagcggcggcggaaagcatggtcctcctgaaaaacgaagacgacgtgctaccactcaagaaatcgggcaccatagcactcataggcgcgttcgtgaaaaagccacgctaccaaggcagcggctcaagccacatcacgccgacacgcctggacgacatatatgaagagataaagaaagcgggcggcgacaaggtaaacctagtgtactcagaaggctacagactagaaaacgacggtatagacgaagaactgataaacgaagccaagaaagccgcgagttccagcgacgtggccgtcgttttcgcaggcctaccagacgaatacgagtccgagggattcgaccgaacgcacatgtcaatccccgagaaccagaacaggctaattgaagcagtcgcagaagtgcagtcgaacatagtcgtagtactactcaacggatcgccagtggaaatgccctggatcgacaaagtgaaatcagtactcgaagcgtacctgggaggccaagcgctgggaggcgcactcgcggacgttctcttcggagaggtcaatccctcaggcaaactagccgaaacgtttccggtaaaactctcacacaacccatcctacctgaactttcccggggaggacgacagagttgagtacaaagaaggactgtttgtcggatacagatactacgacacgaaagggatagagccactgttcccattcgggcacgggctgagctacacaaaattcgaatacagcgacatctcagtcgacaagaaagacgtaagcgacaactcaatcataaatgtgagcgtcaaagtgaaaaacgtaggtaagatggcggggaaagaaatcgtccaactgtacgtgaaagatgtaaagagcagtgtccgccgcccggaaaaggaactcaaagggttcgaaaaagtgttcctgaacccgggcgaagagaaaacagtgaccttcaccttggacaagcgcgcattcgcgtactataatacccagatcaaggactggcacgtcgaaagcggagagttcctaatcctgatcggcagaagcagccgagacatcgtgctaaaggaatcagtacgagtcaacagcacagttaagatccggaaaaggttcaccgtaaacagcgcggtagaagacgtaatgagcgactcgtccgcagccgcggtgctcggccccgtactaaaggaaatcacagacgcgctccaaatcgacatggataacgcgcacgacatgatggcagcaaacatcaaaaacatgccgctcagatcgttggtcgggtacagccaaggacgactcagtgaggaaatgctcgaagaattggtagacaagataaacaacgtagag

SEQ ID NO: 59024 - RNA, 2277 nt, synthetic construct
  misc_feature 1..2277: note = derived and/or modified sequence opt11 from anti-influenza_Chain
  source 1..2277: mol_type = other RNA
atggaacgaatcaaagaactccgcaacttaatgagccagtcccgaacacgagagatcctgaccaaaacaacggtcgaccacatggccatcatcaagaaatacacctccggccgccaagagaaaaacccagccctccgcatgaaatggatgatggcaatgaaataccccatcacggcagacaaaaggataacagaaatgatccccgaaagaaacgaacaaggccaaacactatggtcaaagatgaacgatgcaggatcagaccgcgtcatggtctcacccctagcagtgacatggtggaaccgtaacggccccatgaccaacaccgtacactaccccaaaatctacaaaacatatttcgaacgagtagaacgactcaaacacgggacattcggccccgttcacttccgaaaccaagtcaagatccgacgacgcgtagacataaacccagggcacgcagacctgtccgcgaaagaagcccaggacgtaatcatggaagtagtcttcccgaatgaagtaggcgcgcgaatactcacctccgaatcccaactaacaatcaccaaagagaaaaaggaagaacttcaagactgtaaaatcagccctctcatggtagcctacatgctcgaacgcgaactcgtccgcaaaaccagattcctacccgtcgccggcggcacctccagcgtctacatcgaagtactacacttgacccaaggtacctgctgggaacaaatgtacacaccgggcggcgaagtcaaaaacgacgacgtcgaccaatcactcatcatcgcggccagaaacatagtcagacgcgccgccgtaagcgcagacccgctcgcgagcctcctcgaaatgtgccacagcacgcaaattggaggcatcagaatggtagacatactcaaacagaacccgaccgaagaacaagccgtaggcatctgcaaagccgctatggggcttagaatctccagctccttctcattcggaggctttaccttcaaacgaacctccggatcaagcgtaaagcgagaagaagaggtcctcacaggcaacctacaaaccctcaaaatccgagtccacgaaggctacgaggagttcaccatggtcggccgccgagcaaccgccatccttcgcaaagcaacacgtagactaatccaactgatagtctcgggacgagacgaacagagcatcgccgaagccattatagttgcaatggtcttcagccaagaagattgcatgattaaggccgtgagaggagacctcaacttcgtaaaccgcgcaaaccaacgtctcaacccgatgcaccaactgctacgccacttccaaaaggacgcaaaagtcctgttccaaaactggggcgttgaaccaatcgacaacgtaatgggaatgataggcatactccccgacatgacgccgtcaatcgagatgtccatgcgaggagtccgaatctccaaaatgggggtcgacgagtactcatcaacagaacgagtagtcgtcagcatagacagattcctgcgagtacgcgaccaacgcggcaacgtactactgtcaccagaagaagtcagcgaaacacaaggcacagaaaaactcaccataacatactctagcagcatgatgtgggaaataaatggcccagaatccgtcctggtaaacacctaccaatggatcatccgcaactgggagacagtaaaaatacaatggagccaaaaccccaccatgctctataacaaaatggaatttgaaccattccaatccctggtccccaaggccatacgcggccagtattccggattcgtccgcaccctcttccaacaaatgcgggacgtcctcggaacctttgacaccgcccagatcatcaaacttctgcccttcgctgccgcccctccaaaacagagccgcatgcaattctcctccttcacagtaaacgtgcgcggaagcgggatgcgaatactcgtccgcggaaactcccccgtctttaactacaacaaggccaccaaacgcctcacggtcctcggcaaggacgcaggaacactaactgaagacccagacgagggtacagccggcgtagagtcagcggtgctacgcggcttcttaatactaggaaaagaagaccgacgctatggccccgccctctccataaacgaactcagcaacctagccaagggcgagaaagcaaacgtcctcatcggacaaggcgacgtagttctagtcatgaaaagaaagcgcgactcctcgatcctaaccgacagccagacggccacaaaacgaatccgaatggcaatcaac

SEQ ID NO: 59025 - RNA, 2277 nt, synthetic construct
  misc_feature 1..2277: note = derived and/or modified sequence opt11 from anti-influenza_Chain
  source 1..2277: mol_type = other RNA
atggagcgaatcaaagaactccgaaatctaatgtctcaatcgcgcaccagagaaatactaacaaaaacaacggtcgatcacatggccataattaagaaatatacctcgggccgccaagagaaaaaccccgcactcagaatgaaatggatgatggcaatgaaataccccatcacagcggacaaacggatcaccgaaatgatccctgaaagaaacgaacagggccaaaccctctggagcaaaatgaacgacgcaggatccgacagggtgatggtatccccgttagccgtcacctggtggaatcgcaacgggcccatgacaaacaccgtccactacccaaaaatctacaaaacctacttcgagcgcgtggaaagactgaaacacgggaccttcggaccagtccacttccgcaaccaagtaaaaatacggcgccgggtcgacatcaacccaggacacgcagacctaagcgcgaaagaagctcaagacgtaatcatggaggtagtatttcccaacgaagtcggcgcacgcatacttacatcagagagccaactcaccataaccaaagagaagaaagaagaactacaagactgcaaaataagccccctcatggtagcatacatgctagagcgcgagctagtccgcaaaacccgattccttcccgtggcaggcggcacctcctccgtctacatcgaagtcctccacctcacccagggaacgtgctgggaacaaatgtacaccccaggaggggaagtgaaaaacgacgacgtagaccaaagcctaataatcgcagctcggaacatagtcaggcgcgccgccgtaagcgcggaccccctagccagcctactggagatgtgccactcaacacaaatagggggaatacgcatggtcgacatactgaaacaaaacccaaccgaggaacaggccgtagggatatgcaaagccgcaatgggcctacgaatttcaagcagcttcagcttcggaggcttcacattcaaacgcacaagcggctcctcagtaaagcgagaagaagaggtactgacaggtaatctgcaaaccctcaaaatacgcgtacacgaaggctacgaagaatttaccatggtcggaagacgagcaacagccatcctccgaaaagccacaagaagactaatccagctcatagtgtccggacgagacgaacaaagtatagcagaagccataatcgtagccatggtcttctcacaagaagactgcatgatcaaggccgtgcgcggggacctcaacttcgtaaacagggcaaaccaacgcctaaacccgatgcaccaattactcagacacttccaaaaagacgcgaaagttctcttccaaaactggggcgtcgaacccatagacaacgtcatggggatgatcgggatcctgcccgacatgacgccatccatcgaaatgagcatgcggggagtgcggatcagtaaaatgggagtagacgaatactccagcacagaacgagtggtagtaagcatcgaccgattcctacgcgtacgagaccaaaggggcaacgtgctgctctccccggaagaagtgagcgaaacacaggggaccgaaaaactaaccatcacatacagcagctcaatgatgtgggaaatcaacggaccggaatcagtcctcgttaacacgtatcaatggatcatccgcaactgggaaaccgtcaagatccaatggagccaaaacccgacgatgctctacaacaaaatggagttcgaacccttccaaagcctagtacccaaagccataagaggacaatatagcggattcgtacggacactcttccaacaaatgcgggacgtgctcggcaccttcgacacagcacaaatcataaaactactccccttcgcggccgcaccgccaaaacagtcacgaatgcaattctcatccttcaccgtcaacgtaaggggaagtggaatgagaatcctggtccggggcaacagcccagtcttcaactacaacaaagctaccaaaaggctaaccgtcctaggaaaggacgcaggcacactaacggaagacccagacgaaggaacagccggcgtagaatccgccgtcctccgcggattcctcatcctcggaaaagaagacagaagatacggcccggccctcagcataaacgaactctcaaacctggccaaaggtgaaaaagcaaacgtactaattgggcagggagacgtagttctagtaatgaagcgaaaacgagacagcagtatcttaacagactcccaaacagctaccaaacgcatccgcatggcaataaac

SEQ ID NO: 59026 - RNA, 2472 nt, synthetic construct
  misc_feature 1..2472: note = derived and/or modified sequence opt11 from anti-influenza_Chain
  source 1..2472: mol_type = other RNA
atgatgctacgcaagaaaacgaaacaactcatcagctcaatactcatcctcgtattactactaagcctgttcccagccgcactggcagcagaaggcaacacacgcgaagacaacttcaaacacctccttgggaacgacaacgtaaaacggccaagcgaagcaggagccctccaactccaagaagtagacggccaaatgaccctagtagaccaacacggagaaaagatacaactccgcggcatgagcacgcacggactacaatggttcccagaaatactgaacgacaacgcctacaaggcactgtcaaacgactgggatagcaacatgatcaggctcgcgatgtacgtaggcgaaaacggctacgcaacaaacccagaactaataaaacaacgtgtaatcgacggcatagagctcgccatagaaaacgacatgtacgtaatcgtcgactggcacgtacacgcgcccggagaccccagagatccggtatacgcaggcgcgaaagacttcttccgagaaatagccgcactatatccaaacaacccacacatcatctacgagctagccaacgaaccatcctccaacaataacggtggagcaggaatacccaacaacgaagaaggatggaaagcagtcaaagaatacgcggacccaatcgtcgaaatgttacgaaaatccggcaacgcagacgacaacataataatagtggggagccccaattggagccaacgaccggacctcgccgcagacaacccaatcgacgaccaccacacaatgtacacagtccacttttacacaggatcacacgcagctagcaccgagtcctatccctccgagacccccaactcagaacggggaaacgtcatgtccaacactcgatacgccctcgaaaacggagtcgcggtattcgcaacagagtggggaacaagccaagcgagcggagacggaggaccatacttcgatgaagccgacgtctggatagagttcctgaatgaaaacaacatatcatgggccaactggtcattaacaaacaaaaacgaagtcagcggcgccttcacccccttcgaactcgggaaatcaaacgcgacaaacctagaccccggacccgaccacgtctgggcaccagaagaactgagcctatccggggagtacgtcagggccagaataaaaggcgtaaactacgaacccatagaccgcaccaaatacacgaaagtactctgggacttcaacgacggtaccaaacaagggttcggagtcaacagcgactcgccgaacaaggagctaatcgcagtcgacaacgaaaacaataccctgaaagtcagcggcctagacgtgagcaacgacgtcagcgacggcaacttctgggccaacgcacgacttagcgcaaatggatggggcaaaagcgttgacatactcggcgcagaaaaactaactatggacgtcatagtcgacgaaccgaccacggtagccatcgccgccataccccaaagcagcaaaagcggctgggcaaacccagaacgcgcggtacgcgtcaacgcagaggacttcgtccaacagacggacgggaaatacaaagcagggctaacaatcacgggagaagacgcaccaaacctcaaaaacatcgcatttcacgaagaagacaacaacatgaacaacataatactctttgtcggcaccgacgccgccgacgtgatatacctagacaacattaaagtcataggaaccgaagtagaaatcccagtcgttcacgaccccaagggggaggcagtacttccgtcagtattcgaagacggaacgagacaaggatgggactgggcaggcgagagcggcgtcaaaacagcactgaccatagaagaagcgaacggatccaacgccctaagctgggagttcgggtaccccgaagtcaaaccctccgacaattgggccaccgcacccaggctagacttctggaaaagcgacctcgtgagaggggagaacgactacgtagcattcgacttctacctcgacccagtcagagccaccgagggggccatgaacataaacctcgtctttcagccgcccaccaatgggtattgggtccaggcaccaaagacctatacgatcaacttcgacgaattagaagaggccaaccaagtaaacgggctctaccactacgaagtcaaaataaacgtcagagacataacgaacatccaagacgacacactcctccgaaacatgatgataatcttcgcagacgtagagagtgacttcgccggacgagtattcgtggacaatgtaagattcgaaggcgcagcaacaacagaacccgtggaacccgaaccagtagatcccggggaagagacacccccagtggacgagaaagaagccaagaaagaacaaaaggaagcagaaaaagaagaaaaagaagccgtcaaagaagaaaagaaagaagccaaagaagagaaaaaggcggtgaaaaacgaagccaaaaagaaa

SEQ ID NO: 59027 - RNA, 2472 nt, synthetic construct
  misc_feature 1..2472: note = derived and/or modified sequence opt11 from anti-influenza_Chain
  source 1..2472: mol_type = other RNA
atgatgctacgcaagaaaactaaacaactcatcagcagcatacttatcctagtactcctcttaagcctcttcccagcggcactcgcagcagaaggaaacacgcgagaagacaacttcaagcacctcctcgggaacgacaatgtcaaacgaccgagtgaagcaggggcactccaattacaagaggtagacgggcaaatgacactcgtagaccaacatggagagaaaatccagctacggggaatgagcactcacggcctccagtggtttcctgaaatactaaacgacaacgcctacaaagccctctccaatgactgggacagcaacatgatccgactcgcaatgtacgtaggagaaaacggctacgcaacgaacccagaactcataaaacaaagggtcatagacggcatcgagctagccatcgaaaacgacatgtacgtcatcgtggactggcacgtgcacgcccccggcgaccctcgagaccccgtatacgcgggcgccaaagacttcttccgcgaaatagctgccctctatccaaacaacccccacatcatatacgaactagcgaacgaaccctccagcaacaacaacggaggggcaggaatccccaacaacgaagaaggctggaaagcagtaaaggaatacgcggaccctatagtcgaaatgctaagaaaaagcggaaacgcggacgacaacataatcattgtcgggagcccaaactggagccagcgaccagacctagccgcggacaacccaatagacgaccaccatactatgtacaccgtccacttctacacaggatcgcacgccgccagcacagagtcatacccctccgaaacgccaaacagcgaaaggggcaacgtaatgtctaacacacgctacgcactcgaaaacggcgtagccgtattcgccacagaatggggaaccagccaagccagtggcgacggaggaccgtacttcgacgaagccgacgtctggatagagtttctaaacgagaacaacataagctgggccaactggagcctcaccaacaaaaacgaagtaagcggcgcattcacaccattcgaactcggcaaaagtaacgccacgaacctagatccagggccggaccacgtatgggccccggaagaactatcactctccggggaatatgtacgagcacgcataaagggggtcaactacgagcccatagacagaacaaaatacaccaaagttctttgggactttaacgacggcacgaaacagggttttggcgtcaactccgacagccccaacaaagaactcatagcagtagacaacgagaacaacactcttaaggtgtccggactagacgtatcaaacgacgtaagcgacggcaacttctgggctaacgccaggcttagcgcaaacggctgggggaagtccgtagacatcctaggcgccgaaaagctaacgatggacgtaatcgtagacgaaccaacaaccgtagcaatcgcagcgataccgcaaagctcaaagagcggttgggccaaccccgaacgcgccgtccgagtcaacgcagaagacttcgtacaacagaccgacggcaaatacaaggcaggacttaccatcacaggcgaggacgccccgaacctcaaaaacatagcctttcacgaagaagacaacaacatgaacaacataatcctcttcgtcggcaccgacgcagccgacgtcatatacctagacaacataaaggtcatcggaaccgaggtcgaaataccggtagtccatgatccaaaaggcgaagcagtgctccccagcgtattcgaagacgggaccagacaaggctgggactgggccggagaatcgggagtaaaaacagcactgacaatagaagaagcaaatgggagtaacgcactgagctgggagttcggatacccagaagtaaaacccagcgataactgggccacggcaccccgcctagacttctggaaaagcgacctcgtacgcggcgaaaacgactacgtggcgttcgacttctacctcgaccccgtacgggcaacagaaggagcaatgaacataaacctagtattccaaccgcccaccaacggatactgggtgcaagcacccaaaacttacaccatcaacttcgacgaactggaggaagcaaaccaagtcaacgggctataccactacgaagtgaaaatcaacgttcgcgacatcacgaacatacaagacgacacactactccgcaatatgatgattatcttcgccgacgtagaaagcgacttcgcgggtcgcgtcttcgtagacaacgtacgcttcgaaggagcggcgacaacagaaccagtagaacccgaacccgtggacccaggagaggaaacgcccccggtagacgaaaaggaagccaagaaagaacaaaaagaagccgaaaaagaagagaaagaagctgtcaaggaggaaaagaaagaggcaaaggaagaaaagaaagccgtcaaaaacgaggccaaaaagaaa

SEQ ID NO: 59028 - RNA, 3063 nt, synthetic construct
  misc_feature 1..3063: note = derived and/or modified sequence opt11 from anti-influenza_Chain
  source 1..3063: mol_type = other RNA
atggccggcccacacaggagccgagcagcaggaccgccacccttcgccgtcgacgaacacgtagcgctagagatggtagctttcagaggagaagtcttcgccggccacggcctactcgccgaccaacgacttattgcgcacacaggcagacctgccctaaacgcacaaagaataacacaacaaaaacagcgagaccaatgccgaggacaacgacaccggcaccaccaaggaggtcgaaacctccgaaaagctcaccgcacgttccacgaacaccagtccacgcaagaccaagcacacgatgccccacacggccaacaggcaaaaacagggcacgaaggcctgggccatgaacacgcacaagcccagcaccaacaaggtcagtcgaacgtagtagacagacaggacggggaacccgtggaggcacagcaccaaaaagacggcgcacaacgcgccggcaacgcacccgcgggacgagtcgaactagaacaacagccagtagaagcacaacatcaacagcaagagggcgacgttagaataggaaaacgacgacaaaacgcctttgcaccgcctgcactagaccacgtccatggcggaccaggccgcctacaaagacacggactcgcagtagaacgccacgtcccggccgtccaacagcaccagcagcgagtacaacgcggacgccaacaaatagaccatgtcctaggccatggcctacccggccgccaacgccttgccttccgcgacggcccaagacgacctgtaggagtagcctcccccgtactcggacagagaccatgtcctggacaccggatcgtacaaaacctcttccgtcacggaatcgacccgtgcagagtcggacgttgccgccgatcaccgagcgagctgcacggtatggggtgcgcagacgtccgagcaagaggccacgggcgacacatgcgcggacaacgagatgagcacccgggtagaggcagaccttgcgcccgccgcagacacgtcgacgacgacagagaccgcacaccacaagaaaaactatacgacgtagcaagaggcttagacgaaccagcccgaagagtccatttcgacgatgaggcagacagatccgtattccgaggcctagcccaaccagcccccgatgaacccgaaggccgaagacgagaccgcctagtactgcagcgacaatcagtgaaccacaggagaggacgcttaagcaggcaccgtcaacaacaccagccacagcaacagagaccccacgggaaccaagcattcctaggcaaatacgagaaaagacggagaaaacctaccgcatgcctcaagtcgctacgacgtttcccagacaaggacgcaccagtactctatttcgtgaaccaactcgagaaaaccaaacggaggatgaccctgctattagtctggctaatattcacgggtgtagccggcgaaatacgactcgaagcagaagacggcgaactactcggagtagccgtagacagcacactaacaggttactccgggcgaggttatgtcacgggatttgacgcgccagaagactcagtcagattctccttcgaagcaccaaggggagtataccgcgttgtcttcggagtctcattcagttcacgattcgcctcctacgcactccgggtcgacgactggcaccaaacaggaagcctgataaaacgaggaggcggattcttcgaagccagcatcggcgagatttggctagacgaaggcgctcacaccatggcttttcaactaatgaacggtgcccttgactacgtgagactcgaaccggtatcatacggaccaccagcacgcccaccggcccaactctctgactcacaagcgaccgcgagcgcacaagccctcttcgcatttctactgtcagaatacggtagacacatactagcaggacaacaacaaaacccctaccgcagagacttcgacgcaatcaactacgtccgcaatgtcacaggaaaagaacccgcccttgtctcattcgacctcattgactactcaccaacccgcgaagcacacggggtagtacactaccagacaccagaagactggatcgcatgggcaggccgggacggcatcgtatcactcatgtggcactggaatgccccaaccgacctcatagaagacccaagccaagactgctactggtggtacggcttctacaccagatgcactacgttcgacgtcgcagcagccctagcagacacatccagcgaaagatacagattgctactcagggacatcgacgtcatcgcggcccaactccagaaattccaacaggccgacatccccgtcctatggcggccactacacgaagccgccggagggtggttctggtggggcgcaaaagggcccgaaccattcaaacaactatggcgattactttacgaaagactcgtgcaccaccatgggttgcataacctaatatgggtatatacccacgaaccaggtgccgccgaatggtaccccggagacgcatacgtagacatagtaggacgcgacgtatacgccgacgacccagatgccctgatgagatcagactggaacgagctccaaactctattcggcggccgtaagctagtcgcgctaacagagacgggtacactacccgacgtagaagtaataacagactacggcatatggtggagctggttctccatctggaccgacccatttttaagagacgtcgatccagaccggctcacacgcgtgtatcacagcgagcgagtcttaaccagagacgaattacccgactggagaagctacgtcttacacgcaaccaccgtacagcccgcaggggacctcgcgctagcagtataccccaacccaggagccggacgactccacgtagaagttggcttacctgtcgcagccccagtagtagtagaagtattcaatcttctcggacaacgagtgttccaataccaagcaggtatgcaacccgcaggcctctggcgccgagcctttgagctcgcgctcgcgccaggagtctacctcgtacaggtacgcgccggaaacctagtagcaagaagaaggtgggtatctgtccgt

SEQ ID NO: 59029 - RNA, 3063 nt, synthetic construct
  misc_feature 1..3063: note = derived and/or modified sequence opt11 from anti-influenza_Chain
  source 1..3063: mol_type = other RNA
atggcgggaccccacagaagcagagccgcggggcccccacccttcgccgtagacgaacatgtggcgctagaaatggtggccttcagaggcgaagtattcgccggccatggcctcctcgcagaccaacgactcatcgcccacactggaagacccgccctcaacgcgcaacgaataacccaacaaaaacagagagatcaatgccgaggtcaaaggcacagacaccaccagggcggcagaaacctacgaaaagcgcacagaaccttccacgagcaccaatcaacacaagaccaagcacacgacgcaccacacggccaacaagcaaaaaccggacacgagggactcggccacgaacacgcccaggcacaacaccaacaaggacagagtaacgtcgtagaccgccaggatggcgaaccggtagaagcgcaacatcaaaaggacggcgcgcaaagagccggcaacgcacccgcagggagagtagaactggaacaacaaccggtagaagcgcaacaccagcaacaagaaggcgacgtacgaatcgggaaacgacgacaaaacgccttcgcgcccccagccctcgaccatgtacacggagggcccggtcgactgcagagacatggcctcgcagttgagcgccacgtaccagcagtccaacaacatcaacaacgcgtccaaagagggcgacaacagatcgaccacgtactaggccacggtctcccaggaagacaacgactcgcgttccgagacggaccacggcgcccagtaggcgtagcctccccagtactcggccaacgcccctgcccaggccacagaatcgtacagaacctctttagacacggaatagacccctgccgagtcggacgatgccgacgcagccccagcgaactacacggaatgggttgcgccgacgtaagagcgcggggacacggcagacatatgcgaggacaaagagacgaacacccagggcgaggaagaccatgcgcacgaagaagacacgtcgatgacgaccgagacaggacgccccaagaaaaactatacgacgtggcacgcggactagacgagccagcacggagagtccacttcgatgacgaagccgaccggagcgtcttcagaggactagcccaacccgcaccggacgagccggaaggccgcagacgcgatcgcctagtattacaaagacaaagcgtaaaccaccgaaggggtcgtctatcccgacatcgccaacaacaccagccccaacaacaacgtccacacggaaaccaggctttcctaggaaagtacgaaaaacggagacggaaaccaaccgcgtgcctaaaaagcctgcggcgcttcccagacaaagacgcacctgtactctacttcgtaaaccagctagagaaaaccaaacgccgcatgacgctcctactcgtgtggctgatatttactggcgtcgcaggcgaaataagactcgaagcagaagacggcgaactcctaggcgtcgccgtcgactccacactaacaggatactcgggacgcggctacgtcacaggcttcgatgcccccgaagattccgtgagattctccttcgaggccccgcgaggagtataccgggtagtattcggcgtatcttttagctcacgattcgctagctatgcgctgagagtagacgactggcaccaaaccgggagccttataaagaggggaggcggatttttcgaagcatctataggagaaatatggctagacgaaggggcacacacaatggcattccaactcatgaacggcgcactagattacgttcgcttagagccagtatcctacggaccgcccgcccgcccacccgcacagctcagcgactcccaagctacagcgagcgcccaagcactcttcgccttcctactctccgaatatggaagacacatactagcagggcaacaacaaaacccctacagacgcgacttcgacgccataaactacgtacgaaacgtcactggaaaggaaccagccctagtatccttcgacctaatagactactcccccacccgagaggcacacggagtagtccactaccagacacccgaagattggatagcgtgggcaggccgcgacggcatcgtttcattaatgtggcactggaacgcacccacagacctcatcgaagacccctcgcaagactgctactggtggtacggattttacacccgatgcacaactttcgacgtcgcagcagcactcgccgacacaagctctgaacgctaccgactcctcttacgagacatagacgtaatagcagcacaactgcagaaattccaacaagcagacatcccagtcctatggagaccactccacgaggccgcaggaggatggttctggtggggagcaaaaggccccgaaccattcaaacaactctggcgactactctacgaacgactcgtccaccaccacggcttacacaacctgatctgggtatacacccacgaaccaggggctgcggagtggtacccaggcgacgcatacgtagacatcgtcggacgagacgtctatgccgacgaccccgacgcgctaatgcgctcagactggaacgaattacaaacgcttttcgggggcaggaaactcgtagccctcacagaaacgggtaccctaccagacgtagaagtaatcacggactacggaatctggtggtcctggttcagcatatggaccgacccatttctacgagacgtcgacccagacagactcactcgcgtgtaccacagcgagcgcgtccttacccgcgacgaactccctgattggagaagttacgtgctccacgcgacaacggtccaacccgcaggcgaccttgccctagcagtgtaccctaaccccggagcgggtcgcctacacgtggaagtcggactaccagtagctgcaccagtcgtcgtagaagtctttaatctgttaggccagcgcgtcttccaataccaagcaggaatgcaaccggccggcctttggcgacgcgctttcgaactggcccttgcgcccggcgtataccttgtccaagtcagagcgggaaacctagttgcccgccgtcgatgggtgtccgtacgg

SEQ ID NO: 59030 - RNA, 3165 nt, synthetic construct
  misc_feature 1..3165: note = derived and/or modified sequence opt11 from anti-influenza_Chain
  source 1..3165: mol_type = other RNA
atgcgcaagaagcggcgcggcttcctgaacgccagcacagccgtgctcgtcgggatcctggcgggcttcctaggcgtggtgctcgccgccaccggcgccctggggttcgccgtccgggagtccctcctcctgaagcagttcttattcctcagcttcgagggcaacacggacggcgcctcccccttcgggaaggacgtggtggtcaccgccagccaggacgtggccgccgacggcgagtactccctgaaggtggagaaccgcacctccgtctgggatggggtggagatcgatctgaccggcaaagtgaacacggggaccgactacctcctgtccttccacgtctaccagaccagcgactcaccgcagctgttcagcgtgctggcgcggaccgaggacgagaagggcgagcgctacaagatcctggccgacaaggttgtcgtgcccaactactggaaggagatcctggtgcccttctcccccacgttcgagggcacgccggccaagttcagcctcatcatcacctcccccaagaagactgacttcgtcttctacgtggacaacgtgcaggtcctgacgcccaaagaggccgggcccaaagtggtgtacgagaccagcttcgagaagggcatcggggactggcagccgcggggctccgacgtcaagattagcatctcccccaaggtggcccacagcggcaagaagtccctcttcgtcagcaacaggcagaaggggtggcacggcgcgcagatcagcttgaaggggatccttaagaccggcaagacctacgccttcgaagcctgggtgtaccaggagtccgggcaggaccagactatcatcatgaccatgcagcggaagtacagctccgacagctccaccaagtatgagtggatcaaagccgccaccgtccccagcggccagtgggtccagctgtccggcacgtacaccatccccgcgggggtgaccgtggaggacctcacactgtacttcgagtcccagaacccgacgctggagttctacgtcgacgacgtgaaggtggtcgacaccacctccgccgagatcaagctcgagatgaaccccgaggaggagatccccgccctgaaggacgtgctgaaggactacttccgcgtgggcgtcgccctccccagcaaggtgtttatcaaccagaaggacatcgccctgatctccaagcacagcaactccagcaccgcggagaacgagatgaagccggactcccttctcgccgggatcgagaacggcaagctgaagttccggttcgagacggccgacaagtacatagagttcgcccagcagaacgggatggtggtccgcggccacaccctggtgtggcacaaccagacccccgagtggttcttcaaggacgagaacggcaacctcctgagcaaggaggagatgaccgagcggctgcgcgagtacatccacacggtggtcggacatttcaagggcaaggtgtacgcctgggacgtggtcaacgaggcggtggaccccaaccagcccgacgggctccggcgctccacctggtaccagatcatgggccccgactacatcgagctggccttcaagttcgcccgggaggccgaccccaacgcgaagctgttctacaacgattacaacaccttcgagcccaagaagcgcgacatcatctacaaccttgtcaagtctctgaaagaaaaggggctgatcgacggcatcggcatgcagtgtcatatctccctcgccaccgacatccggcagatcgaggaggccatcaagaagttcagcacgatacccgggatcgagatccacatcaccgagctggacatcagcgtgtaccgcgactccacaagcaactactccgaggcgccgagaaccgccctgatcgagcaggcgcacaagatggcccagctgttcaagatcttcaagaagtacagcaacgtgatcaccaacgtgacgttctggggcttaaaggacgactactcctggcgcgccacccgccggaacgactggccactgatcttcgacaaggactaccaggccaagctggcctactgggcgatcgtcgcccccgaggtgctgcccccgctccccaaagagagtaagatctccgagggggaggccgtggtcgtgggcatgatggacgacagctacatgatgtccaagcccattgagatctacgacgaggagggcaacgtgaaggccaccatccgcgccatctggaaggacagcaccatctacgtctacggagaggtgcaggacgcgacgaagaagccggcggaggacggcgtggccatcttcataaatcccaacaacgagcggaccccctacctgcagcccgacgacacctacgtcgtgctctggaccaactggaagtccgaggtgaaccgcgaggacgtcgaggtgaagaagttcgtgggaccgggcttccggcgctacagcttcgagatgtccatcacgatccccggggtcgagttcaagaaagacagctacatcggcttcgacgtggccgtgatcgacgatggcaagtggtactcctggagcgacaccaccaactcccagaagaccaacacgatgaactacgggaccctgaagctggagggcgttatggtggcgaccgccaagtacgggacccccgtgatcgacggcgagatagacgacatctggaacacgaccgaggagatcgagaccaagagcgtcgccatggggagcctcgagaagaacgccaccgccaaggtgcgggtgctgtgggacgaggagaacctgtacgtcctcgcgatcgtgaaggaccccgtcctgaacaaggacaactccaacccgtgggagcaggatagcgtggagatcttcatcgacgagaacaaccacaagaccggttactacgaggacgacgacgcccagttccgcgtgaactacatgaacgagcagtccttcggcaccggggccagcgccgcccggttcaagaccgcggtcaagctgatcgagggcgggtacatcgtggaggccgccatcaagtggaagaccatcaagccctcccccaacacggtgataggcttcaacgtccaggtgaacgacgccaacgagaaggggcagcgcgtgggcatcatcagctggtcagaccccaccaacaacagctggcgggacccgtccaagttcggcaatctacgcctgatcaaa

SEQ ID NO: 59031 - RNA, 3165 nt, synthetic construct
  misc_feature 1..3165: note = derived and/or modified sequence opt11 from anti-influenza_Chain
  source 1..3165: mol_type = other RNA
atgcgcaagaagcggcgcggcttcctgaacgccagcaccgccgtgctcgtcgggatcctggcgggcttcctgggggtggtgctcgccgcgaccggcgccctggggttcgccgtgcgggagtccctgctcctgaagcagtttttattcctcagcttcgagggcaacacggacggcgcgtcccccttcgggaaggacgtggtagtcaccgccagccaggacgtggccgccgacggagagtactccctcaaggtggagaaccgcacgagcgtctgggacggggtggaaatcgacctgacgggcaaggtgaacacggggaccgactacctcctgtccttccatgtctaccagaccagcgactccccgcagctgttcagcgtgctcgcgcggaccgaggacgagaagggcgagcgctacaagatactggccgacaaggtggtcgtgcctaactactggaaggaaatccttgtgcccttttcccccacgttcgagggcaccccggccaagttcagcctcatcatcacgtcccccaagaagaccgacttcgtcttttacgtggacaacgtgcaggtcctgacgcccaaggaggctgggcccaaggtggtttacgagaccagcttcgagaagggcatcggggactggcagccgcggggctccgacgtcaagatcagcatcagccccaaggtggcccacagcggcaagaagtccctgttcgtctcgaatcgccagaaggggtggcacggcgcgcagatctcactcaagggcatcctgaagaccggtaaaacctacgccttcgaagcctgggtgtaccaggagtccggacaggaccagacgatcatcatgaccatgcagcggaagtacagctccgacagctccaccaagtacgagtggatcaaggccgccaccgtgcccagcggccagtgggtccagctgtccggcacgtacaccatccccgcgggggtgaccgtggaggacctcaccctgtacttcgagagccaaaatccgacgttagagttctacgtcgacgacgtgaaggtagtcgataccacctccgccgagatcaagctcgagatgaaccccgaggaggagatccccgctctgaaggacgtgctgaaggactacttccgcgtgggcgtcgcactccccagcaaggtgttcatcaaccagaaggacatcgccctgatctccaagcacagcaactccagcaccgcggagaatgagatgaagccggactcgctgctcgccgggatcgagaacggaaagctgaagttccgtttcgagacggccgacaaatacatcgagttcgcccagcaaaatggtatggtggtccgcggccacaccctcgtgtggcacaaccagacccccgagtggttcttcaaggacgagaacggtaacctcctgtctaaggaggagatgaccgagcggctgcgcgagtacatccacacggtggtcggccacttcaagggcaaagtgtacgcgtgggacgtcgtcaatgaagcggtggaccccaatcagcccgacgggctccggcgctccacctggtaccagatcatgggacctgactacatcgagctggccttcaagttcgcacgggaggccgaccccaacgcgaagctgttctacaacgactacaataccttcgagcccaagaaacgcgacatcatctacaacctcgtcaaaagcctgaaggagaagggcctgatcgacggcattggcatgcagtgccacatctccctcgccaccgacatccgtcagatcgaggaggccatcaagaagttcagcacgattccggggatcgagatccatatcaccgaactggacatcagcgtgtaccgcgactccacttctaactactccgaggccccgcggaccgccctgattgagcaggcgcacaagatggcccagctattcaagatcttcaaaaagtacagcaacgtgatcaccaacgtgacgttctggggcctcaaggacgactactcatggcgcgccacccgtcgaaacgactggcccctgatcttcgacaaggactaccaggctaagctggcctactgggcgatcgtcgcccccgaagtcctgcccccgctccccaaggagagcaagatatccgaaggagaagcagtggtcgtgggcatgatggacgatagctacatgatgtcgaagcccatcgagatctacgacgaggagggcaatgtgaaggcaaccatccgggccatctggaaggacagcaccatctacgtctacggggaggtgcaggacgcgacgaagaagccggccgaggatggcgtggccatcttcatcaaccccaacaacgagcggaccccctacctgcagcccgacgacacctacgtcgtgctctggaccaactggaagtccgaggtgaaccgcgaggacgtcgaggtgaagaagtttgtgggaccgggcttccgccgctacagcttcgagatgtccatcacgatccccggggtggagttcaagaaggacagctacattggcttcgacgtagccgtgatcgatgacggcaagtggtactcctggagcgacaccacgaactcccagaaaaccaacacgatgaactacgggaccctgaagctggagggcgtcatggtggcaaccgccaagtacggcacccccgtgatcgacggcgagatagacgacatttggaacaccaccgaggagatcgagaccaaaagcgtcgccatggggagcctcgaaaagaacgccaccgccaaggtgcgggtgctgtgggacgaggagaacctgtacgtcctcgcgatcgtgaaggatcccgtcctgaacaaggacaactccaacccgtgggagcaagacagcgtggagatcttcatagacgagaacaaccacaagacgggctattacgaggacgacgatgcccagttccgcgtgaactacatgaacgagcagtccttcggcaccggtgccagcgccgcccggttcaagaccgcggtcaagctgatcgagggcgggtacattgttgaggccgccatcaagtggaagactatcaagccctcccccaacacggtgatcggcttcaacgtccaggtcaacgacgccaacgagaagggccagcgcgttggcatcataagctggtccgaccccaccaacaacagctggcgggacccgtccaagtttggcaacctccgcctgatcaaa

SEQ ID NO: 59032 - RNA, 3177 nt, synthetic construct
  misc_feature 1..3177: note = derived and/or modified sequence opt11 from anti-influenza_Chain
  source 1..3177: mol_type = other RNA
atgcaggttagaaaacgccgagggctgctcgatgtgagcaccgcggtgctcgtaggaatactagcaggattcctaggggtagtcctggcagcgagcggagtgctatcgttcggcaaggaggcctcatcgaaaggcgactcatccctagaaacagtcttagccctcagctttgaaggcaccaccgaaggggtcgtacccttcggtaaggacgtagtcctcaccgcctcacaggacgtagctgccgacggggaatactccctaaaggtagaaaaccgcacctccccctgggacggcgtggagatcgatctaaccggaaaagtaaaatccggcgcagactacctgctgagcttccaagtgtaccaaagctcggacgccccacaactgttcaacgtcgtcgcacgcacggaggacgaaaaaggtgaacgatacgacgtaatactcgacaaggtcgtcgtatcagaccactggaaggaaattctcgtaccttttagccccaccttcgagggcaccccagcaaaatacagcctaattatagtcgcctccaaaaacacgaacttcaacttctacctcgacaaagtacaagtactagcgccaaaagaatcaggacctaaagtgatatacgaaacatcattcgaaaacggcgtcggcgactggcagccccgaggtgacgtcaacatagaggccagctccgaagtagcgcacagcggaaaatcctcactgttcatctcaaaccgccagaaaggctggcagggagcacaaatcaatcttaagggaatcctaaaaaccggaaaaacgtacgcattcgaggcctgggtgtaccagaacagcggacaggaccaaacaatcataatgaccatgcagaggaaatactcaagtgatgcatccacgcaatacgagtggataaagtcagcgacagtcccaagcggccaatgggtccaactaagcggcacctacacaataccagcaggggtgacagtagaagatctcaccttatacttcgagagtcagaaccccaccctagaattttacgtagacgacgtcaaaatcgtcgataccacaagcgccgaaataaaaattgaaatggaaccggagaaggagatcccggccctaaaggaagtactcaaggactatttcaaagtaggagtcgccttaccatcaaaagtattcctcaaccccaaggacatagaactcatcacaaaacactttaactccataaccgcagaaaacgagatgaaaccagagtcccttttagccggaatcgagaacggaaaactaaagttccgattcgaaaccgctgacaaatacatccaattcgtagaagagaacggcatggtcatacgaggacacacactcgtgtggcacaaccaaaccccagactggttcttcaaagatgagaacgggaatcttctctcaaaagaagccatgaccgaaagactgaaagaatacatccacacagtcgtaggccacttcaaaggcaaagtatacgcatgggacgtcgtcaacgaagcagtagacccgaaccaacccgacggattacgacgctccacctggtaccaaataatggggcccgattacatcgaactggcattcaaattcgcccgcgaagcagaccccgacgctaaacttttctacaacgactataatacatttgagccccgcaaacgagacataatctacaacctcgtcaaagacctcaaagagaaagggcttatcgacgggatcggcatgcaatgccacataagccttgcaaccgacatcaaacaaatcgaggaggccataaagaagttctcgaccataccgggaatcgaaatccacataaccgagcttgacatgagcgtataccgagacagctccagcaactacccggaggcaccccgaacggcgctaatcgaacaagcgcacaagatgatgcagctgtttgaaatcttcaagaagtactcaaacgtaataaccaacgtaacattctggggcctcaaggacgactacagctggcgcgcaactcgccgcaacgattggcccctcatattcgacaaagaccatcaagccaaactagcctactgggcgatcgtcgcccccgaggtcctcccacccctccccaaagaatcccgaatctccgaaggagaggcagtagtcgtcggcatgatggacgactcctatctcatgagcaaacccatcgaaatcctagacgaagaaggtaacgtcaaagccaccataagagcagtatggaaagacagcaccatctacatatacggggaagtacaagacaaaacgaaaaagccggccgaagacggcgtagcaatattcataaacccaaataacgagcgtactccatacctccaaccagacgacacctacgccgtcctctggaccaactggaaaaccgaagtaaaccgagaggacgtccaggtcaagaaatttgtcggaccagggttccgaagatacagcttcgaaatgagcatcacaatcccaggcgtcgagttcaagaaagacagttacatcggattcgacgcagcagtaatagacgatggaaaatggtactcttggagcgacaccaccaattcacagaaaactaacaccatgaactatggaaccctcaaactagaaggcatcatggtcgcgaccgcaaagtacggcacgcccgtaatagacggcgaaatagatgaaatctggaataccacagaagaaatcgagaccaaagccgtggccatgggatccctggacaaaaacgccaccgcaaaagtcagggtactatgggacgaaaattatctatacgtcttagccatcgtcaaagaccccgtcctcaacaaagacaactcaaacccatgggagcaagacagtgtcgagatattcatcgacgaaaacaaccacaagaccggatattatgaagatgatgatgcacaattccgagtaaactacatgaacgaacaaaccttcggaaccggcgggagcccagcacggttcaaaaccgccgtcaaattaatcgaaggaggctacatcgtggaggcagccataaaatggaagaccatcaagccaacgccaaatacagtaataggattcaatatacaggtgaatgacgccaacgaaaaaggccaacgcgtgggcataattagctggtcagaccccaccaacaattcatggcgcgacccatccaagttcgggaaccttcgcctaatcaaa

SEQ ID NO: 59033 - RNA, 3177 nt, synthetic construct
  misc_feature 1..3177: note = derived and/or modified sequence opt11 from anti-influenza_Chain
  source 1..3177: mol_type = other RNA
atgcaggtacggaaacgccgaggactactggacgtcagcacagctgtcctagtaggaatcctagcagggttcctcggggtggtactcgcagcctccggcgtgctcagcttcggaaaggaagccagttcgaaaggggacagcagtctagagacagtcctagccctcagcttcgaaggcacaaccgaaggcgtggtccctttcggaaaagacgtcgtcctaaccgcaagccaggacgtagcagccgacggcgagtacagcctcaaagtcgaaaaccgaacatccccatgggacggagtcgaaatcgatctaaccggcaaagtcaaatctggcgccgactacctcctcagcttccaagtttaccaaagctccgacgcaccacagctttttaatgtcgtcgcccgcacggaggacgaaaaaggagagaggtacgacgtcatcctcgacaaggtagtcgtatccgaccactggaaagaaatcttagtaccattctcgccaacgttcgaaggcacgccagcaaaatacagcctaataatagtggcgagcaaaaacaccaacttcaacttttacctcgacaaagtacaggtactagccccgaaggaatcaggccccaaggtcatctatgaaacatccttcgaaaacggcgtcggcgactggcaaccaagaggggacgtaaacatagaagcgtcatccgaagtcgcacactcaggcaaaagctcactgttcataagtaacaggcagaaaggctggcagggcgcacaaataaacctgaaagggattctaaaaacaggcaagacctacgcattcgaagcgtgggtgtaccaaaactcaggccaggaccaaacgataatcatgacaatgcaacgcaagtactcgtccgacgccagcacgcaatacgagtggataaagtcggcaacagtgccaagcgggcaatgggtccagctaagcggcacgtacacgataccagccggcgtcacagttgaagatctcacgctatactttgaaagccaaaaccccacactagagttctacgtcgacgacgtaaaaatcgtcgacacgaccagcgccgaaatcaagatcgaaatggaacccgaaaaagaaatcccagccctaaaagaagtcctaaaagactacttcaaggtaggagtcgccctacccagtaaagtcttcctaaacccgaaagacattgaactgatcacaaaacacttcaacagtataaccgcagaaaacgagatgaaaccagagagcctcctagccggcatcgaaaacggcaagctaaaattccgcttcgaaacagcagataagtacattcaattcgtcgaagaaaacggcatggtgatacgtggacacaccctagtctggcacaaccaaaccccggactggttcttcaaagacgaaaacggcaacctgctatctaaagaggccatgacagaacgactcaaagagtacatacacaccgtagtaggacacttcaaagggaaagtttacgcgtgggacgtagtaaatgaggccgtcgatccaaaccagcccgacggactcagacgctcaacatggtaccaaatcatgggcccggactacatcgaactcgcctttaagttcgccagggaagcagacccagacgccaaactgttctacaacgactacaacaccttcgaaccgcggaagagggacatcatctacaacctcgtgaaagacttgaaagagaaaggtctgatagacggcatcggcatgcaatgccacataagcctagccactgacataaaacaaatcgaggaagctatcaagaaattcagcacaatacccggaatcgaaattcacatcaccgaactggacatgtcagtctaccgagactcgtcgtcgaactatccagaagcaccccgaacggccctcatcgaacaagcacacaaaatgatgcaactctttgaaatattcaagaaatattcgaacgtaatcacaaacgttaccttctggggcctcaaagacgactactcttggagggcaacccgacgcaacgactggccattaatcttcgacaaagaccatcaagctaaactcgcatactgggcaatcgtcgcgcccgaagtactgccacccctacccaaagaatcccggatcagtgaaggcgaagccgtcgtagtaggtatgatggacgacagctacctgatgagcaaaccaatcgaaatactcgacgaggagggaaacgtaaaagcaaccatccgtgctgtatggaaagacagcaccatctacatatacggcgaagttcaagacaagaccaagaaaccagcagaagacggcgtcgcgatcttcatcaatccaaacaatgaacgcaccccctacctacagcctgatgacacctacgccgtcctatggaccaactggaaaaccgaggtaaacagagaggacgtccaagtcaagaaattcgtgggccctgggttcagacgttacagcttcgagatgtccatcacaattccaggggtagagttcaagaaagacagctacatcggtttcgatgcggcggttatcgacgacggaaaatggtacagctggtcagacacgacgaacagccagaaaaccaacaccatgaactatgggaccctaaaactcgagggtatcatggtagccaccgccaaatatggcacacccgtgatcgacggagagatcgacgaaatatggaacaccacagaagaaatcgaaactaaggcagtcgccatgggcagtctcgacaaaaacgccacagccaaagtaagagtactatgggacgaaaactacctatatgtactcgcgatagttaaagaccctgtactgaacaaggacaactccaacccatgggaacaagactcggtagaaatctttatcgacgagaacaaccacaaaacaggctactacgaagacgacgacgcccaattccgagtaaactacatgaacgaacaaaccttcggcaccggcggctcaccagcgcggttcaaaacagcagtaaagctcatcgaagggggatacatagtcgaggcggcgatcaaatggaaaaccataaaacccacccccaacaccgtaatcggattcaacatacaagtcaatgacgcaaacgaaaaaggacaacgggtcggcatcatcagctggagcgatcccaccaataactcatggcgcgaccccagcaaattcggcaacctacgtctgatcaaa

SEQ ID NO: 59034 - RNA, 318 nt, synthetic construct
  misc_feature 1..318: note = derived and/or modified sequence opt11 from anti-OX40_LightChain
  source 1..318: mol_type = other RNA
gaaatcgtcgtcacccaatcccccgccaccctctccctctcccccggcgaacgcgccaccctctcctgccgcgcctcccaatccgtctcctcctacctcgcctggtaccaacaaaaacccggccaagccccccgactcctcatctacgacgcctccaaccgcgccaccggcatccccgcccgattctccggctccggctccggcaccgacttcaccctcaccatctcctccctcgaacccgaagacttcgccgtctactactgccaacaacgctccaactggcccaccttcggccaaggcaccaaagtcgaaatcaaa

SEQ ID NO: 59035 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaaggcatctcctcctggctcgcctggtaccaacaaaaacccgaaaaagcccccaaatccctcatctacgccgcctcatccctccaatccggcgtcccctcccgcttctccggctccggctccggcaccgacttcaccctcaccatctcctccctccaacccgaagacttcgccacctactactgccaacaatacaactcctacccccccaccttcggcggcggcaccaaagtcgaaatcaaa

SEQ ID NO: 59036 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagcccccaaactcctcatctactacacctcccgcctccgctccggcgtcccctcccgcttctccggctccggctccggcaccgacttcaccctcaccatctcctccctccaacccgaagacttcgccacctactactgccaacaaggccacaccctcccccccaccttcggccaaggcaccaaagtcgaaatcaaa

SEQ ID NO: 59037 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgagtcaccatcacctgccgcgcctcccaagacatctccaactacctcaactggtaccaacaaaaacccggcaaaaccgtcaaactcctcatctactacacctcccgcctccgctccggcgtcccctcccgcttctccggctccggctccggcaccgacttcaccctcaccatctcctccctccaacccgaagacttcgccacctactactgccaacaaggccacaccctcccccccaccttcggccaaggcaccaaagtcgaaatcaaa

SEQ ID NO: 59038 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaaaccgtcaaactcctcatctactacacctcccgcctccgctccggcgtcccctcccgattctccggctccggctccggcaaagactacaccctcaccatctcctcactccaacccgaagacttcgccacctacttctgccaacaaggccacaccctcccccccaccttcggccaaggcaccaaagtcgaaatcaaa

SEQ ID NO: 59039 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacatgccgcgcctcccaagacatctccaactacctcaactggtaccaacaaaaacccggcaaagcccccaaactcctaatctactacacctcccgcctccgatccggcgtcccctcccgcttctccggctccggctccggcaccgacttcaccctcaccatctcctccctccaacccgaagacttcgccacctactactgccaacaaggccacaccctccccgccaccttcggccaaggcaccaaagtcgaaatcaaa

SEQ ID NO: 59040 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagcccccaaactcctcatctactacacctcccgcctccgctccggcgtcccctcccgcttctccggctccggctccggcaccgacttcaccctcaccatctcctccctccaacccgaagacttcgccacctactactgccaacaaggccacaccgccccccccaccttcggccaaggcaccaaagtcgaaatcaaa

SEQ ID NO: 59041 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacatgccgcgcctcccaagacatctccaactacctcaactggtaccaacaaaaacccggcaaagcccccaaactcctcatatactacacctcccgcctccgctccggcgtcccctcccgcttctccggctcaggctccggcaccgacttcaccctcaccatctcctccctccaacccgaagacttcgccacctactactgccaacaaggcgccaccctcccccccaccttcggccaaggcaccaaagtcgaaatcaaa

SEQ ID NO: 59042 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagcccccaaactcctcatctactacacctcccgcctccgctcaggcgtcccctcccgcttctccggctccggctccggcaccgacttcaccctcaccatctcctcactccaacccgaagacttcgccacctactactgccaacaaggccacgccctcccccccaccttcggccaaggcaccaaagtcgaaatcaaa

SEQ ID NO: 59043 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctatccgcctccgtcggcgaccgcgtcaccatcacctgccgcgcctcccaagacatctccaactacctcaactggtaccaacaaaaacccggcaaagcccccaaactcctcatctactacacctcccgcctccgctccggcgtcccctcccgcttctccggctccggctccggcaccgacttcaccctcaccatctcctccctccaacccgaagacttcgccacctactactgccaacaagcccacaccctcccccccaccttcggccaaggcaccaaagtcgaaatcaaa

SEQ ID NO: 59044 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagcccccaaactcctcatctactacacctcccgcctccgctccggcgtcccctcccgattctccggctccggctccggcaccgacttcaccctcaccatctcctccctccaacccgaagacttcgccacctactactgccaacaaggccacaccctcgcccccaccttcggccaaggcaccaaagtcgaaatcaaa

SEQ ID NO: 59045 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagcccccaaactcctcatctactacacctcccgcctccgctccggcgtcccctcccgcttctccggctccggctccggcaccgacttcaccctcaccatctcctccctccaacccgaagacttcgccacctactactgccaagccggccacaccctcccccccaccttcggccaaggcaccaaagtcgaaatcaaa

SEQ ID NO: 59046 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagcccccaaactcctcatctactacacctccaaactccactccggcgtcccctcacgcttctccggctcaggctccggcaccgactacaccctcaccatctcctccctccaacccgaagacttcgccacctactactgccaacaaggctccgccctcccctggaccttcggccaaggcaccaaagtcgaaatcaaa

SEQ ID NO: 59047 - RNA, 321 nt, synthetic construct
  misc_feature 1..321: note = derived and/or modified sequence opt11 from anti-OX40_LightChain
  source 1..321: mol_type = other RNA
gacatccaaatgacccaatccccctcctccctctccgcctccgtcggcgaccgcgtcaccatcacctgccgcgcctcccaagacatctccaactacctcaactggtaccaacaaaaacccggcaaagccgtcaaactcctcatctactacacctccaaactccactccggcgtcccctcccgcttctccggctccggctcccgcaccgactacaccctcaccatctcctccctccaacccgaagacttcgccacctactactgccaacaaggctccgccctcccctggaccttcggccaaggcaccaaagtcgaaatcaaa

SEQ ID NO: 59048 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggagccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggactcgagctataaccagaaatttcgcgagcgcgtaaccataaccagggacacgagcacgagcacggcctatctcgagctctcgagcttgcgctcggaagataccgcggtctattactgtgtcttggccccgcgctggtactttagcgtgtgggggcaagggaccttggtcacggtctcgagc

SEQ ID NO: 59049 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggactcgagctataaccagaaatttcgcgagcgcgtgaccataaccgtggacacgagcacgagcacggcctatctcgagctctcgagcttgagatcggaagataccgcggtctattactgtgtcctggccccgcgctggtactttagcgtgtgggggcaagggaccttggtcacggtctcgagc

SEQ ID NO: 59050 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcagacaagcgcccgggcaagggctcgagtggataggcgatatgtatcccgataacggggactcgagctataaccagaaatttcgcgagcgcgtgaccctgaccgtggacacgagcacgagcacggcctatctcgagctctcgagcctgcgatcggaagataccgcggtctattactgtgtcttggccccgcgctggtactttagcgtgtgggggcaagggaccttggtcacggtctcgagc

SEQ ID NO: 59051 - RNA, 351 nt, synthetic construct
  misc_feature 1..351: note = derived and/or modified sequence opt11 from anti-OX40_HeavyChain
  source 1..351: mol_type = other RNA
gaagtgcaactggtccagagcggagccgaggtcaagaaaccgggcgcgagcgtgaaagtgagctgtaaagcgagcgggtacacgttcacggacgcgtacatgagctgggtcaggcaagcgcccgggcaagggctcgagtggataggcgatatgtaccccgataacggggactcgagctataaccagaaatttcgcgagcgcgtgaccataaccagggacacgagcacgagcacggcctatctcgagctctcgagcttgcgctcggaagataccgcggtctattactgtgtcctggccccgcgctggtactttagcgtgtgggggcaagggaccttggtaacggtctcgagc

SEQ ID NO: 59052 - RNA, 351 nt, synthetic construct
  misc_feature 1..351: note = derived and/or modified sequence opt11 from anti-OX40_HeavyChain
  source 1..351: mol_type = other RNA
gaggtccagctcgtgcaatcgggcgcggaagtgaaaaagcccggggcctcggtcaaggtctcgtgcaaggcctcgggctatacctttaccgagagctatatgtcgtgggtgcgccaggccccgggccagggcttggaatggatcggggacatgtacccggacaatggcgatagctcgtacaatcaaaagttcagggaaagggtcacgatcacgcgcgatacctcgacctcgaccgcgtacttggaattgagctcgctcaggagcgaggacacggccgtgtactattgcgtgctcgcgcccaggtggtatttctcggtctggggacagggcacgctcgtgaccgtgagctcg

SEQ ID NO: 59053 - RNA, 351 nt, synthetic construct
  misc_feature 1..351: note = derived and/or modified sequence opt11 from anti-OX40_HeavyChain
  source 1..351: mol_type = other RNA
gaagtccaactcgtccaatccggcgccgaagtcaaaaaacccggcgcctccgtcaaagtctcctgcaaagcctccggctacaccttcaccgactcctacatgtcctgggtacgccaagcccccggccaaggcctcgaatggatcggcgacatgtaccccgacaacgccgactcctcatacaaccaaaaattccgcgaacgcgtcaccatcacccgcgacacctccacctccaccgcctacctcgaactctcctccctccgctccgaagacaccgccgtctactactgcgtcctcgccccccgctggtacttctccgtctggggccaaggcaccctcgtcaccgtctcctcc

SEQ ID NO: 59054 - RNA, 351 nt, synthetic construct
  misc_feature 1..351: note = derived and/or modified sequence opt11 from anti-OX40_HeavyChain
  source 1..351: mol_type = other RNA
gaagtccaactcgtccaatccggagccgaagtcaaaaaacccggcgcctccgtcaaagtctcctgcaaagcctccggctacaccttcaccgactcctacatgtcctgggtccgccaagcccccggacaaggcctcgaatggatcggcgacatgtaccccgacaacgccgacgcctcctacaaccaaaaattccgcgaacgagtcaccatcacccgcgacacctccacctccaccgcctacctcgaactctcctccctccgctccgaagacaccgccgtctactactgcgtcctcgccccccgctggtacttctccgtctggggccaaggcaccctcgtcaccgtctcctcc

SEQ ID NO: 59055 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggacgcgagctataaccagaaatttcgcgagcgcgtgaccataaccagggacacgagcacgagcacggcctatctcgagctctcgagcttgcgctcggaagataccgcggtctattactgtgtcttggccccgcgctggtactttagcgtgtgggggcaagggaccttggtcacggtctcgagc

SEQ ID NO: 59056 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgatagcggggactcgagctataaccagaaatttcgcgagcgcgtgaccataaccagagacacgagcacgagcacggcctatctcgagctctcgagcttgcgctcggaagataccgcggtctattactgtgtcttggccccgcgctggtactttagcgtgtgggggcaagggaccctggtcacggtctcgagc

SEQ ID NO: 59057 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgcaaagcgagcgggtacacgttcacggactcgtacatgagctgggtcaggcaagcgcccgggcaagggctcgagtggataggcgatatgtatcccgataacgggagctcgagctataaccagaaatttcgcgagcgcgtgaccataaccagggacacgagcacgagcacggcctatctcgagctctcgagcttgcgctcggaagataccgcggtctattactgtgtcttggccccgcgctggtactttagcgtgtgggggcaagggaccttggtcacggtctcgagc

SEQ ID NO: 59058 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggacgcgtacatgagctgggtcaggcaagcgcccgggcaagggctcgagtggataggcgatatgtatcccgataacgcggacgcgagctataaccagaaatttcgcgagcgcgtgaccataaccagggacacgagcacgagcacggcctatctagagctctcgagcttgcgctcggaagataccgcggtctattactgtgtcttggccccgcgctggtactttagcgtgtgggggcaagggaccttggtaacggtctcgagc

SEQ ID NO: 59059 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggactcaagctataaccagaaatttcgcgagcgcgtgaccataaccagggacacgagcacgagcacggcctatctcgagctctcgagcttgcgctcggaagataccgcggtctattactgtgtcttggccccgcgctggtactttagcgcgtgggggcaaggaaccttggtcacggtctcgagc

SEQ ID NO: 59060 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggactcgagctataaccagaaatttcgcgagcgcgtgaccataaccagggacacgagcacgagcacggcctatctcgagctctcgagcttgcgctcggaagataccgcggtctattactgtgtcttggccccgcgctggtactttgccgtgtgggggcaagggaccttggtcacggtctcgagc

SEQ ID NO: 59061 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggactcgagctataaccagaaatttcgcgagcgcgtgaccataaccagggacacgagcacgagcacggcctatctcgagctcagctcattgcgctcggaagataccgcggtctattactgtgccttggccccgcgctggtactttagcgtatgggggcaagggaccctggtcacggtctcgagc

SEQ ID NO: 59062 - RNA, 351 nt, synthetic construct
  misc_feature 1..351: note = derived and/or modified sequence opt11 from anti-OX40_HeavyChain
  source 1..351: mol_type = other RNA
gaagtgcaattggtccagagcggggccgaggtcaagaaaccgggcgcgagcgtgaaagtgagctgtaaagcgagcgggtacacgttcacggactcgtacatgagctgggtcaggcaagcgcccgggcaagggctcgagtggataggcgatatgtatcccgataacggggactcgagctataaccagaaatttcgcgagcgcgtgaccataaccagggacacgagcacgagcacggcctatctcgagctctcgagcttgcgctcggaagataccgcggtatattactgtgtcgcggccccgcgctggtactttagcgtgtgggggcaagggaccttggtaacggtctcgagc

SEQ ID NO: 59063 - RNA, 354 nt, synthetic construct
  misc_feature 1..354: note = derived and/or modified sequence opt11 from anti-OX40_HeavyChain
  source 1..354: mol_type = other RNA
gaggtccagctcgtggaatcgggcgggggcttggtccagcccgggggctcgctcaggctctcgtgcgcggcctcaggctttacctttagctcgtactcgatgaattgggtgcgccaggccccgggcaagggcttggaatgggtctcgtacataagctcgagctcgagcacgatcgattacgcggactcggtcaagggcaggttcacgatctcgcgcgataacgcgaaaaatagcttgtacttgcaaatgaactcgctcagggacgaggacacggccgtgtactattgcgcgcgcgagagcgggtggtatctctttgactattgggggcaagggaccttggtcacggtctcgagc

SEQ ID NO: 59064 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacctgcgccgtctacggcggctccttctcctccggctactggaactggatccgccaacaccccggcaaaggcctcgaatggatcggctacatctcctacaacggcatcacctaccacaacccctccctcaaatcccgcatcaccatcaaccccgacacctccaaaaaccaattctccctccaactcaactccgtcacccccgaagacaccgccgtctactactgcgcccgctaccgctacgactacgacggcggccacgccatggactactggggccaaggcaccctcgtcaccgtctcctcc

SEQ ID NO: 59065 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacctgcgccgtctacggcggctccttctcctccggctactggaactggatccgcaaacaccccggcaaaggcctcgaatggatcggctacatctcctacaacggcatcacctaccacaacccctccctcaaatcccgcatcaccatcaaccgcgacacctccaaaaaccaattctccctccaactcaactccgtcacccccgaagacaccgccgtctactactgcgcccgctaccgatacgactacgacggcggccacgccatggactactggggccaaggcaccctcgtcaccgtctcctcc

SEQ ID NO: 59066 - RNA, 363 nt, synthetic construct
  misc_feature 1..363: note = derived and/or modified sequence opt11 from anti-OX40_HeavyChain
  source 1..363: mol_type = other RNA
caagtccaactccaagaatcaggccccggcctcgtcaaaccctcccaaaccctctccctaacctgcgccgtctacggcgactccttctcctccggctactggaactggatccgcaaacaccccggcaaaggcctcgaatacatgggctacatctcctacaacggcatcacctaccacaacccctccctcaaatcccgcatcaccatcaaccgcgacacctccaaaaaccaatactccctccaactcaactccgtcacccccgaagacaccgccgtctacttctgcgcccgctaccgctacgactacgacggcggccacgccatggactactggggccaaggcaccctcgtcaccgtctcctcc

SEQ ID NO: 59067 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcacaaaccctctccctcacctgcgccgtctacggcgactccttctcctccggctactggaactggatccgcaaacaccccggcaaaggcctcgaatacatcggctacatctcctacaacggcatcacctaccacaacccctccctcaaatcccgcatcaccatcaaccgcgacacctccaaaaaccaatactccctccaactcaactccgtcacccccgaagacaccgccgtctacttctgcgcccgctaccgatacgactacgacggcggccacgccatggactactggggccaaggcaccctcgtcaccgtctcatcc

SEQ ID NO: 59068 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctaacctgcgccgtctacggcgactccttctcatccggctactggaactggatccgcaaacaccccggcaaaggcctcgaatacatcggctacatctcctacaacggcatcacctaccacaacccctccctcaaatcccgcatcaccatcaaccgcgacacctccaaaaaccaattctcactccaactcaactccgtcacccccgaagacaccgccgtctacttctgcgcccgctaccgctacgactacgacggcggccacgccatggactactggggccaaggcaccctcgtcaccgtctcctcc

SEQ ID NO: 59069 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctcactcacctgcgccgtctacggcgactccttctcctccggctactggaactggatccgcaaacaccccggcaaaggcctcgaatacatcggctacatctcctacaacggcatcacctaccacaacccatccctcaaatcccgcatcaccatcaaccgcgacacctccaaaaaccaatactccctccaactcaactccgtcacccccgaagacaccgccgtctactactgcgcccgctaccgctacgactacgacggcggccacgccatggactactggggccaaggcaccctcgtcaccgtctcctcc

SEQ ID NO: 59070 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacatgcgccgtctacggcgactccttctcctccggctactggaactggatccgcaaacaccccggcaaaggcctcgaatacatcggctacatctcctacaacggcatcacctaccacaacccctccctcaaatcccgcatcaccatcaaccgcgacacctccaaaaaccaattctccctccaactcaactccgtcacccccgaagacaccgccgtctactactgcgcccgctaccgctacgactacgacggcggccacgccatggactactggggccaaggcaccctcgtcaccgtctcctcc

SEQ ID NO: 59071 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctctcaaaccctatccctaacctgcgccgtctacggcggctccttctcctccggctactggaactggatccgcaaacaccccggcaaaggcctcgaatacatcggctacatctcctacaacggcatcacctaccacaacccctccctcaaatcccgcatcaccatcaaccccgacacctccaaaaaccaatactccctccaactcaactccgtcacccccgaagacacagccgtctacttctgcgcccgctaccgctacgactacgacggcggccacgccatggactactggggccaaggcaccctcgtcaccgtctcctcc

SEQ ID NO: 59072 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacatgcgccgtctacggcggctcattctcctccggctactggaactggatccgcaaacaccccggcaaaggcctcgaatacatcggctacatctcctacaacggcatcacctaccacaacccctccctcaaatcccgcatcaccatcaaccgcgacacctccaaaaaccaatactccctccaactcaactccgtcacccccgaagacaccgccgtctacttctgcgcccgctaccgctacgactacgacggcggccacgccatggactactggggccaaggaaccctcgtcaccgtctcctcc

SEQ ID NO: 59073 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacctgcgccgtctacggcggctccttctcctccggctactggaactggatccgcaaacaccccggcaaaggcctcgaatacatcggctacatctcctacaacggcatcacctaccacaacccctccctcaaatcccgcatcaccatcaaccgcgacacctccaaaaaccaatactccctccaactcaactccgtcacccccgaagacaccgccgtctactactgcgcccgctaccgctacgactacgacggcggccacgccatggactactggggccaaggcaccctcgtcaccgtctcctcc

SEQ ID NO: 59074 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacatgcgccgtctacggcggctccttctcctccggctactggaactggatccgcaaacaccccggcaaaggcctcgaatacatcggctacatctcctacaacggcatcacctaccacaacccctccctcaaatcccgcatcaccatcaaccccgacacctccaaaaaccaatactccctccaactcaactccgtcacccccgaagacaccgccgtctactactgcgcccgctaccgctacgactacgacggcggccacgccatggactactggggccaaggcaccctcgtcaccgtctcctcc

SEQ ID NO: 59075 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctaacctgcgccgtctacggcggctccttctcatccggctactggaactggatccgcaaacaccccggcaaaggcctcgaatacatcggctacatctcctacaacgccatcacctaccacaacccctccctcaaatcccgcatcaccatcaaccgcgacacctccaaaaaccaatactccctccaactcaactccgtcacccccgaagacaccgccgtctactactgcgcccgctacaaatacgactacgacgccggccacgccatggactactggggccaaggcaccctcgtcaccgtctcctcc

SEQ ID NO: 59076 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctaacctgcgccgtctacggcggctccttctcatccggctactggaactggatccgcaaacaccccggcaaaggcctcgaatacatcggctacatctcctacaacgccatcacctaccacaacccctccctcaaatcccgcatcaccatcaaccgcgacacctccaaaaaccaatactccctccaactcaactccgtcacccccgaagacaccgccgtctactactgcgcccgctaccgctacgactacgacggcggccacgccatggactactggggccaaggcaccctcgtcaccgtctcctcc

SEQ ID NO: 59077 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctaacctgcgccgtctacggcggctccttctcctccggctactggaactggatccgcaaacaccccggaaaaggcctcgaatacatcggctacatctcctacaacggcatcacctaccacaacccctcactcaaatcccgaatcaccatcaaccgcgacacctccaaaaaccaatactccctccaactcaactcagtcacccccgaagacaccgccgtctactactgcgcccgctacaaatacgactacgacggcggccacgccatggactactggggccaaggcacactcgtcaccgtctcctcc

SEQ ID NO: 59078 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacctgcgccgtctacggcggctcattctcctccggctactggaactggatccgcaaacaccccggcaaaggcctcgaatacatcggctacatctcctactccggcatcacctaccacaacccctccctcaaatcccgcatcaccatcaaccgcgacacctcaaaaaaccaatactccctccaactcaactccgtaacccccgaagacaccgccgtctactactgcgcccgctaccgctacgactacgacggcggccacgccatggactactggggccaaggcaccctcgtcaccgtctcctcc

SEQ ID NO: 59079 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctcacctgcgccgtctacggcggctccttctcctccggctactggaactggatccgaaaacaccccggcaaaggcctcgaatacatcggctacatctcctactccggcatcacctaccacaacccatccctcaaatcccgcatcaccatcaaccgcgacacctccaaaaaccaatactcactccaactcaactccgtcacccccgaagacaccgccgtctactactgcgcccgatacaaatacgactacgacggcggccacgccatggactactggggccaaggcaccctcgtcaccgtctcctcc

SEQ ID NO: 59080 - RNA, 363 nt, synthetic construct
  misc_feature 1..363: note = derived and/or modified sequence opt11 from anti-OX40_HeavyChain
  source 1..363: mol_type = other RNA
gaagtccaactccaagaatccggcccctccctcgtcaaaccctcccaaaccctctcactcacctgctccgtcaccggcgactccttcacctccggctactggaactggatccgcaaattccccggcaaccgactcgaatacatgggctacatctcctacaacgccatcacctaccacaacccctccctcaaatcccgcatctccatcacccgcgacacctccaaaaaccactactacctccaactcaactccgtcaccaccgaagacaccgccacctacttctgcgcccgctaccgctacgactacgacggcggccacgccatggactactggggccaaggcaccctcgtcaccgtctcctcc

SEQ ID NO: 59081 - RNA, 363 nt, synthetic construct
  misc_feature 1..363: note = derived and/or modified sequence opt11 from anti-OX40_HeavyChain
  source 1..363: mol_type = other RNA
caagtccaactccaagaatccggccccggcctcgtcaaaccctcccaaaccctctccctaacctgcgccgtctacggcggctccttctcctccggctactggaactggatccgcaaacaccccggcaaaggcctcgaatacatcggctacatctcctacaacgccatcacctaccacaacccctccctcaaatcccgaatcaccatcaaccgcgacacctccaaaaaccaatactcactccaactcaactccgtcacccccgaagacaccgccgtctactactgcgcccgctacaaatacgactacgacggcggccacgccatggactactggggccaaggcaccctcgtcaccgtctcctca

SEQ ID NO: 59082 - RNA, 372 nt, synthetic construct
  misc_feature 1..372: note = derived and/or modified sequence opt11 from anti-OX40_HeavyChain
  source 1..372: mol_type = other RNA
gaagtgcaattggtggagagcgggggcgggctcgtgcaaccgggcaggagcttgcgcttgagctgtgccgcgagcgggttcacgttcgatgactatgcaatgcactgggtcaggcaagcgcccgggaaagggctagagtgggtgagcgggatatcgtggaatagcgggagcataggctatgcagatagcgtgaaagggcgctttacaataagcagggacaatgccaagaactcgctctatctacagatgaatagcttgcgagcggaagataccgcgctctattactgtgccaaggaccagagcacggccgattactatttctattacgggatggatgtctggggccagggcacgaccgtgaccgtgagctcg

SEQ ID NO: 59083 - RNA, 381 nt, synthetic construct
  misc_feature 1..381: note = derived and/or modified sequence opt11 from anti-OX40_LightChain
  source 1..381: mol_type = other RNA
atggaaacccccgcccaactcctattcctactcctcctctggctccccgacaccaccggcgaaatcgtcctcacccaatcacccggcaccctctccctctcccccggagaacgcgccatcctctcctgccgcgcctcccaatccgtctcctcctccttcctcgcctggtaccaacaaaaacccggccaagccccacgcctcctcatctacggcgccttctcccgcgccaccggcatacccgaccgcttctccggctccggctccggcaccgacttcaccctcaccatctcacgcctcgaacccgaagacttcgccgtctactactgccaacaatacgactcctcccgcaccttcggccaaggcaccaaagtcgaaatcaaa

SEQ ID NO: 59084 - RNA, 381 nt, synthetic construct
  misc_feature 1..381: note = derived and/or modified sequence opt11 from anti-OX40_LightChain
  source 1..381: mol_type = other RNA
atggaagcccccgcccaactcctcttcctcctcctcctctggctccccgacaccaccggcgaaatcgtcctcacccaatcccccgccaccctctccctctcccccggcgaacgcgccaccctctcctgccgcgcctcccaaggcgtctcatcctacctcgcctggtaccaacaaaaacccggccaagccccccgcctcctcatctacgacgcctccaaccgcgccaccggcatccccgcccgcttctccggctcaggccccggcaccgacttcaccctcaccatctcctccctcgaacccgaagacttcgccgtctactactgccaacaacgctccaactggcaccccaccttcggacaaggcaccaaagtcgaaatcaaa

SEQ ID NO: 59085 - RNA, 381 nt, synthetic construct
  misc_feature 1..381: note = derived and/or modified sequence opt11 from anti-OX40_LightChain
  source 1..381: mol_type = other RNA
atggaagcccccgcccaactcctcttcctcctcctcctctggctccccgacaccaccggcgaaatcgtcctcacccaatcacccgccaccctatccctctcccccggagaacgcgccaccctctcctgccgcgcctcacaatccgtctcctcctacctcgcctggtaccaacaaaaacccggccaagccccccgcctcctcatctacgacgcctccaaccgcgccaccggcatccccgcccgcttctccggctcaggctcaggcaccgacttcaccctcaccatctcctccctcgaacccgaagacttcgccgtctactactgccaacaacgctccaactggcccatcaccttcggccaaggcacccgcctcgaaatcaaa

SEQ ID NO: 59086 - RNA, 387 nt, synthetic construct
  misc_feature 1..387: note = derived and/or modified sequence opt11 from anti-OX40_LightChain
  source 1..387: mol_type = other RNA
atggaaacccccgcccaactcctcttcctcctcctcctctggctccccgacaccaccggcgaaatcgtcctcacccaatcccccggcaccctctcactctcccccggcgaacgcgccaccctatcctgccgcgcctcccaatccgtatcctcctcctacctcgcctggtaccaacaaaaacccggccaagcaccccgcctcctcatctacggcgcctcctcccgagccaccggcatccccgaccgcttctccggctccggctccggcaccgacttcaccctcaccatctcccgcctcgaacccgaagacttcgccgtctactactgccaacaatacgactcctccctcaccttcggcggcggcacaaaagtcgaaatcaaacgcacc

SEQ ID NO: 59087 - RNA, 390 nt, synthetic construct
  misc_feature 1..390: note = derived and/or modified sequence opt11 from anti-OX40_LightChain
  source 1..390: mol_type = other RNA
atggacatgcgcgtcctcgcccaactcctcggcctcctcctcctctgcttccccggcgcccgctgcgacatccaaatgacccaatccccctcctccctctccgcctccgtcggcaaccgcgtcaccatcacctgccgcgcctcccaagacatctcctcctggctcgcctggtaccaacaaaaacccgaaaaagcccccaaatccctaatctacgccgcctcctccctccaatccggcgtcccctcacgcttctccggctccggctccggcaccgacttcaccctcaccatctcctccctccaacccgaagacttcgccacctactactgccaacaatacaactcctaccccctcaccttcggccaaggcacccgcctcgaaatcaaacgc

SEQ ID NO: 59088 - RNA, 408 nt, synthetic construct
  misc_feature 1..408: note = derived and/or modified sequence opt11 from anti-OX40_HeavyChain
  source 1..408: mol_type = other RNA
atggacacactctgctccaccctcctcctcctcaccatcccctcctgggtcctatcccaaatcaccctcaaagaatccggccccaccctcgtcaaacccacccaaaccctcaccctctcctgcaccttctccggcttctccctctccacctccggcgtcggcgtcggctggatccgccaaccacccggcaaagccctcgaatggctcgccctcatccactgggacgacgccgaacgctactccccctccctcaaatcccgcctcaccatcaccaaagacacctccaaaaaccaagtcgtcctcaccatgaccaacatggacctcgtcgacaccgccacctactactgcgcccacacccgcggcgccttcgacatctggggccaaggcaccatggtcacagtctcctcc

SEQ ID NO: 59089 - RNA, 408 nt, synthetic construct
  misc_feature 1..408: note = derived and/or modified sequence opt11 from anti-OX40_HeavyChain
  source 1..408: mol_type = other RNA
atggacaccctctgctccaccctcctcctcctcaccatcccatcctgggtcctctcccaaatcaccctaaaagaatccggccccaccctcgtcaaacccacccaaaccctcaccctaacctgcaccttctccggcttctccctctccacatccggcgtcggagtcggctggatccgccaaccacccggcaaagccctagaatggctcgccctcatctactgggacgaccactccccctactccccctccctcaaatcccgcctcaccatcaccaaagacacctccaaaaaccaagtcgtcctcaccatgaccaacatggaccccgtcgacaccgccacctactactgcgcccgcacccgcggcgccttcgacatctggggccaaggcaccatggtcaccgtctcatcc

SEQ ID NO: 59090 - RNA, 420 nt, synthetic construct
  misc_feature 1..420: note = derived and/or modified sequence opt11 from anti-OX40_HeavyChain
  source 1..420: mol_type = other RNA
atggagtgggggccgtgttgggtgtttttggtggtgatattggagggggtgcagtgtggggtgcagctggtggagagtgggggggggttggtgcagccgggggggagtttgaggttgagctgtgcggcgagtgggtttacgtttagtagttatagtatgaattgggtgaggcaggcgccggggaaggggttggagtgggtgagctatataagtagtagtagcagtacgatatattatgcggatagtgtgaaggggaggtttacgataagtagagataatgcgaagaatagtctgtatttgcagatgaatagcctgagggatgaggatacggcggtgtattattgtgcgaggggggtgtatcataatgggtggagtttttttgattattgggggcaggggacgctgttgacggtgagtagt

SEQ ID NO: 59091 - RNA, 423 nt, synthetic construct
  misc_feature 1..423: note = derived and/or modified sequence opt11 from anti-OX40_HeavyChain
  source 1..423: mol_type = other RNA
atggacaccctctgctccaccctcctcctcctcaccatcccctcctgggtcctctcccaaatcaccctcaaagaatccggccccaccctagtcaaacccaaacaaaccctcaccctcacctgcaccttctccggcttctccctctccacctccggcatgggcgtcggctggatccgccaaccccccggcaaagccctcgaatggctcgccgtcatctactgggacgaccaccaactctactccccctccctcaaatcccgcctcaccatcaccaaagacacctccaaaaaccaagtagtcctcaccatgaccaacatggaccccgtcgacaccgccacctactactgcgcccaccgccgcggcgccttccaacactggggccaaggcaccctcgtcaccgtctcctccgcctccaccaaaggc

SEQ ID NO: 59092 - RNA, 462 nt, synthetic construct
  misc_feature 1..462: note = derived and/or modified sequence opt11 from anti-OX40_HeavyChain
  source 1..462: mol_type = other RNA
atgaccatgatcacaccctccctcgtaccctcatccgaccccctcgtcaccgccgcctccgtcctcgaattcgccctcctcatccgcctcaccatcggccaagccgtcgtctcaacccaatccaccggcggcggcctcgtccaacccggccgctccctccgcctctcatgcgccgcctccggcttcaccctcgacgactacggcatgcactgggtccgccaagcccccggcaaaggcctcgaatgggtctccggcatctcctggaactccgactccatcggctacgtcgactccgtcaaaggccgcttcaccatctcccgcgacaacgccaaaaactccctctacctccaaatgaactccctccgcgtcgaagacaccgccctctactactgcgtcaaagacatctccggctggtactccttcgactactggggccaaggcaccctcgtcaccgtctcctcc

SEQ ID NO: 59093 - RNA, 639 nt, synthetic construct
  misc_feature 1..639: note = derived and/or modified sequence opt11 from anti-OX40_LightChain
  source 1..639: mol_type = other RNA
gaaatcgtcgtcacccaatcacccgccaccctctccctctcccccggcgaacgcgccaccctctcctgccgcgcctcacaatccgtctcctcctacctcgcctggtaccaacaaaaacccggccaagccccacgcctcctcatctacgacgcctcaaaccgagccacaggcatccccgcccgattctccggctccggctccggaaccgacttcacactaaccatctcctccctcgaacccgaagacttcgccgtctactactgccaacaacgatccaactggcccaccttcggccaaggcaccaaagtcgaaatcaaacgcaccgtcgccgccccctccgtcttcatcttcccaccctcagacgaacaactcaaatccggcaccgcctccgtcgtctgcctcctcaacaacttctacccccgcgaagccaaagtacaatggaaagtcgacaacgccctccaatccggaaactcccaagaatccgtcacagaacaagactccaaagactccacctactcactttcctccaccctcaccctctccaaagccgactacgaaaaacacaaagtctacgcctgcgaagtaacccaccaaggcctctcctcccccgtcaccaaatccttcaaccgcggcgaatgc

SEQ ID NO: 59094 - RNA, 1350 nt, synthetic construct
  misc_feature 1..1350: note = derived and/or modified sequence opt11 from anti-OX40_HeavyChain
  source 1..1350: mol_type = other RNA
gaagtccaactcgtcgaatccggcggcggccttgtacagcccggacgatccctccgcctatcgtgcgccgcctccggcttcacattcgacgactacgcaatgcactgggtacgccaagcacccggcaaaggcctcgaatgggtctccggcatatcatggaactcaggatctatcggatacgccgactccgtcaaaggccgcttcacaatctcccgcgacaacgctaaaaactccctctacctccaaatgaactcactccgagcggaagataccgcactctactactgcgccaaagaccaatccaccgccgattactacttctactacggcatggacgtctggggccagggcaccaccgtcacagtctcgtcagcaagcaccaaaggaccctccgtcttcccactcgcaccttgctctcgcagcacctcagaatccactgcagctctcggctgcctcgtcaaagactacttcccagaaccagtcacagtcagctggaactccggcgcactcacctctggcgttcacaccttccccgcggtcctccaatcatccggcctctactccctatcctctgtagtcaccgtcccctcaagtaatttcggtacccaaacctatacctgcaatgtcgaccacaaaccctccaacacaaaagtcgacaaaaccgtagaacgaaaatgctgcgtagagtgcccaccatgccccgcaccacccgtagcaggcccctccgtctttctcttcccacccaaacccaaggacaccctaatgatatcccgcacccccgaagtaacctgcgtcgtcgtcgacgtttcccacgaagaccccgaagtccagttcaactggtacgtcgacggagtagaagtccacaacgccaaaaccaaaccccgagaagaacaattcaactccaccttccgcgtcgtctctgtactcaccgtagttcaccaagactggctaaacggaaaagaatacaaatgcaaagtcagcaacaaaggcctccccgcccccatcgagaaaaccatatctaaaaccaaaggccaaccccgcgaaccacaagtctacaccctcccaccctcacgtgaagaaatgaccaaaaaccaagtctcactcacatgcctcgtcaaaggcttctacccaagcgacatcgcagtagaatgggaatccaacggccaacccgaaaacaactacaaaaccaccccacccatgctagactcagacgggtccttcttcctctactccaagctcaccgtcgacaaatctcgctggcaacaaggaaacgtcttctcctgctcagtcatgcacgaagcccttcacaaccattacacccaaaaatccttatccctatcccccggaaaa

SEQ ID NO: 59095 - RNA, 21 nt, synthetic construct
  misc_feature 1..21: note = derived and/or modified sequence opt11 from anti-HIV_VRC01_VRC02_NIH45-46_LightChain_CDR
  source 1..21: mol_type = other RNA
tgccaacaatacgaattcttc

SEQ ID NO: 59096 - RNA, 42 nt, synthetic construct
  misc_feature 1..42: note = derived and/or modified sequence opt11 from anti-HIV_VRC01_HeavyChain_CDR
  source 1..42: mol_type = other RNA
acgcgcgggaaaaattgcgattacaattgggatttcgagcac

SEQ ID NO: 59097 - RNA, 21 nt, synthetic construct
  misc_feature 1..21: note = derived and/or modified sequence opt11 from anti-HIV_3BNC60_LightChain_CDR
  source 1..21: mol_type = other RNA
tgccaagtgtacgagttcata

SEQ ID NO: 59098 - RNA, 36 nt, synthetic construct
  misc_feature 1..36: note = derived and/or modified sequence opt11 from anti-HIV_3BNC60_HeavyChain_CDR
  source 1..36: mol_type = other RNA
gcgcgccagcgctcggacttttgggatttcgatgtc

SEQ ID NO: 59099 - RNA, 36 nt, synthetic construct
  misc_feature 1..36: note = derived and/or modified sequence opt11 from anti-HIV_5H/I1-BMV-D5_HeavyChain_CDR
  source 1..36: mol_type = other RNA
gcgcgcgataacccgaccttgctcgggagcgattac

SEQ ID NO: 59100 - RNA, 33 nt, synthetic construct
  misc_feature 1..33: note = derived and/or modified sequence opt11 from anti-HIV_8ANC195_LightChain_CDR
  source 1..33: mol_type = other RNA
tgccaacaatacgacacctaccccggcaccttc

SEQ ID NO: 59101 - RNA, 33 nt, synthetic construct
  misc_feature 1..33: note = derived and/or modified sequence opt11 from anti-HIV_CH01_CH02_CH03_LightChain_CDR
  source 1..33: mol_type = other RNA
tgccaacaatacggcggcagcccatacacattc

SEQ ID NO: 59102 - RNA, 78 nt, synthetic construct
  misc_feature 1..78: note = derived and/or modified sequence opt11 from anti-HIV_CH01_HeavyChain_CDR
  source 1..78: mol_type = other RNA
gcgcgcgggaccgattacacgatcgatgacgcgggcatacactatcaagggagcgggaccttttggtatttcgatctc

SEQ ID NO: 59103 - RNA, 78 nt, synthetic construct
  misc_feature 1..78: note = derived and/or modified sequence opt11 from anti-HIV_CH02_HeavyChain_CDR
  source 1..78: mol_type = other RNA
gcccgcggcaccgactacacaatcgacgaccaaggccgattctaccaaggctccggcaccttctggtacttcgacttc

SEQ ID NO: 59104 - RNA, 78 nt, synthetic construct
  misc_feature 1..78: note = derived and/or modified sequence opt11 from anti-HIV_CH03_HeavyChain_CDR
  source 1..78: mol_type = other RNA
gcccgcggcaccgactacacaatcgacgaccaaggcatattctacaaaggatccggcaccttctggtacttcgacctc

SEQ ID NO: 59105 - RNA, 33 nt, synthetic construct
  misc_feature 1..33: note = derived and/or modified sequence opt11 from anti-HIV_CH04_LightChain_CDR
  source 1..33: mol_type = other RNA
tgccaacaatacggccgctccccctacaccttc

SEQ ID NO: 59106 - RNA, 78 nt, synthetic construct
  misc_feature 1..78: note = derived and/or modified sequence opt11 from anti-HIV_CH04_HeavyChain_CDR
  source 1..78: mol_type = other RNA
gcgcgcgggaccgattacacgatcgatgaccagggcatacgctatcaagggagcgggaccttttggtatttcgatgtc

SEQ ID NO: 59107 - RNA, 54 nt, synthetic construct
  misc_feature 1..54: note = derived and/or modified sequence opt11 from anti-HIV_NIH45-46_HeavyChain_CDR
  source 1..54: mol_type = other RNA
acacgcggaaaatactgcacggccagagactactacaactgggacttcgaacac

SEQ ID NO: 59108 - RNA, 90 nt, synthetic construct
  misc_feature 1..90: note = derived and/or modified sequence opt11 from anti-HIV_PG16_HeavyChain_CDR
  source 1..90: mol_type = other RNA
gcccgagaagccggcggcccaatctggcacgacgacgtcaaatactacgacttcaacgacggctactacaactaccactacatggacgtc

SEQ ID NO: 59109 - RNA, 36 nt, synthetic construct
  misc_feature 1..36: note = derived and/or modified sequence opt11 from anti-HIV_PGT122_LightChain_CDR
  source 1..36: mol_type = other RNA
cacatatgggacagcagacgcccgaccaactgggta

SEQ ID NO: 59110 - RNA, 72 nt, synthetic construct
  misc_feature 1..72: note = derived and/or modified sequence opt11 from anti-HIV_PGT122_HeavyChain_CDR
  source 1..72: mol_type = other RNA
accaagcacgggcgcaggatctatggcgtggtcgcgttcaaggaatggttcacgtacttttacatggacgtg

SEQ ID NO: 59111 - RNA, 36 nt, synthetic construct
  misc_feature 1..36: note = derived and/or modified sequence opt11 from anti-HIV_PGT123_LightChain_CDR
  source 1..36: mol_type = other RNA
cacatatacgacgccagaggcggaacaaactgggtc

SEQ ID NO: 59112 - RNA, 72 nt, synthetic construct
  misc_feature 1..72: note = derived and/or modified sequence opt11 from anti-HIV_PGT123_HeavyChain_CDR
  source 1..72: mol_type = other RNA
gccctccacggcaaacgcatctacggcatcgtcgccctcggcgaactcttcacctacttctacatggacgtc

SEQ ID NO: 59113 - RNA, 30 nt, synthetic construct
  misc_feature 1..30: note = derived and/or modified sequence opt11 from anti-HIV_PGT125_PGT128_LightChain_CDR
  source 1..30: mol_type = other RNA
gggagtttggtcgggaactgggacgtgata

SEQ ID NO: 59114 - RNA, 57 nt, synthetic construct
  misc_feature 1..57: note = derived and/or modified sequence opt11 from anti-HIV_PGT125_HeavyChain_CDR
  source 1..57: mol_type = other RNA
tttgacggggaagtgctcgtgtacaatcactggcccaagcccgcgtgggtggacttg

SEQ ID NO: 59115 - RNA, 30 nt, synthetic construct
  misc_feature 1..30: note = derived and/or modified sequence opt11 from anti-HIV_PGT126_PGT127_LightChain_CDR
  source 1..30: mol_type = other RNA
tcgagcttggtcgggaactgggacgtgata

SEQ ID NO: 59116 - RNA, 57 nt, synthetic construct
  misc_feature 1..57: note = derived and/or modified sequence opt11 from anti-HIV_PGT126_HeavyChain_CDR
  source 1..57: mol_type = other RNA
ttcgacggagaagtactcgtataccacgactggcccaagcccgcatgggtagacctg

SEQ ID NO: 59117 - RNA, 57 nt, synthetic construct
  misc_feature 1..57: note = derived and/or modified sequence opt11 from anti-HIV_PGT127_HeavyChain_CDR
  source 1..57: mol_type = other RNA
tttgggggggaggtgttggtgtatagggattggccgaagccggcgtgggtggatttg

SEQ ID NO: 59118 - RNA, 57 nt, synthetic construct
  misc_feature 1..57: note = derived and/or modified sequence opt11 from anti-HIV_PGT128_HeavyChain_CDR
  source 1..57: mol_type = other RNA
tttggcggggaagtgctcaggtacacggactggcccaagccagcgtgggtggacttg

SEQ ID NO: 59119 - RNA, 30 nt, synthetic construct
  misc_feature 1..30: note = derived and/or modified sequence opt11 from anti-HIV_PGT130_LightChain_CDR
  source 1..30: mol_type = other RNA
tcgagtttgttcgggcgctgggacgtggtc

SEQ ID NO: 59120 - RNA, 57 nt, synthetic construct
  misc_feature 1..57: note = derived and/or modified sequence opt11 from anti-HIV_PGT130_HeavyChain_CDR
  source 1..57: mol_type = other RNA
tccggcggcgacatcctctactactacgaatggcaaaaaccccactggttctcaccc

SEQ ID NO: 59121 - RNA, 30 nt, synthetic construct
  misc_feature 1..30: note = derived and/or modified sequence opt11 from anti-HIV_PGT131_LightChain_CDR
  source 1..30: mol_type = other RNA
tcgagcttgagcgggcgatgggacatagtc

SEQ ID NO: 59122 - RNA, 57 nt, synthetic construct
  misc_feature 1..57: note = derived and/or modified sequence opt11 from anti-HIV_PGT131_HeavyChain_CDR
  source 1..57: mol_type = other RNA
agcgggggcgatatcttgtactatatcgagtggcagaaaccgcactggttctatccc

SEQ ID NO: 59123 - RNA, 27 nt, synthetic construct
  misc_feature 1..27: note = derived and/or modified sequence opt11 from anti-HIV_PGT135_PGT136_PGT137_LightChain_CDR
  source 1..27: mol_type = other RNA
caacagtacgaagaatggcccagaacc

SEQ ID NO: 59124 - RNA, 54 nt, synthetic construct
  misc_feature 1..54: note = derived and/or modified sequence opt11 from anti-HIV_PGT135_HeavyChain_CDR
  source 1..54: mol_type = other RNA
caccgacaccacgacgtattcatgctcgtccccatcgccggctggttcgacgtc

SEQ ID NO: 59125 - RNA, 54 nt, synthetic construct
  misc_feature 1..54: note = derived and/or modified sequence opt11 from anti-HIV_PGT136_HeavyChain_CDR
  source 1..54: mol_type = other RNA
cacaaataccacgacatcttccgcgtcgtccccgtcgccggctggttcgacccc

SEQ ID NO: 59126 - RNA, 54 nt, synthetic construct
  misc_feature 1..54: note = derived and/or modified sequence opt11 from anti-HIV_PGT137_HeavyChain_CDR
  source 1..54: mol_type = other RNA
cacaaataccacgacatcgtcatggtcgtccccatcgccggctggttcgacccc

SEQ ID NO: 59127 - RNA, 27 nt, synthetic construct
  misc_feature 1..27: note = derived and/or modified sequence opt11 from anti-HIV_PGT141_PGT142_PGT143_PGT144_LightChain_CDR
  source 1..27: mol_type = other RNA
atgcaaggactcaaccgcccgtggacg

SEQ ID NO: 59128 - RNA, 96 nt, synthetic construct
  misc_feature 1..96: note = derived and/or modified sequence opt11 from anti-HIV_PGT141_HeavyChain_CDR
  source 1..96: mol_type = other RNA
ggctcaaaacaccgcctccgcgactacgtcctctacgacgactacggcctcatcaactaccaagaatggaacgactacctcgaattcctcgacgtc

SEQ ID NO: 59129 - RNA, 96 nt, synthetic construct
  misc_feature 1..96: note = derived and/or modified sequence opt11 from anti-HIV_PGT144_HeavyChain_CDR
  source 1..96: mol_type = other RNA
ggctcaaaacaccgcctccgcgactacgtcctctacgacgactacggcctcatcaaccaacaagaatggaacgactacctcgaattcctcgacgtc

SEQ ID NO: 59130 - RNA, 27 nt, synthetic construct
  misc_feature 1..27: note = derived and/or modified sequence opt11 from anti-HIV_PGT145_LightChain_CDR
  source 1..27: mol_type = other RNA
atgcaaggactccacagcccgtggaca

SEQ ID NO: 59131 - RNA, 93 nt, synthetic construct
  misc_feature 1..93: note = derived and/or modified sequence opt11 from anti-HIV_PGT145_HeavyChain_CDR
  source 1..93: mol_type = other RNA
ggctcaaaacaccgcctccgcgactacttcctctacaacgaatacggccccaactacgaagaatggggcgactacctcgccaccctcgacgtc

SEQ ID NO: 59132 - RNA, 21 nt, synthetic construct
  misc_feature 1..21: note = derived and/or modified sequence opt11 from anti-HIV_VRC-CH30_VRC-CH31_VRC-CH32_VRC-CH33_VRC-CH34_Light Chain _CDR
  source 1..21: mol_type = other RNA
tgccaacaatacgaaaccttc

SEQ ID NO: 59133 - RNA, 45 nt, synthetic construct
  misc_feature 1..45: note = derived and/or modified sequence opt11 from anti-HIV_VRC-CH30_VRC-CH31_VRC-CH32_VRC-CH34_HeavyChain_CDR
  source 1..45: mol_type = other RNA
gccagagcacaaaaacgaggcagatcagaatgggcctacgcccac

SEQ ID NO: 59134 - RNA, 45 nt, synthetic construct
  misc_feature 1..45: note = derived and/or modified sequence opt11 from anti-HIV_VRC-CH33_HeavyChain_CDR
  source 1..45: mol_type = other RNA
gcgcgagcgcaaaagcgagcgcgctcggaatgggcctatgcccat

SEQ ID NO: 59135 - RNA, 21 nt, synthetic construct
  misc_feature 1..21: note = derived and/or modified sequence opt11 from anti-HIV_VRC-PG04_LightChain_CDR
  source 1..21: mol_type = other RNA
tgccaacaactcgaattcttc

SEQ ID NO: 59136 - RNA, 48 nt, synthetic construct
  misc_feature 1..48: note = derived and/or modified sequence opt11 from anti-HIV_VRC-PG04_HeavyChain_CDR
  source 1..48: mol_type = other RNA
gcgcgccagaaattttacacgggcgggcaagggtggtatttcgatctc

SEQ ID NO: 59137 - RNA, 21 nt, synthetic construct
  misc_feature 1..21: note = derived and/or modified sequence opt11 from anti-HIV_VRC-PG04b_LightChain_CDR
  source 1..21: mol_type = other RNA
tgccaacaagtcgaattcttc

SEQ ID NO: 59138 - RNA, 48 nt, synthetic construct
  misc_feature 1..48: note = derived and/or modified sequence opt11 from anti-HIV_VRC-PG04b_HeavyChain_CDR
  source 1..48: mol_type = other RNA
gcgaggcagaagtttgagaggggggggcaggggtggtattttgatttg

SEQ ID NO: 59139 - RNA, 21 nt, synthetic construct
  misc_feature 1..21: note = derived and/or modified sequence opt11 from anti-HIV_VRC03_LightChain_CDR
  source 1..21: mol_type = other RNA
tgccaacaattcgaattcttc

SEQ ID NO: 59140 - RNA, 48 nt, synthetic construct
  misc_feature 1..48: note = derived and/or modified sequence opt11 from anti-HIV_VRC03_HeavyChain_CDR
  source 1..48: mol_type = other RNA
gtgcgcaggggctcgtgcgattactgtggcgatttcccgtggcagtac

SEQ ID NO: 59141 - RNA, 21 nt, synthetic construct
  misc_feature 1..21: note = derived and/or modified sequence opt11 from anti-HIV_1TJG_P-Chain
  source 1..21: mol_type = other RNA
gaactggacaagtgggcaagt

SEQ ID NO: 59142 - RNA, 69 nt, synthetic construct
  misc_feature 1..69: note = derived and/or modified sequence opt11 from anti-HIV_2B1H_P-Chain
  source 1..69: mol_type = other RNA
aacaacaccaaaaaatccatcaaaatccgcccccgccaagccttctacgccaccaacggcatcatcggc

SEQ ID NO: 59143 - RNA, 69 nt, synthetic construct
  misc_feature 1..69: note = derived and/or modified sequence opt11 from anti-HIV_2B1A_P-Chain
  source 1..69: mol_type = other RNA
aacaacacccgcaaatccatacacctcggccccggccgcgccttctacgccaccggcgacatcatcggc

SEQ ID NO: 59144 - RNA, 57 nt, synthetic construct
  misc_feature 1..57: note = derived and/or modified sequence opt11 from anti-HIV_2B0S_P-Chain
  source 1..57: mol_type = other RNA
aaacgcaaacgcatccacatcggccccggccgcgccttctacaccaccaaaaacgcc

SEQ ID NO: 59145 - RNA, 69 nt, synthetic construct
  misc_feature 1..69: note = derived and/or modified sequence opt11 from anti-HIV_3UJJ_P-Chain
  source 1..69: mol_type = other RNA
aataacacgcgcaagagcatacgcataggcccgggccaggccttttacgcgaccggggacataatcggg

SEQ ID NO: 59146 - RNA, 69 nt, synthetic construct
  misc_feature 1..69: note = derived and/or modified sequence opt11 from anti-HIV_3UJI_P-Chain
  source 1..69: mol_type = other RNA
tacaacaaacgcaaacgcatccacatcggccccggccgcgccttctacaccaccaaaaacatcatcggc

SEQ ID NO: 59147 - RNA, 75 nt, synthetic construct
  misc_feature 1..75: note = derived and/or modified sequence opt11 from anti-HIV_3MLZ_P-Chain
  source 1..75: mol_type = other RNA
agcaacaacacgcgcaagggcatacacataggcccgggcagggccttctacgcgaccgggcaaataaccggggac

SEQ ID NO: 59148 - RNA, 60 nt, synthetic construct
  misc_feature 1..60: note = derived and/or modified sequence opt11 from anti-HIV_3MLV_Q-Chain
  source 1..60: mol_type = other RNA
aacaacacacgcaaacgcatacgcgtaggcccaggccaaaccgtatacgcaaccaacgcc

SEQ ID NO: 59149 - RNA, 69 nt, synthetic construct
  misc_feature 1..69: note = derived and/or modified sequence opt11 from anti-HIV_3MLU_P-Chain
  source 1..69: mol_type = other RNA
aataacacgcgcaagagcatacgcataggcccgggccaggccttttacgcgaccgggggcataatcggg

SEQ ID NO: 59150 - RNA, 60 nt, synthetic construct
  misc_feature 1..60: note = derived and/or modified sequence opt11 from anti-HIV_3MLR_P-Chain
  source 1..60: mol_type = other RNA
aacaacaccaaaaagggcatagccataggcccgggcaggacactgtacgcgcgcgagaaa

SEQ ID NO: 59151 - RNA, 48 nt, synthetic construct
  misc_feature 1..48: note = derived and/or modified sequence opt11 from anti-HIV_4XCF_P-Chain
  source 1..48: mol_type = other RNA
aactggtgggacataacgaactggctctggtacatcaaaaagaaaaag

SEQ ID NO: 59152 - RNA, 45 nt, synthetic construct
  misc_feature 1..45: note = derived and/or modified sequence opt11 from anti-HIV_4XBE_P-Chain
  source 1..45: mol_type = other RNA
aactggttcgacataacgaactggctctggtacatcaaaaagaaa

SEQ ID NO: 59153 - RNA, 48 nt, synthetic construct
  misc_feature 1..48: note = derived and/or modified sequence opt11 from anti-HIV_4XAW_P-Chain
  source 1..48: mol_type = other RNA
aactggttcgacataacgaactggctctggtacatcaaaaagaaaaag

SEQ ID NO: 59154 - RNA, 45 nt, synthetic construct
  misc_feature 1..45: note = derived and/or modified sequence opt11 from anti-HIV_2QSC_P-Chain
  source 1..45: mol_type = other RNA
cgcaaacgcatccacatcggccccggccgcgccttctacaccacc

SEQ ID NO: 59155 - RNA, 60 nt, synthetic construct
  misc_feature 1..60: note = derived and/or modified sequence opt11 from anti-HIV_3MLS_S-Chain
  source 1..60: mol_type = other RNA
gcctgccaagccttctacgcctcctccccccgcaaatccatacacatcggcgcctgcgcc

SEQ ID NO: 59156 - RNA, 42 nt, synthetic construct
  misc_feature 1..42: note = derived and/or modified sequence opt11 from anti-HIV_3GO1_P-Chain
  source 1..42: mol_type = other RNA
cgcaagcgcatacacataggcccgggcagggccttctacaca

SEQ ID NO: 59157 - RNA, 42 nt, synthetic construct
  misc_feature 1..42: note = derived and/or modified sequence opt11 from anti-HIV_4M1D_Q-Chain
  source 1..42: mol_type = other RNA
tgccgcatccacatcggccccggccgagccttctacacctgc

SEQ ID NO: 59158 - RNA, 39 nt, synthetic construct
  misc_feature 1..39: note = derived and/or modified sequence opt11 from anti-HIV_3C2A_Q-Chain
  source 1..39: mol_type = other RNA
aaatccatccacctcggccccggccgcgccttctacgcc

SEQ ID NO: 59159 - RNA, 12 nt, synthetic construct
  misc_feature 1..12: note = derived and/or modified sequence opt11 from anti-HIV_CDR
  source 1..12: mol_type = other RNA
caatccaaaacc

SEQ ID NO: 59160 - RNA, 12 nt, synthetic construct
  misc_feature 1..12: note = derived and/or modified sequence opt11 from anti-HIV_CDR
  source 1..12: mol_type = other RNA
gacctgatcgat

SEQ ID NO: 59161 - RNA, 15 nt, synthetic construct
  misc_feature 1..15: note = derived and/or modified sequence opt11 from anti-HIV_CDR
  source 1..15: mol_type = other RNA
gaccactactggtca

SEQ ID NO: 59162 - RNA, 15 nt, synthetic construct
  misc_feature 1..15: note = derived and/or modified sequence opt11 from anti-HIV_CDR
  source 1..15: mol_type = other RNA
ggcaggttctggagt

SEQ ID NO: 59163 - RNA, 15 nt, synthetic construct
  misc_feature 1..15: note = derived and/or modified sequence opt11 from anti-HIV_CDR
  source 1..15: mol_type = other RNA
aactactactggacc

SEQ ID NO: 59164 - RNA, 15 nt, synthetic construct
  misc_feature 1..15: note = derived and/or modified sequence opt11 from anti-HIV_CDR
  source 1..15: mol_type = other RNA
gacgcctactggtca

SEQ ID NO: 59165 - RNA, 15 nt, synthetic construct
  misc_feature 1..15: note = derived and/or modified sequence opt11 from anti-HIV_CDR
  source 1..15: mol_type = other RNA
gatagctattggtcg

SEQ ID NO: 59166 - RNA, 15 nt, synthetic construct
  misc_feature 1..15: note = derived and/or modified sequence opt11 from anti-HIV_CDR
  source 1..15: mol_type = other RNA
gacaactactggtca

SEQ ID NO: 59167 - RNA, 15 nt, synthetic construct
  misc_feature 1..15: note = derived and/or modified sequence opt11 from anti-HIV_CDR
  source 1..15: mol_type = other RNA
aacagctactggacc

SEQ ID NO: 59168 - RNA, 15 nt, synthetic construct
  misc_feature 1..15: note = derived and/or modified sequence opt11 from anti-HIV_CDR
  source 1..15: mol_type = other RNA
tcctattactggtcc

SEQ ID NO: 59169 - RNA, 15 nt, synthetic construct
  misc_feature 1..15: note = derived and/or modified sequence opt11 from anti-HIV_CDR
  source 1..15: mol_type = other RNA
agcttcggcatgcac

SEQ ID NO: 59170 - RNA, 15 nt, synthetic construct
  misc_feature 1..15: note = derived and/or modified sequence opt11 from anti-HIV_CDR
  source 1..15: mol_type = other RNA
gccgcatttcagtgg

SEQ ID NO: 59171 - RNA, 15 nt, synthetic construct
  misc_feature 1..15: note = derived and/or modified sequence opt11 from anti-HIV_CDR
  source 1..15: mol_type = other RNA
caacaactccgcacc

SEQ ID NO: 59172 - RNA, 15 nt, synthetic construct
  misc_feature 1..15: note = derived and/or modified sequence opt11 from anti-HIV_CDR
  source 1..15: mol_type = other RNA
caacaatacgacagc

SEQ ID NO: 59173 - RNA, 15 nt, synthetic construct
  misc_feature 1..15: note = derived and/or modified sequence opt11 from anti-HIV_CDR
  source 1..15: mol_type = other RNA
caacaactcgccacc

SEQ ID NO: 59174 - RNA, 15 nt, synthetic construct
  misc_feature 1..15: note = derived and/or modified sequence opt11 from anti-HIV_CDR
  source 1..15: mol_type = other RNA
gagagctttcagtgg

SEQ ID NO: 59175 - RNA, 15 nt, synthetic construct
  misc_feature 1..15: note = derived and/or modified sequence opt11 from anti-HIV_CDR
  source 1..15: mol_type = other RNA
gaggtgtatgagttt

SEQ ID NO: 59176 - RNA, 15 nt, synthetic construct
  misc_feature 1..15: note = derived and/or modified sequence opt11 from anti-HIV_CDR
  source 1..15: mol_type = other RNA
gcctcgctcgagttt

SEQ ID NO: 59177 - RNA, 15 nt, synthetic construct
  misc_feature 1..15: note = derived and/or modified sequence opt11 from anti-HIV_CDR
  source 1..15: mol_type = other RNA
agcgtgtacgagttc

SEQ ID NO: 59178 - RNA, 15 nt, synthetic construct
  misc_feature 1..15: note = derived and/or modified sequence opt11 from anti-HIV_CDR
  source 1..15: mol_type = other RNA
gccgcgctcgagttt

SEQ ID NO: 59179 - RNA, 15 nt, synthetic construct
  misc_feature 1..15: note = derived and/or modified sequence opt11 from anti-HIV_CDR
  source 1..15: mol_type = other RNA
gcggtggtggagttt

SEQ ID NO: 59180 - RNA, 15 nt, synthetic construct
  misc_feature 1..15: note = derived and/or modified sequence opt11 from anti-HIV_CDR
  source 1..15: mol_type = other RNA
caattgttcgagttc

SEQ ID NO: 59181 - RNA, 15 nt, synthetic construct
  misc_feature 1..15: note = derived and/or modified sequence opt11 from anti-HIV_CDR
  source 1..15: mol_type = other RNA
gccgtcttccaatgg

SEQ ID NO: 59182 - RNA, 15 nt, synthetic construct
  misc_feature 1..15: note = derived and/or modified sequence opt11 from anti-HIV_CDR
  source 1..15: mol_type = other RNA
gccgtgctcgagttt

SEQ ID NO: 59183 - RNA, 15 nt, synthetic construct
  misc_feature 1..15: note = derived and/or modified sequence opt11 from anti-HIV_CDR
  source 1..15: mol_type = other RNA
aacgggttcgatgtc

SEQ ID NO: 59184 - RNA, 15 nt, synthetic construct
  misc_feature 1..15: note = derived and/or modified sequence opt11 from anti-HIV_CDR
  source 1..15: mol_type = other RNA
caacagtacgaattc

SEQ ID NO: 59185 - RNA, 15 nt, synthetic construct
  misc_feature 1..15: note = derived and/or modified sequence opt11 from anti-HIV_CDR
  source 1..15: mol_type = other RNA
caacactacgaattc

SEQ ID NO: 59186 - RNA, 15 nt, synthetic construct
  misc_feature 1..15: note = derived and/or modified sequence opt11 from anti-HIV_CDR
  source 1..15: mol_type = other RNA
caagtgtacgaggtc

SEQ ID NO: 59187 - RNA, 15 nt, synthetic construct
  misc_feature 1..15: note = derived and/or modified sequence opt11 from anti-HIV_CDR
  source 1..15: mol_type = other RNA
caagtgtacgagttc

SEQ ID NO: 59188 - RNA, 15 nt, synthetic construct
  misc_feature 1..15: note = derived and/or modified sequence opt11 from anti-HIV_CDR
  source 1..15: mol_type = other RNA
ttctcgaaagagagc

SEQ ID NO: 59189 - RNA, 15 nt, synthetic construct
  misc_feature 1..15: note = derived and/or modified sequence opt11 from anti-HIV_CDR
  source 1..15: mol_type = other RNA
ctcaagctctcgagc

SEQ ID NO: 59190 - RNA, 15 nt, synthetic construct
  misc_feature 1..15: note = derived and/or modified sequence opt11 from anti-HIV_CDR
  source 1..15: mol_type = other RNA
tacaaggtctcgagc

SEQ ID NO: 59191 - RNA, 15 nt, synthetic construct
  misc_feature 1..15: note = derived and/or modified sequence opt11 from anti-HIV_CDR
  source 1..15: mol_type = other RNA
cccccacaagaatcc

SEQ ID NO: 59192 - RNA, 15 nt, synthetic construct
  misc_feature 1..15: note = derived and/or modified sequence opt11 from anti-HIV_CDR
  source 1..15: mol_type = other RNA
accgcacgcgattac

SEQ ID NO: 59193 - RNA, 15 nt, synthetic construct
  misc_feature 1..15: note = derived and/or modified sequence opt11 from anti-HIV_CDR
  source 1..15: mol_type = other RNA
atgcagtcgatccag

SEQ ID NO: 59194 - RNA, 15 nt, synthetic construct
  misc_feature 1..15: note = derived and/or modified sequence opt11 from anti-HIV_CDR
  source 1..15: mol_type = other RNA
caccaactcgacacc

SEQ ID NO: 59195 - RNA, 15 nt, synthetic construct
  misc_feature 1..15: note = derived and/or modified sequence opt11 from anti-HIV_CDR
  source 1..15: mol_type = other RNA
caccaactcgacagc

SEQ ID NO: 59196 - RNA, 15 nt, synthetic construct
  misc_feature 1..15: note = derived and/or modified sequence opt11 from anti-HIV_CDR
  source 1..15: mol_type = other RNA
caacaactcggcacc

SEQ ID NO: 59197 - RNA, 15 nt, synthetic construct
  misc_feature 1..15: note = derived and/or modified sequence opt11 from anti-HIV_CDR
  source 1..15: mol_type = other RNA
caaaaagccaccaca

SEQ ID NO: 59198 - RNA, 15 nt, synthetic construct
  misc_feature 1..15: note = derived and/or modified sequence opt11 from anti-HIV_CDR
  source 1..15: mol_type = other RNA
ttatttgccggcacc

SEQ ID NO: 59199 - RNA, 18 nt, synthetic construct
  misc_feature 1..18: note = derived and/or modified sequence opt11 from anti-HIV_CDR
  source 1..18: mol_type = other RNA
gtacgcgggagctcgcca

SEQ ID NO: 59200 - RNA, 18 nt, synthetic construct
  misc_feature 1..18: note = derived and/or modified sequence opt11 from anti-HIV_CDR
  source 1..18: mol_type = other RNA
ggcctgctctttgtcgtg

SEQ ID NO: 59201 - RNA, 18 nt, synthetic construct
  misc_feature 1..18: note = derived and/or modified sequence opt11 from anti-HIV_CDR
  source 1..18: mol_type = other RNA
atggactggacatggagc

SEQ ID NO: 59202 - RNA, 18 nt, synthetic construct
  misc_feature 1..18: note = derived and/or modified sequence opt11 from anti-HIV_CDR
  source 1..18: mol_type = other RNA
atggattggacgtggagg

SEQ ID NO: 59203 - RNA, 18 nt, synthetic construct
  misc_feature 1..18: note = derived and/or modified sequence opt11 from anti-HIV_CDR
  source 1..18: mol_type = other RNA
atgaaacacctctggttc

SEQ ID NO: 59204 - RNA, 18 nt, synthetic construct
  misc_feature 1..18: note = derived and/or modified sequence opt11 from anti-HIV_CDR
  source 1..18: mol_type = other RNA
atggactggatatggagg

SEQ ID NO: 59205 - RNA, 18 nt, synthetic construct
  misc_feature 1..18: note = derived and/or modified sequence opt11 from anti-HIV_CDR
  source 1..18: mol_type = other RNA
atggattggacgtggacg

SEQ ID NO: 59206 - RNA, 18 nt, synthetic construct
  misc_feature 1..18: note = derived and/or modified sequence opt11 from anti-HIV_CDR
  source 1..18: mol_type = other RNA
atgaaacacctcttcctc

SEQ ID NO: 59207 - RNA, 18 nt, synthetic construct
  misc_feature 1..18: note = derived and/or modified sequence opt11 from anti-HIV_CDR
  source 1..18: mol_type = other RNA
caactcctccaatccaac

SEQ ID NO: 59208 - RNA, 18 nt, synthetic construct
  misc_feature 1..18: note = derived and/or modified sequence opt11 from anti-HIV_CDR
  source 1..18: mol_type = other RNA
ggaggatcgcccgagcat

SEQ ID NO: 59209 - RNA, 18 nt, synthetic construct
  misc_feature 1..18: note = derived and/or modified sequence opt11 from anti-HIV_CDR
  source 1..18: mol_type = other RNA
ctagagggcacggactat

SEQ ID NO: 59210 - RNA, 18 nt, synthetic construct
  misc_feature 1..18: note = derived and/or modified sequence opt11 from anti-HIV_CDR
  source 1..18: mol_type = other RNA
caacaatacccctccacc

SEQ ID NO: 59211 - RNA, 21 nt, synthetic construct
  misc_feature 1..21: note = derived and/or modified sequence opt11 from anti-HIV_CDR
  source 1..21: mol_type = other RNA
aacaatcacgaccgcccaagc

SEQ ID NO: 59212 - RNA, 21 nt, synthetic construct
  misc_feature 1..21: note = derived and/or modified sequence opt11 from anti-HIV_CDR
  source 1..21: mol_type = other RNA
aacaatcaagaccgcccggcc

SEQ ID NO: 59213 - RNA, 21 nt, synthetic construct
  misc_feature 1..21: note = derived and/or modified sequence opt11 from anti-HIV_CDR
  source 1..21: mol_type = other RNA
aacaataacgaccgcccaagc

SEQ ID NO: 59214 - RNA, 21 nt, synthetic construct
  misc_feature 1..21: note = derived and/or modified sequence opt11 from anti-HIV_CDR
  source 1..21: mol_type = other RNA
aacaatcaagaccgcccgagc

SEQ ID NO: 59215 - RNA, 21 nt, synthetic construct
  misc_feature 1..21: note = derived and/or modified sequence opt11 from anti-HIV_CDR
  source 1..21: mol_type = other RNA
gacgacagcgaccgcccaagc

SEQ ID NO: 59216 - RNA, 21 nt, synthetic construct
  misc_feature 1..21: note = derived and/or modified sequence opt11 from anti-HIV_CDR
  source 1..21: mol_type = other RNA
tgggcaagcacacgccatacc

SEQ ID NO: 59217 - RNA, 21 nt, synthetic construct
  misc_feature 1..21: note = derived and/or modified sequence opt11 from anti-HIV_CDR
  source 1..21: mol_type = other RNA
ggcgcgaccgcgcgcgatttc

SEQ ID NO: 59218 - RNA, 21 nt, synthetic construct
  misc_feature 1..21: note = derived and/or modified sequence opt11 from anti-HIV_CDR
  source 1..21: mol_type = other RNA
gcctccatcaaactcgcccta

SEQ ID NO: 59219 - RNA, 21 nt, synthetic construct
  misc_feature 1..21: note = derived and/or modified sequence opt11 from anti-HIV_CDR
  source 1..21: mol_type = other RNA
caacaatacggccgctcaccc

SEQ ID NO: 59220 - RNA, 21 nt, synthetic construct
  misc_feature 1..21: note = derived and/or modified sequence opt11 from anti-HIV_CDR
  source 1..21: mol_type = other RNA
caacaatactacatctccccc

SEQ ID NO: 59221 - RNA, 21 nt, synthetic construct
  misc_feature 1..21: note = derived and/or modified sequence opt11 from anti-HIV_CDR
  source 1..21: mol_type = other RNA
caacaatcccactccccctcc

SEQ ID NO: 59222 - RNA, 21 nt, synthetic construct
  misc_feature 1..21: note = derived and/or modified sequence opt11 from anti-HIV_CDR
  source 1..21: mol_type = other RNA
gggaggtgtgcgaggaggtgg

SEQ ID NO: 59223 - RNA, 21 nt, synthetic construct
  misc_feature 1..21: note = derived and/or modified sequence opt11 from anti-HIV_CDR
  source 1..21: mol_type = other RNA
aggttcttgttcgtggtcgcg

SEQ ID NO: 59224 - RNA, 21 nt, synthetic construct
  misc_feature 1..21: note = derived and/or modified sequence opt11 from anti-HIV_CDR
  source 1..21: mol_type = other RNA
atgtccgtctccttcctcatc

SEQ ID NO: 59225 - RNA, 21 nt, synthetic construct
  misc_feature 1..21: note = derived and/or modified sequence opt11 from anti-HIV_CDR
  source 1..21: mol_type = other RNA
ggaagctcgaacaggtgcccg

SEQ ID NO: 59226 - RNA, 21 nt, synthetic construct
  misc_feature 1..21: note = derived and/or modified sequence opt11 from anti-HIV_CDR
  source 1..21: mol_type = other RNA
atgaaacacctctggttcttc

SEQ ID NO: 59227 - RNA, 21 nt, synthetic construct
  misc_feature 1..21: note = derived and/or modified sequence opt11 from anti-HIV_CDR
  source 1..21: mol_type = other RNA
gcctcatgggacttcgacttc

SEQ ID NO: 59228 - RNA, 21 nt, synthetic construct
  misc_feature 1..21: note = derived and/or modified sequence opt11 from anti-HIV_CDR
  source 1..21: mol_type = other RNA
gaaataggggtggcggagcat

SEQ ID NO: 59229 - RNA, 21 nt, synthetic construct
  misc_feature 1..21: note = derived and/or modified sequence opt11 from anti-HIV_CDR
  source 1..21: mol_type = other RNA
caaaaatacgacaccgccccc

SEQ ID NO: 59230 - RNA, 21 nt, synthetic construct
  misc_feature 1..21: note = derived and/or modified sequence opt11 from anti-HIV_CDR
  source 1..21: mol_type = other RNA
caacaatcctcctccaccccc

SEQ ID NO: 59231 - RNA, 21 nt, synthetic construct
  misc_feature 1..21: note = derived and/or modified sequence opt11 from anti-HIV_CDR
  source 1..21: mol_type = other RNA
caacagagcgcaggcacaccc

SEQ ID NO: 59232 - RNA, 21 nt, synthetic construct
  misc_feature 1..21: note = derived and/or modified sequence opt11 from anti-HIV_CDR
  source 1..21: mol_type = other RNA
caacaatcctcctccaaaccc

SEQ ID NO: 59233 - RNA, 21 nt, synthetic construct
  misc_feature 1..21: note = derived and/or modified sequence opt11 from anti-HIV_CDR
  source 1..21: mol_type = other RNA
caagaatacaacacctacacc

SEQ ID NO: 59234 - RNA, 21 nt, synthetic construct
  misc_feature 1..21: note = derived and/or modified sequence opt11 from anti-HIV_CDR
  source 1..21: mol_type = other RNA
caagaatacaacaactacaac

SEQ ID NO: 59235 - RNA, 21 nt, synthetic construct
  misc_feature 1..21: note = derived and/or modified sequence opt11 from anti-HIV_CDR
  source 1..21: mol_type = other RNA
cactacgacgccctagactac

SEQ ID NO: 59236 - RNA, 24 nt, synthetic construct
  misc_feature 1..24: note = derived and/or modified sequence opt11 from anti-HIV_CDR
  source 1..24: mol_type = other RNA
gcgatctttaaaggggtccagtgc

SEQ ID NO: 59237 - RNA, 24 nt, synthetic construct
  misc_feature 1..24: note = derived and/or modified sequence opt11 from anti-HIV_CDR
  source 1..24: mol_type = other RNA
ggccccctcggcgattacgacttc

SEQ ID NO: 59238 - RNA, 24 nt, synthetic construct
  misc_feature 1..24: note = derived and/or modified sequence opt11 from anti-HIV_CDR
  source 1..24: mol_type = other RNA
caacaatacggctcatccctccgc

SEQ ID NO: 59239 - RNA, 24 nt, synthetic construct
  misc_feature 1..24: note = derived and/or modified sequence opt11 from anti-HIV_CDR
  source 1..24: mol_type = other RNA
caacaatactcccactaccgcacc

SEQ ID NO: 59240 - RNA, 24 nt, synthetic construct
  misc_feature 1..24: note = derived and/or modified sequence opt11 from anti-HIV_CDR
  source 1..24: mol_type = other RNA
caatactacggcatgtccgtcacc

SEQ ID NO: 59241 - RNA, 24 nt, synthetic construct
  misc_feature 1..24: note = derived and/or modified sequence opt11 from anti-HIV_CDR
  source 1..24: mol_type = other RNA
caacagtacgagaactggctcaca

SEQ ID NO: 59242 - RNA, 24 nt, synthetic construct
  misc_feature 1..24: note = derived and/or modified sequence opt11 from anti-HIV_CDR
  source 1..24: mol_type = other RNA
tccggagtccactacatggacgtc

SEQ ID NO: 59243 - RNA, 24 nt, synthetic construct
  misc_feature 1..24: note = derived and/or modified sequence opt11 from anti-HIV_CDR
  source 1..24: mol_type = other RNA
caacaatactccggccccctcacc

SEQ ID NO: 59244 - RNA, 24 nt, synthetic construct
  misc_feature 1..24: note = derived and/or modified sequence opt11 from anti-HIV_CDR
  source 1..24: mol_type = other RNA
caacaatactacaccgtcccctcc

SEQ ID NO: 59245 - RNA, 24 nt, synthetic construct
  misc_feature 1..24: note = derived and/or modified sequence opt11 from anti-HIV_CDR
  source 1..24: mol_type = other RNA
caacaatacggctcatccatcacc

SEQ ID NO: 59246 - RNA, 24 nt, synthetic construct
  misc_feature 1..24: note = derived and/or modified sequence opt11 from anti-HIV_CDR
  source 1..24: mol_type = other RNA
caccaatacaacaaatgggacacc

SEQ ID NO: 59247 - RNA, 24 nt, synthetic construct
  misc_feature 1..24: note = derived and/or modified sequence opt11 from anti-HIV_CDR
  source 1..24: mol_type = other RNA
caacaatcctacaccacccccctc

SEQ ID NO: 59248 - RNA, 24 nt, synthetic construct
  misc_feature 1..24: note = derived and/or modified sequence opt11 from anti-HIV_CDR
  source 1..24: mol_type = other RNA
cagcgctgggaaacgatcgattac

SEQ ID NO: 59249 - RNA, 24 nt, synthetic construct
  misc_feature 1..24: note = derived and/or modified sequence opt11 from anti-HIV_CDR
  source 1..24: mol_type = other RNA
tgctcgtacgcgggctcgtacacg

SEQ ID NO: 59250 - RNA, 24 nt, synthetic construct
  misc_feature 1..24: note = derived and/or modified sequence opt11 from anti-HIV_CDR
  source 1..24: mol_type = other RNA
caacaatacgacaacctccccacc

SEQ ID NO: 59251 - RNA, 24 nt, synthetic construct
  misc_feature 1..24: note = derived and/or modified sequence opt11 from anti-HIV_CDR
  source 1..24: mol_type = other RNA
caacaatgcaccctccccctcacc

SEQ ID NO: 59252 - RNA, 24 nt, synthetic construct
  misc_feature 1..24: note = derived and/or modified sequence opt11 from anti-HIV_CDR
  source 1..24: mol_type = other RNA
caacaatcctactcctccgtcacc

SEQ ID NO: 59253 - RNA, 24 nt, synthetic construct
  misc_feature 1..24: note = derived and/or modified sequence opt11 from anti-HIV_CDR
  source 1..24: mol_type = other RNA
caacaatcccacacctccgtcacc

SEQ ID NO: 59254 - RNA, 24 nt, synthetic construct
  misc_feature 1..24: note = derived and/or modified sequence opt11 from anti-HIV_CDR
  source 1..24: mol_type = other RNA
caacaaacatacgcctccgtcacc

SEQ ID NO: 59255 - RNA, 24 nt, synthetic construct
  misc_feature 1..24: note = derived and/or modified sequence opt11 from anti-HIV_CDR
  source 1..24: mol_type = other RNA
caacaatacaactccgactacacc

SEQ ID NO: 59256 - RNA, 24 nt, synthetic construct
  misc_feature 1..24: note = derived and/or modified sequence opt11 from anti-HIV_CDR
  source 1..24: mol_type = other RNA
cacctatacgtctccagacccgtc

SEQ ID NO: 59257 - RNA, 24 nt, synthetic construct
  misc_feature 1..24: note = derived and/or modified sequence opt11 from anti-HIV_CDR
  source 1..24: mol_type = other RNA
caacaatacggccgctcccccctc

SEQ ID NO: 59258 - RNA, 24 nt, synthetic construct
  misc_feature 1..24: note = derived and/or modified sequence opt11 from anti-HIV_CDR
  source 1..24: mol_type = other RNA
caacaatacggctcctcccccctc

SEQ ID NO: 59259 - RNA, 24 nt, synthetic construct
  misc_feature 1..24: note = derived and/or modified sequence opt11 from anti-HIV_CDR
  source 1..24: mol_type = other RNA
caacaatacaacgactggccagcc

SEQ ID NO: 59260 - RNA, 24 nt, synthetic construct
  misc_feature 1..24: note = derived and/or modified sequence opt11 from anti-HIV_CDR
  source 1..24: mol_type = other RNA
caccaatacggctcatcccaacgc

SEQ ID NO: 59261 - RNA, 24 nt, synthetic construct
  misc_feature 1..24: note = derived and/or modified sequence opt11 from anti-HIV_CDR
  source 1..24: mol_type = other RNA
caacaaacctactcctccgtcacc

SEQ ID NO: 59262 - RNA, 24 nt, synthetic construct
  misc_feature 1..24: note = derived and/or modified sequence opt11 from anti-HIV_CDR
  source 1..24: mol_type = other RNA
caacaaacctaccgctccgtcacc

SEQ ID NO: 59263 - RNA, 24 nt, synthetic construct
  misc_feature 1..24: note = derived and/or modified sequence opt11 from anti-HIV_CDR
  source 1..24: mol_type = other RNA
caacaatacggctcaagctggacc

SEQ ID NO: 59264 - RNA, 24 nt, synthetic construct
  misc_feature 1..24: note = derived and/or modified sequence opt11 from anti-HIV_CDR
  source 1..24: mol_type = other RNA
agctcatacgccggcataaacaac

SEQ ID NO: 59265 - RNA, 24 nt, synthetic construct
  misc_feature 1..24: note = derived and/or modified sequence opt11 from anti-HIV_CDR
  source 1..24: mol_type = other RNA
caaaaatacggctcctccctcacc

SEQ ID NO: 59266 - RNA, 24 nt, synthetic construct
  misc_feature 1..24: note = derived and/or modified sequence opt11 from anti-HIV_CDR
  source 1..24: mol_type = other RNA
atgcaagcgctcgagaccttgggc

SEQ ID NO: 59267 - RNA, 24 nt, synthetic construct
  misc_feature 1..24: note = derived and/or modified sequence opt11 from anti-HIV_CDR
  source 1..24: mol_type = other RNA
caacaatacgccggctccctcacc

SEQ ID NO: 59268 - RNA, 24 nt, synthetic construct
  misc_feature 1..24: note = derived and/or modified sequence opt11 from anti-HIV_CDR
  source 1..24: mol_type = other RNA
cggaactggggcaatttcgaccac

SEQ ID NO: 59269 - RNA, 27 nt, synthetic construct
  misc_feature 1..27: note = derived and/or modified sequence opt11 from anti-HIV_CDR
  source 1..27: mol_type = other RNA
caacaacactacaccaccccctggacc

SEQ ID NO: 59270 - RNA, 27 nt, synthetic construct
  misc_feature 1..27: note = derived and/or modified sequence opt11 from anti-HIV_CDR
  source 1..27: mol_type = other RNA
caacaatccttcgccgtcccctacacc

SEQ ID NO: 59271 - RNA, 27 nt, synthetic construct
  misc_feature 1..27: note = derived and/or modified sequence opt11 from anti-HIV_CDR
  source 1..27: mol_type = other RNA
caacaatacaaatcctactccggcacc

SEQ ID NO: 59272 - RNA, 27 nt, synthetic construct
  misc_feature 1..27: note = derived and/or modified sequence opt11 from anti-HIV_CDR
  source 1..27: mol_type = other RNA
caccaatacgcctactcaccccgcacc

SEQ ID NO: 59273 - RNA, 27 nt, synthetic construct
  misc_feature 1..27: note = derived and/or modified sequence opt11 from anti-HIV_CDR
  source 1..27: mol_type = other RNA
caacaatacaactccttcccccccacc

SEQ ID NO: 59274 - RNA, 27 nt, synthetic construct
  misc_feature 1..27: note = derived and/or modified sequence opt11 from anti-HIV_CDR
  source 1..27: mol_type = other RNA
cagcaaacatactcaaacccgcgcatg

SEQ ID NO: 59275 - RNA, 27 nt, synthetic construct
  misc_feature 1..27: note = derived and/or modified sequence opt11 from anti-HIV_CDR
  source 1..27: mol_type = other RNA
caacaatacgaagacccgccctggacc

SEQ ID NO: 59276 - RNA, 27 nt, synthetic construct
  misc_feature 1..27: note = derived and/or modified sequence opt11 from anti-HIV_CDR
  source 1..27: mol_type = other RNA
caccaatacttcaacaccccccgcacc

SEQ ID NO: 59277 - RNA, 27 nt, synthetic construct
  misc_feature 1..27: note = derived and/or modified sequence opt11 from anti-HIV_CDR
  source 1..27: mol_type = other RNA
caccaatacttctccaccccccgcacc

SEQ ID NO: 59278 - RNA, 27 nt, synthetic construct
  misc_feature 1..27: note = derived and/or modified sequence opt11 from anti-HIV_CDR
  source 1..27: mol_type = other RNA
caacaccgctccaactggccctggacc

SEQ ID NO: 59279 - RNA, 27 nt, synthetic construct
  misc_feature 1..27: note = derived and/or modified sequence opt11 from anti-HIV_CDR
  source 1..27: mol_type = other RNA
cgcgggcgcaggcaaataggcgattac

SEQ ID NO: 59280 - RNA, 27 nt, synthetic construct
  misc_feature 1..27: note = derived and/or modified sequence opt11 from anti-HIV_CDR
  source 1..27: mol_type = other RNA
caacaatacggcctctcaccctggacc

SEQ ID NO: 59281 - RNA, 27 nt, synthetic construct
  misc_feature 1..27: note = derived and/or modified sequence opt11 from anti-HIV_CDR
  source 1..27: mol_type = other RNA
caacaaacctacacctcccccatcacc

SEQ ID NO: 59282 - RNA, 27 nt, synthetic construct
  misc_feature 1..27: note = derived and/or modified sequence opt11 from anti-HIV_CDR
  source 1..27: mol_type = other RNA
caacaatacggctcctccccccccacc

SEQ ID NO: 59283 - RNA, 27 nt, synthetic construct
  misc_feature 1..27: note = derived and/or modified sequence opt11 from anti-HIV_CDR
  source 1..27: mol_type = other RNA
caacaatacggcacctcctcctgcacc

SEQ ID NO: 59284 - RNA, 27 nt, synthetic construct
  misc_feature 1..27: note = derived and/or modified sequence opt11 from anti-HIV_CDR
  source 1..27: mol_type = other RNA
caacaatacgacgacgcacccataacc

SEQ ID NO: 59285 - RNA, 27 nt, synthetic construct
  misc_feature 1..27: note = derived and/or modified sequence opt11 from anti-HIV_CDR
  source 1..27: mol_type = other RNA
ggcccactcctccgctatctcgacagc

SEQ ID NO: 59286 - RNA, 27 nt, synthetic construct
  misc_feature 1..27: note = derived and/or modified sequence opt11 from anti-HIV_CDR
  source 1..27: mol_type = other RNA
tgcctcaaaaaaacctcctcctacgtc

SEQ ID NO: 59287 - RNA, 27 nt, synthetic construct
  misc_feature 1..27: note = derived and/or modified sequence opt11 from anti-HIV_CDR
  source 1..27: mol_type = other RNA
caacaatacaaccactggccccaaacc

SEQ ID NO: 59288 - RNA, 27 nt, synthetic construct
  misc_feature 1..27: note = derived and/or modified sequence opt11 from anti-HIV_CDR
  source 1..27: mol_type = other RNA
caacaatactccaacctcccctacacc

SEQ ID NO: 59289 - RNA, 27 nt, synthetic construct
  misc_feature 1..27: note = derived and/or modified sequence opt11 from anti-HIV_CDR
  source 1..27: mol_type = other RNA
caacaatacgacacctaccccggcacc

SEQ ID NO: 59290 - RNA, 27 nt, synthetic construct
  misc_feature 1..27: note = derived and/or modified sequence opt11 from anti-HIV_CDR
  source 1..27: mol_type = other RNA
caagagtactcgagcacgccctataac

SEQ ID NO: 59291 - RNA, 27 nt, synthetic construct
  misc_feature 1..27: note = derived and/or modified sequence opt11 from anti-HIV_CDR
  source 1..27: mol_type = other RNA
ggggcgtgggacgacacgttatatgta

SEQ ID NO: 59292 - RNA, 27 nt, synthetic construct
  misc_feature 1..27: note = derived and/or modified sequence opt11 from anti-HIV_CDR
  source 1..27: mol_type = other RNA
gcggcctgggacgacacattatacgta

SEQ ID NO: 59293 - RNA, 27 nt, synthetic construct
  misc_feature 1..27: note = derived and/or modified sequence opt11 from anti-HIV_CDR
  source 1..27: mol_type = other RNA
caacaatactactccgactccatcacc

SEQ ID NO: 59294 - RNA, 27 nt, synthetic construct
  misc_feature 1..27: note = derived and/or modified sequence opt11 from anti-HIV_CDR
  source 1..27: mol_type = other RNA
caacaatacggccgctcaccctacacc

SEQ ID NO: 59295 - RNA, 27 nt, synthetic construct
  misc_feature 1..27: note = derived and/or modified sequence opt11 from anti-HIV_CDR
  source 1..27: mol_type = other RNA
caacaatacaccaactacccctggacc

SEQ ID NO: 59296 - RNA, 27 nt, synthetic construct
  misc_feature 1..27: note = derived and/or modified sequence opt11 from anti-HIV_CDR
  source 1..27: mol_type = other RNA
caacaacgccacaactggcccatctcc

SEQ ID NO: 59297 - RNA, 27 nt, synthetic construct
  misc_feature 1..27: note = derived and/or modified sequence opt11 from anti-HIV_CDR
  source 1..27: mol_type = other RNA
caacaataccacaactggccccgcacc

SEQ ID NO: 59298 - RNA, 27 nt, synthetic construct
  misc_feature 1..27: note = derived and/or modified sequence opt11 from anti-HIV_CDR
  source 1..27: mol_type = other RNA
caacaacgctccacctggccccccacc

SEQ ID NO: 59299 - RNA, 27 nt, synthetic construct
  misc_feature 1..27: note = derived and/or modified sequence opt11 from anti-HIV_CDR
  source 1..27: mol_type = other RNA
caacaatacgactccttctcctggacc

SEQ ID NO: 59300 - RNA, 27 nt, synthetic construct
  misc_feature 1..27: note = derived and/or modified sequence opt11 from anti-HIV_CDR
  source 1..27: mol_type = other RNA
caacaatacaacaacctccccgtcacc

SEQ ID NO: 59301 - RNA, 27 nt, synthetic construct
  misc_feature 1..27: note = derived and/or modified sequence opt11 from anti-HIV_CDR
  source 1..27: mol_type = other RNA
caacaatacaaccgctactcctacacc

SEQ ID NO: 59302 - RNA, 27 nt, synthetic construct
  misc_feature 1..27: note = derived and/or modified sequence opt11 from anti-HIV_CDR
  source 1..27: mol_type = other RNA
caagaatactacatcctcccctgctcc

SEQ ID NO: 59303 - RNA, 27 nt, synthetic construct
  misc_feature 1..27: note = derived and/or modified sequence opt11 from anti-HIV_CDR
  source 1..27: mol_type = other RNA
caacaatacgacaacctactcgcccac

SEQ ID NO: 59304 - RNA, 27 nt, synthetic construct
  misc_feature 1..27: note = derived and/or modified sequence opt11 from anti-HIV_CDR
  source 1..27: mol_type = other RNA
caccagtgcgataacttgatcgcacgc

SEQ ID NO: 59305 - RNA, 27 nt, synthetic construct
  misc_feature 1..27: note = derived and/or modified sequence opt11 from anti-HIV_CDR
  source 1..27: mol_type = other RNA
caacaatccttctccaccctctggacc

SEQ ID NO: 59306 - RNA, 27 nt, synthetic construct
  misc_feature 1..27: note = derived and/or modified sequence opt11 from anti-HIV_CDR
  source 1..27: mol_type = other RNA
caccaatcctactccaccccccccacc

SEQ ID NO: 59307 - RNA, 27 nt, synthetic construct
  misc_feature 1..27: note = derived and/or modified sequence opt11 from anti-HIV_CDR
  source 1..27: mol_type = other RNA
caacaaggctactccaccccctggacc

SEQ ID NO: 59308 - RNA, 27 nt, synthetic construct
  misc_feature 1..27: note = derived and/or modified sequence opt11 from anti-HIV_CDR
  source 1..27: mol_type = other RNA
caacaatactccaccaccccccgcacc

SEQ ID NO: 59309 - RNA, 27 nt, synthetic construct
  misc_feature 1..27: note = derived and/or modified sequence opt11 from anti-HIV_CDR
  source 1..27: mol_type = other RNA
caactctacaactccgtcccccaaacc

SEQ ID NO: 59310 - RNA, 27 nt, synthetic construct
  misc_feature 1..27: note = derived and/or modified sequence opt11 from anti-HIV_CDR
  source 1..27: mol_type = other RNA
caacaacgcacctcctggccccaaacc

SEQ ID NO: 59311 - RNA, 27 nt, synthetic construct
  misc_feature 1..27: note = derived and/or modified sequence opt11 from anti-HIV_CDR
  source 1..27: mol_type = other RNA
caacaattcaacacctactcccaaacc

SEQ ID NO: 59312 - RNA, 27 nt, synthetic construct
  misc_feature 1..27: note = derived and/or modified sequence opt11 from anti-HIV_CDR
  source 1..27: mol_type = other RNA
atgcaatccctccaaacccccatcacc

SEQ ID NO: 59313 - RNA, 27 nt, synthetic construct
  misc_feature 1..27: note = derived and/or modified sequence opt11 from anti-HIV_CDR
  source 1..27: mol_type = other RNA
caacaatacaactcctaccccctcacc

SEQ ID NO: 59314 - RNA, 27 nt, synthetic construct
  misc_feature 1..27: note = derived and/or modified sequence opt11 from anti-HIV_CDR
  source 1..27: mol_type = other RNA
caacaatacaactcctactccggcacc

SEQ ID NO: 59315 - RNA, 27 nt, synthetic construct
  misc_feature 1..27: note = derived and/or modified sequence opt11 from anti-HIV_CDR
  source 1..27: mol_type = other RNA
caatcctacgactcctcactctccggc

SEQ ID NO: 59316 - RNA, 27 nt, synthetic construct
  misc_feature 1..27: note = derived and/or modified sequence opt11 from anti-HIV_CDR
  source 1..27: mol_type = other RNA
agccaaggcaataccgcaatcgactac

SEQ ID NO: 59317 - RNA, 27 nt, synthetic construct
  misc_feature 1..27: note = derived and/or modified sequence opt11 from anti-HIV_CDR
  source 1..27: mol_type = other RNA
gaggaacccagggacgcgttcgatcta

SEQ ID NO: 59318 - RNA, 27 nt, synthetic construct
  misc_feature 1..27: note = derived and/or modified sequence opt11 from anti-HIV_CDR
  source 1..27: mol_type = other RNA
caacaatcctacaccacccccgtcacc

SEQ ID NO: 59319 - RNA, 27 nt, synthetic construct
  misc_feature 1..27: note = derived and/or modified sequence opt11 from anti-HIV_CDR
  source 1..27: mol_type = other RNA
gccgggcgagagggctggttcgatcca

SEQ ID NO: 59320 - RNA, 27 nt, synthetic construct
  misc_feature 1..27: note = derived and/or modified sequence opt11 from anti-HIV_CDR
  source 1..27: mol_type = other RNA
caacaatactactccaccccccacacc

SEQ ID NO: 59321 - RNA, 27 nt, synthetic construct
  misc_feature 1..27: note = derived and/or modified sequence opt11 from anti-HIV_CDR
  source 1..27: mol_type = other RNA
cagcaatcgtactcgatcgcgggcacg

SEQ ID NO: 59322 - RNA, 27 nt, synthetic construct
  misc_feature 1..27: note = derived and/or modified sequence opt11 from anti-HIV_CDR
  source 1..27: mol_type = other RNA
caaaactacaacaaacccccccgcacc

SEQ ID NO: 59323 - RNA, 27 nt, synthetic construct
  misc_feature 1..27: note = derived and/or modified sequence opt11 from anti-HIV_CDR
  source 1..27: mol_type = other RNA
atgcaatccatccaactccccctcacc

SEQ ID NO: 59324 - RNA, 27 nt, synthetic construct
  misc_feature 1..27: note = derived and/or modified sequence opt11 from anti-HIV_CDR
  source 1..27: mol_type = other RNA
atgcaagcgctccagacctcgctcacg

SEQ ID NO: 59325 - RNA, 27 nt, synthetic construct
  misc_feature 1..27: note = derived and/or modified sequence opt11 from anti-HIV_CDR
  source 1..27: mol_type = other RNA
caacaatactcctcctccccccgcacc

SEQ ID NO: 59326 - RNA, 27 nt, synthetic construct
  misc_feature 1..27: note = derived and/or modified sequence opt11 from anti-HIV_CDR
  source 1..27: mol_type = other RNA
caagcgtgggatagctcgaccgcggtc

SEQ ID NO: 59327 - RNA, 27 nt, synthetic construct
  misc_feature 1..27: note = derived and/or modified sequence opt11 from anti-HIV_CDR
  source 1..27: mol_type = other RNA
caacactacaacaactggccctacacc

SEQ ID NO: 59328 - RNA, 27 nt, synthetic construct
  misc_feature 1..27: note = derived and/or modified sequence opt11 from anti-HIV_CDR
  source 1..27: mol_type = other RNA
caacaatacgaccgcctacccataacc

SEQ ID NO: 59329 - RNA, 27 nt, synthetic construct
  misc_feature 1..27: note = derived and/or modified sequence opt11 from anti-HIV_CDR
  source 1..27: mol_type = other RNA
caacaatacggctcctcacccatcacc

SEQ ID NO: 59330 - RNA, 27 nt, synthetic construct
  misc_feature 1..27: note = derived and/or modified sequence opt11 from anti-HIV_CDR
  source 1..27: mol_type = other RNA
caacaatacgacgtctggcccctcacc

SEQ ID NO: 59331 - RNA, 27 nt, synthetic construct
  misc_feature 1..27: note = derived and/or modified sequence opt11 from anti-HIV_CDR
  source 1..27: mol_type = other RNA
caccaatacgcctcctcaccccgcacc

SEQ ID NO: 59332 - RNA, 27 nt, synthetic construct
  misc_feature 1..27: note = derived and/or modified sequence opt11 from anti-HIV_CDR
  source 1..27: mol_type = other RNA
atgcaatccctccacctcccctacacc

SEQ ID NO: 59333 - RNA, 27 nt, synthetic construct
  misc_feature 1..27: note = derived and/or modified sequence opt11 from anti-HIV_CDR
  source 1..27: mol_type = other RNA
caacaatactactcctcccccctcacc

SEQ ID NO: 59334 - RNA, 27 nt, synthetic construct
  misc_feature 1..27: note = derived and/or modified sequence opt11 from anti-HIV_CDR
  source 1..27: mol_type = other RNA
caacaacacgacaccttccccttcacc

SEQ ID NO: 59335 - RNA, 27 nt, synthetic construct
  misc_feature 1..27: note = derived and/or modified sequence opt11 from anti-HIV_CDR
  source 1..27: mol_type = other RNA
caacaatcctactccaccccctacacc

SEQ ID NO: 59336 - RNA, 27 nt, synthetic construct
  misc_feature 1..27: note = derived and/or modified sequence opt11 from anti-HIV_CDR
  source 1..27: mol_type = other RNA
caacaatacaaaacctaccccgtcacc

SEQ ID NO: 59337 - RNA, 27 nt, synthetic construct
  misc_feature 1..27: note = derived and/or modified sequence opt11 from anti-HIV_CDR
  source 1..27: mol_type = other RNA
caacaatactactccacccccgtcacc

SEQ ID NO: 59338 - RNA, 27 nt, synthetic construct
  misc_feature 1..27: note = derived and/or modified sequence opt11 from anti-HIV_CDR
  source 1..27: mol_type = other RNA
caacaatacaactggccccccttcacc

SEQ ID NO: 59339 - RNA, 27 nt, synthetic construct
  misc_feature 1..27: note = derived and/or modified sequence opt11 from anti-HIV_CDR
  source 1..27: mol_type = other RNA
atgcaaggaacccactggccatggaca

SEQ ID NO: 59340 - RNA, 27 nt, synthetic construct
  misc_feature 1..27: note = derived and/or modified sequence opt11 from anti-HIV_CDR
  source 1..27: mol_type = other RNA
caccaatgcggctcctcaccccgcacc

SEQ ID NO: 59341 - RNA, 27 nt, synthetic construct
  misc_feature 1..27: note = derived and/or modified sequence opt11 from anti-HIV_CDR
  source 1..27: mol_type = other RNA
caacaatacaactcctacttccgcacc

SEQ ID NO: 59342 - RNA, 27 nt, synthetic construct
  misc_feature 1..27: note = derived and/or modified sequence opt11 from anti-HIV_CDR
  source 1..27: mol_type = other RNA
caacaataccacaactggcccccctcc

SEQ ID NO: 59343 - RNA, 27 nt, synthetic construct
  misc_feature 1..27: note = derived and/or modified sequence opt11 from anti-HIV_CDR
  source 1..27: mol_type = other RNA
atgcagggaacgtactggctgtggaca

SEQ ID NO: 59344 - RNA, 27 nt, synthetic construct
  misc_feature 1..27: note = derived and/or modified sequence opt11 from anti-HIV_CDR
  source 1..27: mol_type = other RNA
caacaaggcttctccgcccccttcacc

SEQ ID NO: 59345 - RNA, 27 nt, synthetic construct
  misc_feature 1..27: note = derived and/or modified sequence opt11 from anti-HIV_CDR
  source 1..27: mol_type = other RNA
caacaatacaacacctaccccctcacc

SEQ ID NO: 59346 - RNA, 27 nt, synthetic construct
  misc_feature 1..27: note = derived and/or modified sequence opt11 from anti-HIV_CDR
  source 1..27: mol_type = other RNA
atgcaaggaacccactggccacgcaca

SEQ ID NO: 59347 - RNA, 27 nt, synthetic construct
  misc_feature 1..27: note = derived and/or modified sequence opt11 from anti-HIV_CDR
  source 1..27: mol_type = other RNA
ttcgggcgcacgccctggttcgatccc

SEQ ID NO: 59348 - RNA, 27 nt, synthetic construct
  misc_feature 1..27: note = derived and/or modified sequence opt11 from anti-HIV_CDR
  source 1..27: mol_type = other RNA
caacaatacttcacctccgtcatcacc

SEQ ID NO: 59349 - RNA, 27 nt, synthetic construct
  misc_feature 1..27: note = derived and/or modified sequence opt11 from anti-HIV_CDR
  source 1..27: mol_type = other RNA
caccactacatgtccgacctccaaacc

SEQ ID NO: 59350 - RNA, 27 nt, synthetic construct
  misc_feature 1..27: note = derived and/or modified sequence opt11 from anti-HIV_CDR
  source 1..27: mol_type = other RNA
caccactactcctcctcctcccacacc

SEQ ID NO: 59351 - RNA, 27 nt, synthetic construct
  misc_feature 1..27: note = derived and/or modified sequence opt11 from anti-HIV_CDR
  source 1..27: mol_type = other RNA
caccactacaaatccgactgccaaacc

SEQ ID NO: 59352 - RNA, 27 nt, synthetic construct
  misc_feature 1..27: note = derived and/or modified sequence opt11 from anti-HIV_CDR
  source 1..27: mol_type = other RNA
cagcacagaagctcgtggccgctcaca

SEQ ID NO: 59353 - RNA, 27 nt, synthetic construct
  misc_feature 1..27: note = derived and/or modified sequence opt11 from anti-HIV_CDR
  source 1..27: mol_type = other RNA
ctccaacaccactcctacccctggacc

SEQ ID NO: 59354 - RNA, 27 nt, synthetic construct
  misc_feature 1..27: note = derived and/or modified sequence opt11 from anti-HIV_CDR
  source 1..27: mol_type = other RNA
caacaatacggcacctcacccggcacc

SEQ ID NO: 59355 - RNA, 27 nt, synthetic construct
  misc_feature 1..27: note = derived and/or modified sequence opt11 from anti-HIV_CDR
  source 1..27: mol_type = other RNA
caacaatacggctcctcacccaccacc

SEQ ID NO: 59356 - RNA, 27 nt, synthetic construct
  misc_feature 1..27: note = derived and/or modified sequence opt11 from anti-HIV_CDR
  source 1..27: mol_type = other RNA
caacaatacggcacctcacccaccacc

SEQ ID NO: 59357 - RNA, 27 nt, synthetic construct
  misc_feature 1..27: note = derived and/or modified sequence opt11 from anti-HIV_CDR
  source 1..27: mol_type = other RNA
atgcaagcaacccactggccacccgga

SEQ ID NO: 59358 - RNA, 27 nt, synthetic construct
  misc_feature 1..27: note = derived and/or modified sequence opt11 from anti-HIV_CDR
  source 1..27: mol_type = other RNA
caacgctacaaccgcgacccctacatc

SEQ ID NO: 59359 - RNA, 27 nt, synthetic construct
  misc_feature 1..27: note = derived and/or modified sequence opt11 from anti-HIV_CDR
  source 1..27: mol_type = other RNA
caacaatacgacaacctacccctcgcc

SEQ ID NO: 59360 - RNA, 27 nt, synthetic construct
  misc_feature 1..27: note = derived and/or modified sequence opt11 from anti-HIV_CDR
  source 1..27: mol_type = other RNA
tcatcatactccgccaccggcgtcgcc

SEQ ID NO: 59361 - RNA, 27 nt, synthetic construct
  misc_feature 1..27: note = derived and/or modified sequence opt11 from anti-HIV_CDR
  source 1..27: mol_type = other RNA
caacactacggcaactcacgctggacc

SEQ ID NO: 59362 - RNA, 27 nt, synthetic construct
  misc_feature 1..27: note = derived and/or modified sequence opt11 from anti-HIV_CDR
  source 1..27: mol_type = other RNA
caacaatacgaaacctacccctggacc

SEQ ID NO: 59363 - RNA, 27 nt, synthetic construct
  misc_feature 1..27: note = derived and/or modified sequence opt11 from anti-HIV_CDR
  source 1..27: mol_type = other RNA
caacaatacggctcctccccctccacc

SEQ ID NO: 59364 - RNA, 27 nt, synthetic construct
  misc_feature 1..27: note = derived and/or modified sequence opt11 from anti-HIV_CDR
  source 1..27: mol_type = other RNA
caacaatcccaacgcaccccccacacc

SEQ ID NO: 59365 - RNA, 27 nt, synthetic construct
  misc_feature 1..27: note = derived and/or modified sequence opt11 from anti-HIV_CDR
  source 1..27: mol_type = other RNA
caacaatacgacatcctccccctcacc

SEQ ID NO: 59366 - RNA, 27 nt, synthetic construct
  misc_feature 1..27: note = derived and/or modified sequence opt11 from anti-HIV_CDR
  source 1..27: mol_type = other RNA
caacaatccaactcctccccctggacc

SEQ ID NO: 59367 - RNA, 27 nt, synthetic construct
  misc_feature 1..27: note = derived and/or modified sequence opt11 from anti-HIV_CDR
  source 1..27: mol_type = other RNA
caacaatcatacgacaccccccgcacc

SEQ ID NO: 59368 - RNA, 27 nt, synthetic construct
  misc_feature 1..27: note = derived and/or modified sequence opt11 from anti-HIV_CDR
  source 1..27: mol_type = other RNA
caacaattcggctcctcacccggcacc

SEQ ID NO: 59369 - RNA, 27 nt, synthetic construct
  misc_feature 1..27: note = derived and/or modified sequence opt11 from anti-HIV_CDR
  source 1..27: mol_type = other RNA
caccaatacggctcctcaccccaaacc

SEQ ID NO: 59370 - RNA, 27 nt, synthetic construct
  misc_feature 1..27: note = derived and/or modified sequence opt11 from anti-HIV_CDR
  source 1..27: mol_type = other RNA
caccaatacggctcctcaccccaatcc

SEQ ID NO: 59371 - RNA, 27 nt, synthetic construct
  misc_feature 1..27: note = derived and/or modified sequence opt11 from anti-HIV_CDR
  source 1..27: mol_type = other RNA
ctccaacacaactcctaccccctcacc

SEQ ID NO: 59372 - RNA, 27 nt, synthetic construct
  misc_feature 1..27: note = derived and/or modified sequence opt11 from anti-HIV_CDR
  source 1..27: mol_type = other RNA
caacaatacaacgactggcccatcacc

SEQ ID NO: 59373 - RNA, 27 nt, synthetic construct
  misc_feature 1..27: note = derived and/or modified sequence opt11 from anti-HIV_CDR
  source 1..27: mol_type = other RNA
caacaaaccttcaccttcccctacacc

SEQ ID NO: 59374 - RNA, 27 nt, synthetic construct
  misc_feature 1..27: note = derived and/or modified sequence opt11 from anti-HIV_CDR
  source 1..27: mol_type = other RNA
caacaatcctacaccttcccctacatc

SEQ ID NO: 59375 - RNA, 27 nt, synthetic construct
  misc_feature 1..27: note = derived and/or modified sequence opt11 from anti-HIV_CDR
  source 1..27: mol_type = other RNA
caatactacggctcctccccctacacc

SEQ ID NO: 59376 - RNA, 27 nt, synthetic construct
  misc_feature 1..27: note = derived and/or modified sequence opt11 from anti-HIV_CDR
  source 1..27: mol_type = other RNA
caacaatccttcggcaccccccgcacc

SEQ ID NO: 59377 - RNA, 27 nt, synthetic construct
  misc_feature 1..27: note = derived and/or modified sequence opt11 from anti-HIV_CDR
  source 1..27: mol_type = other RNA
caacaatacaacgactggccccgcacc

SEQ ID NO: 59378 - RNA, 27 nt, synthetic construct
  misc_feature 1..27: note = derived and/or modified sequence opt11 from anti-HIV_CDR
  source 1..27: mol_type = other RNA
caacaatacggctcctcaccccgcacc

SEQ ID NO: 59379 - RNA, 27 nt, synthetic construct
  misc_feature 1..27: note = derived and/or modified sequence opt11 from anti-HIV_CDR
  source 1..27: mol_type = other RNA
ctccaacacaaccgctacccctggacc

SEQ ID NO: 59380 - RNA, 27 nt, synthetic construct
  misc_feature 1..27: note = derived and/or modified sequence opt11 from anti-HIV_CDR
  source 1..27: mol_type = other RNA
ctccaacacaacaactacccctggacc

SEQ ID NO: 59381 - RNA, 27 nt, synthetic construct
  misc_feature 1..27: note = derived and/or modified sequence opt11 from anti-HIV_CDR
  source 1..27: mol_type = other RNA
ctccaatactccacctaccccctcacc

SEQ ID NO: 59382 - RNA, 27 nt, synthetic construct
  misc_feature 1..27: note = derived and/or modified sequence opt11 from anti-HIV_CDR
  source 1..27: mol_type = other RNA
ctccaatacaacgcctaccccctcacc

SEQ ID NO: 59383 - RNA, 27 nt, synthetic construct
  misc_feature 1..27: note = derived and/or modified sequence opt11 from anti-HIV_CDR
  source 1..27: mol_type = other RNA
caacaatacgactccgcacccgtaacc

SEQ ID NO: 59384 - RNA, 27 nt, synthetic construct
  misc_feature 1..27: note = derived and/or modified sequence opt11 from anti-HIV_CDR
  source 1..27: mol_type = other RNA
caacaaacctacaccttcccctactcc

SEQ ID NO: 59385 - RNA, 27 nt, synthetic construct
  misc_feature 1..27: note = derived and/or modified sequence opt11 from anti-HIV_CDR
  source 1..27: mol_type = other RNA
ggctacgacaactcaggcccggactat

SEQ ID NO: 59386 - RNA, 27 nt, synthetic construct
  misc_feature 1..27: note = derived and/or modified sequence opt11 from anti-HIV_CDR
  source 1..27: mol_type = other RNA
caacaatacaacaactggccccccgcc

SEQ ID NO: 59387 - RNA, 27 nt, synthetic construct
  misc_feature 1..27: note = derived and/or modified sequence opt11 from anti-HIV_CDR
  source 1..27: mol_type = other RNA
caccaatacgccctctcaccctggacc

SEQ ID NO: 59388 - RNA, 27 nt, synthetic construct
  misc_feature 1..27: note = derived and/or modified sequence opt11 from anti-HIV_CDR
  source 1..27: mol_type = other RNA
caaaaatacgacaccgaccccatgacc

SEQ ID NO: 59389 - RNA, 27 nt, synthetic construct
  misc_feature 1..27: note = derived and/or modified sequence opt11 from anti-HIV_CDR
  source 1..27: mol_type = other RNA
caacaatacaactactaccccatcacc

SEQ ID NO: 59390 - RNA, 27 nt, synthetic construct
  misc_feature 1..27: note = derived and/or modified sequence opt11 from anti-HIV_CDR
  source 1..27: mol_type = other RNA
caacaaaccttcaccgaccccgtcacc

SEQ ID NO: 59391 - RNA, 27 nt, synthetic construct
  misc_feature 1..27: note = derived and/or modified sequence opt11 from anti-HIV_CDR
  source 1..27: mol_type = other RNA
gcggcctgggacgatagtttgcacgtg

SEQ ID NO: 59392 - RNA, 27 nt, synthetic construct
  misc_feature 1..27: note = derived and/or modified sequence opt11 from anti-HIV_CDR
  source 1..27: mol_type = other RNA
caacaatacgcctcctcacccttcacc

SEQ ID NO: 59393 - RNA, 27 nt, synthetic construct
  misc_feature 1..27: note = derived and/or modified sequence opt11 from anti-HIV_CDR
  source 1..27: mol_type = other RNA
caacaatcctcctccacccccttcacc

SEQ ID NO: 59394 - RNA, 27 nt, synthetic construct
  misc_feature 1..27: note = derived and/or modified sequence opt11 from anti-HIV_CDR
  source 1..27: mol_type = other RNA
cagcaaaggagcaactgggcgatcaca

SEQ ID NO: 59395 - RNA, 27 nt, synthetic construct
  misc_feature 1..27: note = derived and/or modified sequence opt11 from anti-HIV_CDR
  source 1..27: mol_type = other RNA
caacaatacggctcctcccccttcacc

SEQ ID NO: 59396 - RNA, 27 nt, synthetic construct
  misc_feature 1..27: note = derived and/or modified sequence opt11 from anti-HIV_CDR
  source 1..27: mol_type = other RNA
caaaaatacaacggcgccccctggacc

SEQ ID NO: 59397 - RNA, 27 nt, synthetic construct
  misc_feature 1..27: note = derived and/or modified sequence opt11 from anti-HIV_CDR
  source 1..27: mol_type = other RNA
caaaaatacaacaacgccccctggacc

SEQ ID NO: 59398 - RNA, 27 nt, synthetic construct
  misc_feature 1..27: note = derived and/or modified sequence opt11 from anti-HIV_CDR
  source 1..27: mol_type = other RNA
caacaacgcgtcaactggcccccaaac

SEQ ID NO: 59399 - RNA, 27 nt, synthetic construct
  misc_feature 1..27: note = derived and/or modified sequence opt11 from anti-HIV_CDR
  source 1..27: mol_type = other RNA
caacaacgcggccactggcccctaacc

SEQ ID NO: 59400 - RNA, 27 nt, synthetic construct
  misc_feature 1..27: note = derived and/or modified sequence opt11 from anti-HIV_CDR
  source 1..27: mol_type = other RNA
caacaataccgctactccgtcatcatc

SEQ ID NO: 59401 - RNA, 27 nt, synthetic construct
  misc_feature 1..27: note = derived and/or modified sequence opt11 from anti-HIV_CDR
  source 1..27: mol_type = other RNA
caacaatccggcacctccctcctcacc

SEQ ID NO: 59402 - RNA, 27 nt, synthetic construct
  misc_feature 1..27: note = derived and/or modified sequence opt11 from anti-HIV_CDR
  source 1..27: mol_type = other RNA
atgaaatcccaacactcaccccgcacc

SEQ ID NO: 59403 - RNA, 27 nt, synthetic construct
  misc_feature 1..27: note = derived and/or modified sequence opt11 from anti-HIV_CDR
  source 1..27: mol_type = other RNA
atgcaacccctccaaaccccctacacc

SEQ ID NO: 59404 - RNA, 27 nt, synthetic construct
  misc_feature 1..27: note = derived and/or modified sequence opt11 from anti-HIV_CDR
  source 1..27: mol_type = other RNA
caacaatacaccgcctacccctggacc

SEQ ID NO: 59405 - RNA, 27 nt, synthetic construct
  misc_feature 1..27: note = derived and/or modified sequence opt11 from anti-HIV_CDR
  source 1..27: mol_type = other RNA
ctccaaaaccacaactacccccgcacc

SEQ ID NO: 59406 - RNA, 27 nt, synthetic construct
  misc_feature 1..27: note = derived and/or modified sequence opt11 from anti-HIV_CDR
  source 1..27: mol_type = other RNA
ctccaaacccactcctacccccgcacc

SEQ ID NO: 59407 - RNA, 30 nt, synthetic construct
  misc_feature 1..30: note = derived and/or modified sequence opt11 from anti-HIV_CDR
  source 1..30: mol_type = other RNA
gccgcctgggacgactcattcgactacgta

SEQ ID NO: 59408 - RNA, 30 nt, synthetic construct
  misc_feature 1..30: note = derived and/or modified sequence opt11 from anti-HIV_CDR
  source 1..30: mol_type = other RNA
caacactccttcggctcacccccctggacc

SEQ ID NO: 59409 - RNA, 30 nt, synthetic construct
  misc_feature 1..30: note = derived and/or modified sequence opt11 from anti-HIV_CDR
  source 1..30: mol_type = other RNA
agctcattcacgcccacaaacacgctcgtg

SEQ ID NO: 59410 - RNA, 30 nt, synthetic construct
  misc_feature 1..30: note = derived and/or modified sequence opt11 from anti-HIV_CDR
  source 1..30: mol_type = other RNA
caacaatacggcaccctacacccccgcacc

SEQ ID NO: 59411 - RNA, 30 nt, synthetic construct
  misc_feature 1..30: note = derived and/or modified sequence opt11 from anti-HIV_CDR
  source 1..30: mol_type = other RNA
caacaatacaacaactggccccccatcacc

SEQ ID NO: 59412 - RNA, 30 nt, synthetic construct
  misc_feature 1..30: note = derived and/or modified sequence opt11 from anti-HIV_CDR
  source 1..30: mol_type = other RNA
caacaatactaccaatggctctcctacacc

SEQ ID NO: 59413 - RNA, 30 nt, synthetic construct
  misc_feature 1..30: note = derived and/or modified sequence opt11 from anti-HIV_CDR
  source 1..30: mol_type = other RNA
caacagcgcgcaaactggcgcctgctcaca

SEQ ID NO: 59414 - RNA, 30 nt, synthetic construct; identical to SEQ ID NO: 21204
  misc_feature 1..30: note = derived and/or modified sequence opt11 from anti-HIV_CDR
  source 1..30: mol_type = other RNA

SEQ ID NO: 59415 - RNA, 30 nt, synthetic construct
  misc_feature 1..30: note = derived and/or modified sequence opt11 from anti-HIV_CDR
  source 1..30: mol_type = other RNA
cgccgatccgactactgcgacttcgacgtc

SEQ ID NO: 59416 - RNA, 30 nt, synthetic construct
  misc_feature 1..30: note = derived and/or modified sequence opt11 from anti-HIV_CDR
  source 1..30: mol_type = other RNA
cgacacaccgactactgcgacttcgacgtc

SEQ ID NO: 59417 - RNA, 30 nt, synthetic construct
  misc_feature 1..30: note = derived and/or modified sequence opt11 from anti-HIV_CDR
  source 1..30: mol_type = other RNA
caacgatccgactactgggacttcgacgtc

SEQ ID NO: 59418 - RNA, 30 nt, synthetic construct; identical to SEQ ID NO: 21208
  misc_feature 1..30: note = derived and/or modified sequence opt11 from anti-HIV_CDR
  source 1..30: mol_type = other RNA

SEQ ID NO: 59419 - RNA, 30 nt, synthetic construct
  misc_feature 1..30: note = derived and/or modified sequence opt11 from anti-HIV_CDR
  source 1..30: mol_type = other RNA
tgcgaggtcgatgccgatgaaacgataacg

SEQ ID NO: 59420 - RNA, 30 nt, synthetic construct
  misc_feature 1..30: note = derived and/or modified sequence opt11 from anti-HIV_CDR
  source 1..30: mol_type = other RNA
tgcgaggtcgatgccgaggaaacgataata

SEQ ID NO: 59421 - RNA, 30 nt, synthetic construct
  misc_feature 1..30: note = derived and/or modified sequence opt11 from anti-HIV_CDR
  source 1..30: mol_type = other RNA
caacgatccgacttctgggacttcgacgtc

SEQ ID NO: 59422 - RNA, 30 nt, synthetic construct; identical to SEQ ID NO: 21212
  misc_feature 1..30: note = derived and/or modified sequence opt11 from anti-HIV_CDR
  source 1..30: mol_type = other RNA

SEQ ID NO: 59423 - RNA, 30 nt, synthetic construct
  misc_feature 1..30: note = derived and/or modified sequence opt11 from anti-HIV_CDR
  source 1..30: mol_type = other RNA
tgctcgtacgcgggcgggcgaacggtcgtg

SEQ ID NO: 59424 - RNA, 30 nt, synthetic construct
  misc_feature 1..30: note = derived and/or modified sequence opt11 from anti-HIV_CDR
  source 1..30: mol_type = other RNA
gccgcgtgggatgactcgctagattacgtg

SEQ ID NO: 59425 - RNA, 30 nt, synthetic construct
  misc_feature 1..30: note = derived and/or modified sequence opt11 from anti-HIV_CDR
  source 1..30: mol_type = other RNA
caacaacgctccaactggccccgcctcacc

SEQ ID NO: 59426 - RNA, 30 nt, synthetic construct
  misc_feature 1..30: note = derived and/or modified sequence opt11 from anti-HIV_CDR
  source 1..30: mol_type = other RNA
caacaatacaacaactggccccccttcacc

SEQ ID NO: 59427 - RNA, 30 nt, synthetic construct
  misc_feature 1..30: note = derived and/or modified sequence opt11 from anti-HIV_CDR
  source 1..30: mol_type = other RNA
atgcaaggcacctactggccacccctaacc

SEQ ID NO: 59428 - RNA, 30 nt, synthetic construct
  misc_feature 1..30: note = derived and/or modified sequence opt11 from anti-HIV_CDR
  source 1..30: mol_type = other RNA
caacaatacggctcctccctcctctacacc

SEQ ID NO: 59429 - RNA, 30 nt, synthetic construct
  misc_feature 1..30: note = derived and/or modified sequence opt11 from anti-HIV_CDR
  source 1..30: mol_type = other RNA
caacaatccttcggcatacccccctggacc

SEQ ID NO: 59430 - RNA, 30 nt, synthetic construct
  misc_feature 1..30: note = derived and/or modified sequence opt11 from anti-HIV_CDR
  source 1..30: mol_type = other RNA
tgctcgtacgcgggctcgtactcgtacgtg

SEQ ID NO: 59431 - RNA, 30 nt, synthetic construct
  misc_feature 1..30: note = derived and/or modified sequence opt11 from anti-HIV_CDR
  source 1..30: mol_type = other RNA
tactcgtacgcgggcaatagcttgggcgtg

SEQ ID NO: 59432 - RNA, 30 nt, synthetic construct; identical to SEQ ID NO: 21222
  misc_feature 1..30: note = derived and/or modified sequence opt11 from anti-HIV_CDR
  source 1..30: mol_type = other RNA

SEQ ID NO: 59433 - RNA, 30 nt, synthetic construct
  misc_feature 1..30: note = derived and/or modified sequence opt11 from anti-HIV_CDR
  source 1..30: mol_type = other RNA
caagaatgggaactccaacccttcgactac

SEQ ID NO: 59434 - RNA, 30 nt, synthetic construct
  misc_feature 1..30: note = derived and/or modified sequence opt11 from anti-HIV_CDR
  source 1..30: mol_type = other RNA
ctcatacccgtctccggcgccttcgacgtc

SEQ ID NO: 59435 - RNA, 30 nt, synthetic construct
  misc_feature 1..30: note = derived and/or modified sequence opt11 from anti-HIV_CDR
  source 1..30: mol_type = other RNA
gaccgcgattacgatgaagacttcgacttc

SEQ ID NO: 59436 - RNA, 30 nt, synthetic construct
  misc_feature 1..30: note = derived and/or modified sequence opt11 from anti-HIV_CDR
  source 1..30: mol_type = other RNA
caagaatacggccgctcaccacccttcccc

SEQ ID NO: 59437 - RNA, 30 nt, synthetic construct
  misc_feature 1..30: note = derived and/or modified sequence opt11 from anti-HIV_CDR
  source 1..30: mol_type = other RNA
acactcgacggcaacttccactgggacttc

SEQ ID NO: 59438 - RNA, 30 nt, synthetic construct
  misc_feature 1..30: note = derived and/or modified sequence opt11 from anti-HIV_CDR
  source 1..30: mol_type = other RNA
ttcacccaacgccaaggcggcttcgactac

SEQ ID NO: 59439 - RNA, 30 nt, synthetic construct
  misc_feature 1..30: note = derived and/or modified sequence opt11 from anti-HIV_CDR
  source 1..30: mol_type = other RNA
caacaatactacaaatggccccccatcacc

SEQ ID NO: 59440 - RNA, 30 nt, synthetic construct
  misc_feature 1..30: note = derived and/or modified sequence opt11 from anti-HIV_CDR
  source 1..30: mol_type = other RNA
caacaatacggctcctccgccccctacacc

SEQ ID NO: 59441 - RNA, 30 nt, synthetic construct
  misc_feature 1..30: note = derived and/or modified sequence opt11 from anti-HIV_CDR
  source 1..30: mol_type = other RNA
caacaactcaactccgaccccccctggacc

SEQ ID NO: 59442 - RNA, 30 nt, synthetic construct
  misc_feature 1..30: note = derived and/or modified sequence opt11 from anti-HIV_CDR
  source 1..30: mol_type = other RNA
caacaccacggctcctccccaacctggacc

SEQ ID NO: 59443 - RNA, 30 nt, synthetic construct
  misc_feature 1..30: note = derived and/or modified sequence opt11 from anti-HIV_CDR
  source 1..30: mol_type = other RNA
caacaatacaaaaaatggcccccctggacc

SEQ ID NO: 59444 - RNA, 30 nt, synthetic construct
  misc_feature 1..30: note = derived and/or modified sequence opt11 from anti-HIV_CDR
  source 1..30: mol_type = other RNA
caacaatacggcttctccctccccgtcacc

SEQ ID NO: 59445 - RNA, 30 nt, synthetic construct
  misc_feature 1..30: note = derived and/or modified sequence opt11 from anti-HIV_CDR
  source 1..30: mol_type = other RNA
caatcatacaacggcgacccccccgtcacc

SEQ ID NO: 59446 - RNA, 30 nt, synthetic construct
  misc_feature 1..30: note = derived and/or modified sequence opt11 from anti-HIV_CDR
  source 1..30: mol_type = other RNA
caacagtacgggagctcgagaaggtggacg

SEQ ID NO: 59447 - RNA, 30 nt, synthetic construct; identical to SEQ ID NO: 51805
  misc_feature 1..30: note = derived and/or modified sequence opt11 from anti-HIV_CDR
  source 1..30: mol_type = other RNA

SEQ ID NO: 59448 - RNA, 30 nt, synthetic construct
  misc_feature 1..30: note = derived and/or modified sequence opt11 from anti-HIV_CDR
  source 1..30: mol_type = other RNA
agagagggctcgcaaggggcctttgacata

SEQ ID NO: 59449 - RNA, 30 nt, synthetic construct
  misc_feature 1..30: note = derived and/or modified sequence opt11 from anti-HIV_CDR
  source 1..30: mol_type = other RNA
ggcgacagcgggccaacaggatttgactat

SEQ ID NO: 59450 - RNA, 30 nt, synthetic construct
  misc_feature 1..30: note = derived and/or modified sequence opt11 from anti-HIV_CDR
  source 1..30: mol_type = other RNA
gtcaggagagggagctcgtacccggactat

SEQ ID NO: 59451 - RNA, 30 nt, synthetic construct; identical to SEQ ID NO: 21241
  misc_feature 1..30: note = derived and/or modified sequence opt11 from anti-HIV_CDR
  source 1..30: mol_type = other RNA

SEQ ID NO: 59452 - RNA, 30 nt, synthetic construct
  misc_feature 1..30: note = derived and/or modified sequence opt11 from anti-HIV_CDR
  source 1..30: mol_type = other RNA
caatcgtacgatagctcggtctcggtcgtg

SEQ ID NO: 59453 - RNA, 30 nt, synthetic construct; identical to SEQ ID NO: 21243
  misc_feature 1..30: note = derived and/or modified sequence opt11 from anti-HIV_CDR
  source 1..30: mol_type = other RNA

SEQ ID NO: 59454 - RNA, 30 nt, synthetic construct
  misc_feature 1..30: note = derived and/or modified sequence opt11 from anti-HIV_CDR
  source 1..30: mol_type = other RNA
tacgagggcaagagatcgggcatggacgtg

SEQ ID NO: 59455 - RNA, 30 nt, synthetic construct
  misc_feature 1..30: note = derived and/or modified sequence opt11 from anti-HIV_CDR
  source 1..30: mol_type = other RNA
caacagtacggaagctcgcccgagtacaca

SEQ ID NO: 59456 - RNA, 30 nt, synthetic construct
  misc_feature 1..30: note = derived and/or modified sequence opt11 from anti-HIV_CDR
  source 1..30: mol_type = other RNA
caatactacgaccacagacccgccatcgcc

SEQ ID NO: 59457 - RNA, 30 nt, synthetic construct
  misc_feature 1..30: note = derived and/or modified sequence opt11 from anti-HIV_CDR
  source 1..30: mol_type = other RNA
caacaatacgacaacctcccccgcgtcacc

SEQ ID NO: 59458 - RNA, 30 nt, synthetic construct
  misc_feature 1..30: note = derived and/or modified sequence opt11 from anti-HIV_CDR
  source 1..30: mol_type = other RNA
ggcgcgtacacgaccacgagcacgctcgtg

SEQ ID NO: 59459 - RNA, 30 nt, synthetic construct; identical to SEQ ID NO: 51817
  misc_feature 1..30: note = derived and/or modified sequence opt11 from anti-HIV_CDR
  source 1..30: mol_type = other RNA

SEQ ID NO: 59460 - RNA, 30 nt, synthetic construct
  misc_feature 1..30: note = derived and/or modified sequence opt11 from anti-HIV_CDR
  source 1..30: mol_type = other RNA
caacaatcctacaacacccgccccctcacc

SEQ ID NO: 59461 - RNA, 30 nt, synthetic construct
  misc_feature 1..30: note = derived and/or modified sequence opt11 from anti-HIV_CDR
  source 1..30: mol_type = other RNA
caacagtacggaggctcgccaccggacaca

SEQ ID NO: 59462 - RNA, 30 nt, synthetic construct; identical to SEQ ID NO: 21252
  misc_feature 1..30: note = derived and/or modified sequence opt11 from anti-HIV_CDR
  source 1..30: mol_type = other RNA

SEQ ID NO: 59463 - RNA, 30 nt, synthetic construct; identical to SEQ ID NO: 21253
  misc_feature 1..30: note = derived and/or modified sequence opt11 from anti-HIV_CDR
  source 1..30: mol_type = other RNA

SEQ ID NO: 59464 - RNA, 30 nt, synthetic construct
  misc_feature 1..30: note = derived and/or modified sequence opt11 from anti-HIV_CDR
  source 1..30: mol_type = other RNA
caacactacggcaacagcccacgcgtaacc

SEQ ID NO: 59465 - RNA, 30 nt, synthetic construct
  misc_feature 1..30: note = derived and/or modified sequence opt11 from anti-HIV_CDR
  source 1..30: mol_type = other RNA
gacgcgttcgtgagctcggccatggacgtg

SEQ ID NO: 59466 - RNA, 30 nt, synthetic construct
  misc_feature 1..30: note = derived and/or modified sequence opt11 from anti-HIV_CDR
  source 1..30: mol_type = other RNA
ttgcgcgcgaccacgcccgggttcgattac

SEQ ID NO: 59467 - RNA, 30 nt, synthetic construct
  misc_feature 1..30: note = derived and/or modified sequence opt11 from anti-HIV_CDR
  source 1..30: mol_type = other RNA
ctacgcgcaaccatacccggattcgactac

SEQ ID NO: 59468 - RNA, 30 nt, synthetic construct
  misc_feature 1..30: note = derived and/or modified sequence opt11 from anti-HIV_CDR
  source 1..30: mol_type = other RNA
ctccgcgccaccatagccggattcgactac

SEQ ID NO: 59469 - RNA, 30 nt, synthetic construct
  misc_feature 1..30: note = derived and/or modified sequence opt11 from anti-HIV_CDR
  source 1..30: mol_type = other RNA
tgctcgtacgcgggctcgtacatatgggtg

SEQ ID NO: 59470 - RNA, 30 nt, synthetic construct
  misc_feature 1..30: note = derived and/or modified sequence opt11 from anti-HIV_CDR
  source 1..30: mol_type = other RNA
tgctcgtacgcgggcacgtactcgtacgtg

SEQ ID NO: 59471 - RNA, 30 nt, synthetic construct
  misc_feature 1..30: note = derived and/or modified sequence opt11 from anti-HIV_CDR
  source 1..30: mol_type = other RNA
agctcgtacgcgggctcgaacaatttcgtg

SEQ ID NO: 59472 - RNA, 30 nt, synthetic construct; identical to SEQ ID NO: 21262
  misc_feature 1..30: note = derived and/or modified sequence opt11 from anti-HIV_CDR
  source 1..30: mol_type = other RNA

SEQ ID NO: 59473 - RNA, 30 nt, synthetic construct
  misc_feature 1..30: note = derived and/or modified sequence opt11 from anti-HIV_CDR
  source 1..30: mol_type = other RNA
caacaatacgccacctcctccctctacacc

SEQ ID NO: 59474 - RNA, 30 nt, synthetic construct
  misc_feature 1..30: note = derived and/or modified sequence opt11 from anti-HIV_CDR
  source 1..30: mol_type = other RNA
caatggtacggcaccctacacccccgcacc

SEQ ID NO: 59475 - RNA, 30 nt, synthetic construct; identical to SEQ ID NO: 21265
  misc_feature 1..30: note = derived and/or modified sequence opt11 from anti-HIV_CDR
  source 1..30: mol_type = other RNA

SEQ ID NO: 59476 - RNA, 30 nt, synthetic construct; identical to SEQ ID NO: 21266
  misc_feature 1..30: note = derived and/or modified sequence opt11 from anti-HIV_CDR
  source 1..30: mol_type = other RNA

SEQ ID NO: 59477 - RNA, 30 nt, synthetic construct
  misc_feature 1..30: note = derived and/or modified sequence opt11 from anti-HIV_CDR
  source 1..30: mol_type = other RNA
acgggcgggctcttgcgctttccagaggtc

SEQ ID NO: 59478 - RNA, 30 nt, synthetic construct
  misc_feature 1..30: note = derived and/or modified sequence opt11 from anti-HIV_CDR
  source 1..30: mol_type = other RNA
tgctcgtacgcgggctcgtacacgtacgtg

SEQ ID NO: 59479 - RNA, 30 nt, synthetic construct
  misc_feature 1..30: note = derived and/or modified sequence opt11 from anti-HIV_CDR
  source 1..30: mol_type = other RNA
caacaacgctactcctggccctccctcacc

SEQ ID NO: 59480 - RNA, 30 nt, synthetic construct
  misc_feature 1..30: note = derived and/or modified sequence opt11 from anti-HIV_CDR
  source 1..30: mol_type = other RNA
ctccaatgcggctcctcccccccctacacc

SEQ ID NO: 59481 - RNA, 30 nt, synthetic construct
  misc_feature 1..30: note = derived and/or modified sequence opt11 from anti-HIV_CDR
  source 1..30: mol_type = other RNA
tcctcatacgccggcacaaaccactgggtc

SEQ ID NO: 59482 - RNA, 30 nt, synthetic construct
  misc_feature 1..30: note = derived and/or modified sequence opt11 from anti-HIV_CDR
  source 1..30: mol_type = other RNA
tcctcatacgccgccacaaaccactgggtc

SEQ ID NO: 59483 - RNA, 30 nt, synthetic construct
  misc_feature 1..30: note = derived and/or modified sequence opt11 from anti-HIV_CDR
  source 1..30: mol_type = other RNA
caatactacggcacctcccccccctccacc

SEQ ID NO: 59484 - RNA, 30 nt, synthetic construct
  misc_feature 1..30: note = derived and/or modified sequence opt11 from anti-HIV_CDR
  source 1..30: mol_type = other RNA
caatactacggctcctcccccccctccacc

SEQ ID NO: 59485 - RNA, 30 nt, synthetic construct
  misc_feature 1..30: note = derived and/or modified sequence opt11 from anti-HIV_CDR
  source 1..30: mol_type = other RNA
caagaattcggccgcgcacccccataccca

SEQ ID NO: 59486 - RNA, 30 nt, synthetic construct
  misc_feature 1..30: note = derived and/or modified sequence opt11 from anti-HIV_CDR
  source 1..30: mol_type = other RNA
caagaatacggccgctcaccaccctacccc

SEQ ID NO: 59487 - RNA, 30 nt, synthetic construct
  misc_feature 1..30: note = derived and/or modified sequence opt11 from anti-HIV_CDR
  source 1..30: mol_type = other RNA
caagaatacggccgcgcacccccataccca

SEQ ID NO: 59488 - RNA, 30 nt, synthetic construct
  misc_feature 1..30: note = derived and/or modified sequence opt11 from anti-HIV_CDR
  source 1..30: mol_type = other RNA
catatagcggtcgggggatcggaggaacac

SEQ ID NO: 59489 - RNA, 30 nt, synthetic construct
  misc_feature 1..30: note = derived and/or modified sequence opt11 from anti-HIV_CDR
  source 1..30: mol_type = other RNA
cacatagcagtcggcggatcagaagaccac

SEQ ID NO: 59490 - RNA, 30 nt, synthetic construct
  misc_feature 1..30: note = derived and/or modified sequence opt11 from anti-HIV_CDR
  source 1..30: mol_type = other RNA
cacatagcagtgggcgggagagaggaagag

SEQ ID NO: 59491 - RNA, 33 nt, synthetic construct
  misc_feature 1..33: note = derived and/or modified sequence opt11 from anti-HIV_CDR
  source 1..33: mol_type = other RNA
ggggagaagagtagggggagtagggcggtgcag

SEQ ID NO: 59492 - RNA, 33 nt, synthetic construct
  misc_feature 1..33: note = derived and/or modified sequence opt11 from anti-HIV_CDR
  source 1..33: mol_type = other RNA
ggcgagaaatcgttcgcgagcagggccgtgcaa

SEQ ID NO: 59493 - RNA, 33 nt, synthetic construct
  misc_feature 1..33: note = derived and/or modified sequence opt11 from anti-HIV_CDR
  source 1..33: mol_type = other RNA
ggacgacaggccttgggctcgagagcagtccag

SEQ ID NO: 59494 - RNA, 33 nt, synthetic construct
  misc_feature 1..33: note = derived and/or modified sequence opt11 from anti-HIV_CDR
  source 1..33: mol_type = other RNA
ggcgaggaatcgctcgggagcaggagcgtgata

SEQ ID NO: 59495 - RNA, 33 nt, synthetic construct
  misc_feature 1..33: note = derived and/or modified sequence opt11 from anti-HIV_CDR
  source 1..33: mol_type = other RNA
ggggagaagagtttggggagtagggcggtgcag

SEQ ID NO: 59496 - RNA, 33 nt, synthetic construct
  misc_feature 1..33: note = derived and/or modified sequence opt11 from anti-HIV_CDR
  source 1..33: mol_type = other RNA
gggaaagagagcataggctcgcgcgcggtccag

SEQ ID NO: 59497 - RNA, 33 nt, synthetic construct
  misc_feature 1..33: note = derived and/or modified sequence opt11 from anti-HIV_CDR
  source 1..33: mol_type = other RNA
ggcgggaacaatatcgggagcaagagcgtgcac

SEQ ID NO: 59498 - RNA, 33 nt, synthetic construct
  misc_feature 1..33: note = derived and/or modified sequence opt11 from anti-HIV_CDR
  source 1..33: mol_type = other RNA
ggagagaagagtatagggagcagggcggtgcag

SEQ ID NO: 59499 - RNA, 33 nt, synthetic construct
  misc_feature 1..33: note = derived and/or modified sequence opt11 from anti-HIV_CDR
  source 1..33: mol_type = other RNA
aaagcgagccaggacgtgagcacggccgtggcc

SEQ ID NO: 59500 - RNA, 33 nt, synthetic construct
  misc_feature 1..33: note = derived and/or modified sequence opt11 from anti-HIV_CDR
  source 1..33: mol_type = other RNA
ggctcccgcaacctctcccaccgcctcctctca

SEQ ID NO: 59501 - RNA, 33 nt, synthetic construct
  misc_feature 1..33: note = derived and/or modified sequence opt11 from anti-HIV_CDR
  source 1..33: mol_type = other RNA
ggcacatacgacagccagggctcgaccagactc

SEQ ID NO: 59502 - RNA, 33 nt, synthetic construct
  misc_feature 1..33: note = derived and/or modified sequence opt11 from anti-HIV_CDR
  source 1..33: mol_type = other RNA
caacaacgaaccatctggccccccggctgctcc

SEQ ID NO: 59503 - RNA, 33 nt, synthetic construct
  misc_feature 1..33: note = derived and/or modified sequence opt11 from anti-HIV_CDR
  source 1..33: mol_type = other RNA
ggcacgtgggatagctcgctctcggccgtgcta

SEQ ID NO: 59504 - RNA, 33 nt, synthetic construct
  misc_feature 1..33: note = derived and/or modified sequence opt11 from anti-HIV_CDR
  source 1..33: mol_type = other RNA
gcgagctgggacaatagcttgagcgggcccgtg

SEQ ID NO: 59505 - RNA, 33 nt, synthetic construct
  misc_feature 1..33: note = derived and/or modified sequence opt11 from anti-HIV_CDR
  source 1..33: mol_type = other RNA
gcgagctgggacgatagcttgagcgggtgggtg

SEQ ID NO: 59506 - RNA, 33 nt, synthetic construct; identical to SEQ ID NO: 21296
  misc_feature 1..33: note = derived and/or modified sequence opt11 from anti-HIV_CDR
  source 1..33: mol_type = other RNA

SEQ ID NO: 59507 - RNA, 33 nt, synthetic construct
  misc_feature 1..33: note = derived and/or modified sequence opt11 from anti-HIV_CDR
  source 1..33: mol_type = other RNA
caacaccgcaccaactggcccccctccatcacc

SEQ ID NO: 59508 - RNA, 33 nt, synthetic construct
  misc_feature 1..33: note = derived and/or modified sequence opt11 from anti-HIV_CDR
  source 1..33: mol_type = other RNA
caatcgtacgaccgctcgctcaggggctcggtc

SEQ ID NO: 59509 - RNA, 33 nt, synthetic construct
  misc_feature 1..33: note = derived and/or modified sequence opt11 from anti-HIV_CDR
  source 1..33: mol_type = other RNA
agctcgggcaattacgatttcgcgttcgatatc

SEQ ID NO: 59510 - RNA, 33 nt, synthetic construct
  misc_feature 1..33: note = derived and/or modified sequence opt11 from anti-HIV_CDR
  source 1..33: mol_type = other RNA
agctcgggcaattacgatttcgcgtacgatatc

SEQ ID NO: 59511 - RNA, 33 nt, synthetic construct
  misc_feature 1..33: note = derived and/or modified sequence opt11 from anti-HIV_CDR
  source 1..33: mol_type = other RNA
agctcgggcaatttcgagttcgcgttcgagatc

SEQ ID NO: 59512 - RNA, 33 nt, synthetic construct
  misc_feature 1..33: note = derived and/or modified sequence opt11 from anti-HIV_CDR
  source 1..33: mol_type = other RNA
gccacctacgactcacacggctcaatccgcctc

SEQ ID NO: 59513 - RNA, 33 nt, synthetic construct
  misc_feature 1..33: note = derived and/or modified sequence opt11 from anti-HIV_CDR
  source 1..33: mol_type = other RNA
ggcacgtacgacacctcgctctcgctcaggctc

SEQ ID NO: 59514 - RNA, 33 nt, synthetic construct
  misc_feature 1..33: note = derived and/or modified sequence opt11 from anti-HIV_CDR
  source 1..33: mol_type = other RNA
gccgccttcgactccgccctctctctccctctc

SEQ ID NO: 59515 - RNA, 33 nt, synthetic construct
  misc_feature 1..33: note = derived and/or modified sequence opt11 from anti-HIV_CDR
  source 1..33: mol_type = other RNA
gccacatacgacagcgacggctcaatcagacta

SEQ ID NO: 59516 - RNA, 33 nt, synthetic construct
  misc_feature 1..33: note = derived and/or modified sequence opt11 from anti-HIV_CDR
  source 1..33: mol_type = other RNA
gccacctacgactccggctggtcaatccgccta

SEQ ID NO: 59517 - RNA, 33 nt, synthetic construct
  misc_feature 1..33: note = derived and/or modified sequence opt11 from anti-HIV_CDR
  source 1..33: mol_type = other RNA
gccacctacgacaccggcctatccctccgccta

SEQ ID NO: 59518 - RNA, 33 nt, synthetic construct; identical to SEQ ID NO: 21308
  misc_feature 1..33: note = derived and/or modified sequence opt11 from anti-HIV_CDR
  source 1..33: mol_type = other RNA

SEQ ID NO: 59519 - RNA, 33 nt, synthetic construct
  misc_feature 1..33: note = derived and/or modified sequence opt11 from anti-HIV_CDR
  source 1..33: mol_type = other RNA
gccgcgtacgatagcgcggtctcgctcccggtc

SEQ ID NO: 59520 - RNA, 33 nt, synthetic construct; identical to SEQ ID NO: 21310
  misc_feature 1..33: note = derived and/or modified sequence opt11 from anti-HIV_CDR
  source 1..33: mol_type = other RNA

SEQ ID NO: 59521 - RNA, 33 nt, synthetic construct; identical to SEQ ID NO: 21311
  misc_feature 1..33: note = derived and/or modified sequence opt11 from anti-HIV_CDR
  source 1..33: mol_type = other RNA

SEQ ID NO: 59522 - RNA, 33 nt, synthetic construct; identical to SEQ ID NO: 21312
  misc_feature 1..33: note = derived and/or modified sequence opt11 from anti-HIV_CDR
  source 1..33: mol_type = other RNA

SEQ ID NO: 59523 - RNA, 33 nt, synthetic construct
  misc_feature 1..33: note = derived and/or modified sequence opt11 from anti-HIV_CDR
  source 1..33: mol_type = other RNA
gccacctacgactcacaaggctcaacccgcctc

SEQ ID NO: 59524 - RNA, 33 nt, synthetic construct
  misc_feature 1..33: note = derived and/or modified sequence opt11 from anti-HIV_CDR
  source 1..33: mol_type = other RNA
gccacctacgactcccaacgctcaatccgcctc

SEQ ID NO: 59525 - RNA, 33 nt, synthetic construct; identical to SEQ ID NO: 21315
  misc_feature 1..33: note = derived and/or modified sequence opt11 from anti-HIV_CDR
  source 1..33: mol_type = other RNA

SEQ ID NO: 59526 - RNA, 33 nt, synthetic construct
  misc_feature 1..33: note = derived and/or modified sequence opt11 from anti-HIV_CDR
  source 1..33: mol_type = other RNA
cagcacaggagcatatggccgctcatgtgcaca

SEQ ID NO: 59527 - RNA, 33 nt, synthetic construct
  misc_feature 1..33: note = derived and/or modified sequence opt11 from anti-HIV_CDR
  source 1..33: mol_type = other RNA
ctccagcccgtgtacatattcaggggcacgtgg

SEQ ID NO: 59528 - RNA, 33 nt, synthetic construct
  misc_feature 1..33: note = derived and/or modified sequence opt11 from anti-HIV_CDR
  source 1..33: mol_type = other RNA
tgcgaggtagatgcagatgagacggtgacgtgc

SEQ ID NO: 59529 - RNA, 33 nt, synthetic construct
  misc_feature 1..33: note = derived and/or modified sequence opt11 from anti-HIV_CDR
  source 1..33: mol_type = other RNA
tgtgaggtggatgcggaggtgacgatgacggtg

SEQ ID NO: 59530 - RNA, 33 nt, synthetic construct
  misc_feature 1..33: note = derived and/or modified sequence opt11 from anti-HIV_CDR
  source 1..33: mol_type = other RNA
agctcgtacgcggacacgaacgatttcggggtc

SEQ ID NO: 59531 - RNA, 33 nt, synthetic construct; identical to SEQ ID NO: 21321
  misc_feature 1..33: note = derived and/or modified sequence opt11 from anti-HIV_CDR
  source 1..33: mol_type = other RNA

SEQ ID NO: 59532 - RNA, 33 nt, synthetic construct
  misc_feature 1..33: note = derived and/or modified sequence opt11 from anti-HIV_CDR
  source 1..33: mol_type = other RNA
gggacgtgggacgggagtttgacgacgggggtg

SEQ ID NO: 59533 - RNA, 33 nt, synthetic construct
  misc_feature 1..33: note = derived and/or modified sequence opt11 from anti-HIV_CDR
  source 1..33: mol_type = other RNA
caatcctacgacaactccctctccggctgggtc

SEQ ID NO: 59534 - RNA, 33 nt, synthetic construct
  misc_feature 1..33: note = derived and/or modified sequence opt11 from anti-HIV_CDR
  source 1..33: mol_type = other RNA
caacaatactactccatccccccctggaccttc

SEQ ID NO: 59535 - RNA, 33 nt, synthetic construct
  misc_feature 1..33: note = derived and/or modified sequence opt11 from anti-HIV_CDR
  source 1..33: mol_type = other RNA
atgcaaggcacctactggcccccctcaatcacc

SEQ ID NO: 59536 - RNA, 33 nt, synthetic construct
  misc_feature 1..33: note = derived and/or modified sequence opt11 from anti-HIV_CDR
  source 1..33: mol_type = other RNA
caatcgtacgatagctcgctcggggtcgaggtc

SEQ ID NO: 59537 - RNA, 33 nt, synthetic construct
  misc_feature 1..33: note = derived and/or modified sequence opt11 from anti-HIV_CDR
  source 1..33: mol_type = other RNA
caagtgtgggatagcgggcgagatagctgggtc

SEQ ID NO: 59538 - RNA, 33 nt, synthetic construct
  misc_feature 1..33: note = derived and/or modified sequence opt11 from anti-HIV_CDR
  source 1..33: mol_type = other RNA
cagagctatgactcgagcttgagcgggtgggtg

SEQ ID NO: 59539 - RNA, 33 nt, synthetic construct
  misc_feature 1..33: note = derived and/or modified sequence opt11 from anti-HIV_CDR
  source 1..33: mol_type = other RNA
gggagttgggacgggagtttgaatgcgggggtg

SEQ ID NO: 59540 - RNA, 33 nt, synthetic construct
  misc_feature 1..33: note = derived and/or modified sequence opt11 from anti-HIV_CDR
  source 1..33: mol_type = other RNA
ctctccgccgactcctcctccacctaccaagtc

SEQ ID NO: 59541 - RNA, 33 nt, synthetic construct
  misc_feature 1..33: note = derived and/or modified sequence opt11 from anti-HIV_CDR
  source 1..33: mol_type = other RNA
tgttcgtacgcgggcagggacacgagctgggtc

SEQ ID NO: 59542 - RNA, 33 nt, synthetic construct
  misc_feature 1..33: note = derived and/or modified sequence opt11 from anti-HIV_CDR
  source 1..33: mol_type = other RNA
caacaacgctccaactggccccccggcctcacc

SEQ ID NO: 59543 - RNA, 33 nt, synthetic construct
  misc_feature 1..33: note = derived and/or modified sequence opt11 from anti-HIV_CDR
  source 1..33: mol_type = other RNA
aaagggcgcgggtacgggtactggttcgatagc

SEQ ID NO: 59544 - RNA, 33 nt, synthetic construct
  misc_feature 1..33: note = derived and/or modified sequence opt11 from anti-HIV_CDR
  source 1..33: mol_type = other RNA
gagatggcggcgacgagtgacgcgtttgacata

SEQ ID NO: 59545 - RNA, 33 nt, synthetic construct
  misc_feature 1..33: note = derived and/or modified sequence opt11 from anti-HIV_CDR
  source 1..33: mol_type = other RNA
tccatatactcaaccggccccgcccccgtctac

SEQ ID NO: 59546 - RNA, 33 nt, synthetic construct
  misc_feature 1..33: note = derived and/or modified sequence opt11 from anti-HIV_CDR
  source 1..33: mol_type = other RNA
cgcgggagcctgctcataaaatatttcgattac

SEQ ID NO: 59547 - RNA, 33 nt, synthetic construct
  misc_feature 1..33: note = derived and/or modified sequence opt11 from anti-HIV_CDR
  source 1..33: mol_type = other RNA
caacaatacgacaacctacccccacgcgtcacc

SEQ ID NO: 59548 - RNA, 33 nt, synthetic construct
  misc_feature 1..33: note = derived and/or modified sequence opt11 from anti-HIV_CDR
  source 1..33: mol_type = other RNA
gatgtgaggttggtggcggtgccgggggcggat

SEQ ID NO: 59549 - RNA, 33 nt, synthetic construct
  misc_feature 1..33: note = derived and/or modified sequence opt11 from anti-HIV_CDR
  source 1..33: mol_type = other RNA
caacaacgaaccacctggccccccgaatacacc

SEQ ID NO: 59550 - RNA, 33 nt, synthetic construct
  misc_feature 1..33: note = derived and/or modified sequence opt11 from anti-HIV_CDR
  source 1..33: mol_type = other RNA
gcggcctgggacgatagcttgaacgggtgggtg

SEQ ID NO: 59551 - RNA, 33 nt, synthetic construct
  misc_feature 1..33: note = derived and/or modified sequence opt11 from anti-HIV_CDR
  source 1..33: mol_type = other RNA
cgcagacgctcagcctggagcccgttcgacagc

SEQ ID NO: 59552 - RNA, 33 nt, synthetic construct
  misc_feature 1..33: note = derived and/or modified sequence opt11 from anti-HIV_CDR
  source 1..33: mol_type = other RNA
gccacatgggacagctcactcaggaccgcacta

SEQ ID NO: 59553 - RNA, 33 nt, synthetic construct
  misc_feature 1..33: note = derived and/or modified sequence opt11 from anti-HIV_CDR
  source 1..33: mol_type = other RNA
gggacgtgggacagtagtttgagggcggcgttg

SEQ ID NO: 59554 - RNA, 33 nt, synthetic construct
  misc_feature 1..33: note = derived and/or modified sequence opt11 from anti-HIV_CDR
  source 1..33: mol_type = other RNA
caacaacgctccatctggcccccctccctcacc

SEQ ID NO: 59555 - RNA, 33 nt, synthetic construct
  misc_feature 1..33: note = derived and/or modified sequence opt11 from anti-HIV_CDR
  source 1..33: mol_type = other RNA
gagtttcagacgagtggggtggtgagggagggg

SEQ ID NO: 59556 - RNA, 33 nt, synthetic construct
  misc_feature 1..33: note = derived and/or modified sequence opt11 from anti-HIV_CDR
  source 1..33: mol_type = other RNA
cacataggcgcgggcgggccatatagcgagtac

SEQ ID NO: 59557 - RNA, 33 nt, synthetic construct
  misc_feature 1..33: note = derived and/or modified sequence opt11 from anti-HIV_CDR
  source 1..33: mol_type = other RNA
cgcgggcactcgttcacgagcccgttcgatagc

SEQ ID NO: 59558 - RNA, 33 nt, synthetic construct
  misc_feature 1..33: note = derived and/or modified sequence opt11 from anti-HIV_CDR
  source 1..33: mol_type = other RNA
caacacctcaactcatacccccgcatgtacacc

SEQ ID NO: 59559 - RNA, 33 nt, synthetic construct
  misc_feature 1..33: note = derived and/or modified sequence opt11 from anti-HIV_CDR
  source 1..33: mol_type = other RNA
caacaacgctccaactggccccccaaaatcacc

SEQ ID NO: 59560 - RNA, 33 nt, synthetic construct
  misc_feature 1..33: note = derived and/or modified sequence opt11 from anti-HIV_CDR
  source 1..33: mol_type = other RNA
gcggcgtgggatgatagtttggggggggtggtg

SEQ ID NO: 59561 - RNA, 33 nt, synthetic construct
  misc_feature 1..33: note = derived and/or modified sequence opt11 from anti-HIV_CDR
  source 1..33: mol_type = other RNA
gggacatgggactcgagcttgagcgcggtcgtg

SEQ ID NO: 59562 - RNA, 33 nt, synthetic construct
  misc_feature 1..33: note = derived and/or modified sequence opt11 from anti-HIV_CDR
  source 1..33: mol_type = other RNA
caacaaagagcaaactggccaccaggcggaacc

SEQ ID NO: 59563 - RNA, 33 nt, synthetic construct
  misc_feature 1..33: note = derived and/or modified sequence opt11 from anti-HIV_CDR
  source 1..33: mol_type = other RNA
gggggggggtatccgagggggaatatggatgtg

SEQ ID NO: 59564 - RNA, 33 nt, synthetic construct; identical to SEQ ID NO: 21354
  misc_feature 1..33: note = derived and/or modified sequence opt11 from anti-HIV_CDR
  source 1..33: mol_type = other RNA

SEQ ID NO: 59565 - RNA, 33 nt, synthetic construct
  misc_feature 1..33: note = derived and/or modified sequence opt11 from anti-HIV_CDR
  source 1..33: mol_type = other RNA
caacaacgcggcatctggcccctacaaatcacc

SEQ ID NO: 59566 - RNA, 33 nt, synthetic construct
  misc_feature 1..33: note = derived and/or modified sequence opt11 from anti-HIV_CDR
  source 1..33: mol_type = other RNA
cgctcgcccgggggcgggtacgcgttcgatatc

SEQ ID NO: 59567 - RNA, 33 nt, synthetic construct
  misc_feature 1..33: note = derived and/or modified sequence opt11 from anti-HIV_CDR
  source 1..33: mol_type = other RNA
agcgggcccgggctcttgcgcgggttcgattac

SEQ ID NO: 59568 - RNA, 33 nt, synthetic construct
  misc_feature 1..33: note = derived and/or modified sequence opt11 from anti-HIV_CDR
  source 1..33: mol_type = other RNA
caacaacgaaccacccgcccccccgaatacacc

SEQ ID NO: 59569 - RNA, 33 nt, synthetic construct
  misc_feature 1..33: note = derived and/or modified sequence opt11 from anti-HIV_CDR
  source 1..33: mol_type = other RNA
caacaacgaaccacccgcccccccgactacacc

SEQ ID NO: 59570 - RNA, 33 nt, synthetic construct
  misc_feature 1..33: note = derived and/or modified sequence opt11 from anti-HIV_CDR
  source 1..33: mol_type = other RNA
caaggccgaaccacccgcccacccgactacaca

SEQ ID NO: 59571 - RNA, 33 nt, synthetic construct
  misc_feature 1..33: note = derived and/or modified sequence opt11 from anti-HIV_CDR
  source 1..33: mol_type = other RNA
caacaacgctccaccaccccccccgaatacacc

SEQ ID NO: 59572 - RNA, 33 nt, synthetic construct
  misc_feature 1..33: note = derived and/or modified sequence opt11 from anti-HIV_CDR
  source 1..33: mol_type = other RNA
caacaacgcacctcctggcccctcgccctctcc

SEQ ID NO: 59573 - RNA, 33 nt, synthetic construct; identical to SEQ ID NO: 21363
  misc_feature 1..33: note = derived and/or modified sequence opt11 from anti-HIV_CDR
  source 1..33: mol_type = other RNA

SEQ ID NO: 59574 - RNA, 36 nt, synthetic construct
  misc_feature 1..36: note = derived and/or modified sequence opt11 from anti-HIV_CDR
  source 1..36: mol_type = other RNA
cactattgggatagcaggagcccgatctcgtgggtg

SEQ ID NO: 59575 - RNA, 36 nt, synthetic construct
  misc_feature 1..36: note = derived and/or modified sequence opt11 from anti-HIV_CDR
  source 1..36: mol_type = other RNA
cacaagtgggatagcaggagcccgctctcgtgggtg

SEQ ID NO: 59576 - RNA, 36 nt, synthetic construct
  misc_feature 1..36: note = derived and/or modified sequence opt11 from anti-HIV_CDR
  source 1..36: mol_type = other RNA
cacatgtgggatagcaggagcgggttctcgtggtcg

SEQ ID NO: 59577 - RNA, 36 nt, synthetic construct
  misc_feature 1..36: note = derived and/or modified sequence opt11 from anti-HIV_CDR
  source 1..36: mol_type = other RNA
cacatctgggactccagagtccccaccaaatgggtc

SEQ ID NO: 59578 - RNA, 36 nt, synthetic construct
  misc_feature 1..36: note = derived and/or modified sequence opt11 from anti-HIV_CDR
  source 1..36: mol_type = other RNA
caagtgtgggatagctcgagcgatcacccgtgggtg

SEQ ID NO: 59579 - RNA, 36 nt, synthetic construct
  misc_feature 1..36: note = derived and/or modified sequence opt11 from anti-HIV_CDR
  source 1..36: mol_type = other RNA
cacatatacgacgccagacgcccaaccaactgggtc

SEQ ID NO: 59580 - RNA, 36 nt, synthetic construct
  misc_feature 1..36: note = derived and/or modified sequence opt11 from anti-HIV_CDR
  source 1..36: mol_type = other RNA
ctcgacggcgaagccttccgctactacctagacctc

SEQ ID NO: 59581 - RNA, 36 nt, synthetic construct
  misc_feature 1..36: note = derived and/or modified sequence opt11 from anti-HIV_CDR
  source 1..36: mol_type = other RNA
ccccaatacaacctcggccgcgaccccctagacgtc

SEQ ID NO: 59582 - RNA, 36 nt, synthetic construct
  misc_feature 1..36: note = derived and/or modified sequence opt11 from anti-HIV_CDR
  source 1..36: mol_type = other RNA
cccgaaccctcctccatcgtcgcccccctctactac

SEQ ID NO: 59583 - RNA, 36 nt, synthetic construct
  misc_feature 1..36: note = derived and/or modified sequence opt11 from anti-HIV_CDR
  source 1..36: mol_type = other RNA
ggcgggggagatggcaggaactggcatttgcatccg

SEQ ID NO: 59584 - RNA, 36 nt, synthetic construct
  misc_feature 1..36: note = derived and/or modified sequence opt11 from anti-HIV_CDR
  source 1..36: mol_type = other RNA
cccaagagcgggcgcgattactggagctttgacttg

SEQ ID NO: 59585 - RNA, 36 nt, synthetic construct
  misc_feature 1..36: note = derived and/or modified sequence opt11 from anti-HIV_CDR
  source 1..36: mol_type = other RNA
cccaggggcgggcgcgataactggagctttcacgtg

SEQ ID NO: 59586 - RNA, 36 nt, synthetic construct
  misc_feature 1..36: note = derived and/or modified sequence opt11 from anti-HIV_CDR
  source 1..36: mol_type = other RNA
ccgcactcgcccgatgacgcgtggtcactcgacgtc

SEQ ID NO: 59587 - RNA, 36 nt, synthetic construct
  misc_feature 1..36: note = derived and/or modified sequence opt11 from anti-HIV_CDR
  source 1..36: mol_type = other RNA
cccctccgcggcggcgacacctggcactaccactca

SEQ ID NO: 59588 - RNA, 36 nt, synthetic construct
  misc_feature 1..36: note = derived and/or modified sequence opt11 from anti-HIV_CDR
  source 1..36: mol_type = other RNA
ctccaacccgtctacatcctccgctccatctgccac

SEQ ID NO: 59589 - RNA, 36 nt, synthetic construct
  misc_feature 1..36: note = derived and/or modified sequence opt11 from anti-HIV_CDR
  source 1..36: mol_type = other RNA
ctccaacccgtctacatcctcaaatgcaactggtgc

SEQ ID NO: 59590 - RNA, 36 nt, synthetic construct
  misc_feature 1..36: note = derived and/or modified sequence opt11 from anti-HIV_CDR
  source 1..36: mol_type = other RNA
gaatacagattcgacgactggggcccgctcgaccac

SEQ ID NO: 59591 - RNA, 36 nt, synthetic construct
  misc_feature 1..36: note = derived and/or modified sequence opt11 from anti-HIV_CDR
  source 1..36: mol_type = other RNA
gcggcatgggacgatagcttgaacgggcacggggta

SEQ ID NO: 59592 - RNA, 36 nt, synthetic construct; identical to SEQ ID NO: 21382
  misc_feature 1..36: note = derived and/or modified sequence opt11 from anti-HIV_CDR
  source 1..36: mol_type = other RNA

SEQ ID NO: 59593 - RNA, 36 nt, synthetic construct
  misc_feature 1..36: note = derived and/or modified sequence opt11 from anti-HIV_CDR
  source 1..36: mol_type = other RNA
ggcctatacgactcctccggctactacttcggctac

SEQ ID NO: 59594 - RNA, 36 nt, synthetic construct
  misc_feature 1..36: note = derived and/or modified sequence opt11 from anti-HIV_CDR
  source 1..36: mol_type = other RNA
ctcgggtgctcgggcgggagctgttacgaggactcg

SEQ ID NO: 59595 - RNA, 36 nt, synthetic construct
  misc_feature 1..36: note = derived and/or modified sequence opt11 from anti-HIV_CDR
  source 1..36: mol_type = other RNA
gcgagcgggagctatatattgggcacgatggatgta

SEQ ID NO: 59596 - RNA, 36 nt, synthetic construct
  misc_feature 1..36: note = derived and/or modified sequence opt11 from anti-HIV_CDR
  source 1..36: mol_type = other RNA
tactcaaccgacaactccggcaaacaacactgggtc

SEQ ID NO: 59597 - RNA, 36 nt, synthetic construct
  misc_feature 1..36: note = derived and/or modified sequence opt11 from anti-HIV_CDR
  source 1..36: mol_type = other RNA
gtcaagcaattcctcgagtggctgtacctggactat

SEQ ID NO: 59598 - RNA, 36 nt, synthetic construct
  misc_feature 1..36: note = derived and/or modified sequence opt11 from anti-HIV_CDR
  source 1..36: mol_type = other RNA
ggcgtgcgctcgatcgtgggcgcgcactttgactat

SEQ ID NO: 59599 - RNA, 36 nt, synthetic construct
  misc_feature 1..36: note = derived and/or modified sequence opt11 from anti-HIV_CDR
  source 1..36: mol_type = other RNA
ggcgtgggcacgcgctattacgtgtactttgactcg

SEQ ID NO: 59600 - RNA, 36 nt, synthetic construct; identical to SEQ ID NO: 21390
  misc_feature 1..36: note = derived and/or modified sequence opt11 from anti-HIV_CDR
  source 1..36: mol_type = other RNA

SEQ ID NO: 59601 - RNA, 36 nt, synthetic construct
  misc_feature 1..36: note = derived and/or modified sequence opt11 from anti-HIV_CDR
  source 1..36: mol_type = other RNA
cgcggcatcgccgccgccggcttttacttccaacac

SEQ ID NO: 59602 - RNA, 36 nt, synthetic construct
  misc_feature 1..36: note = derived and/or modified sequence opt11 from anti-HIV_CDR
  source 1..36: mol_type = other RNA
cgcgggatcgcggccgcggccttttactttcaaacg

SEQ ID NO: 59603 - RNA, 36 nt, synthetic construct
  misc_feature 1..36: note = derived and/or modified sequence opt11 from anti-HIV_CDR
  source 1..36: mol_type = other RNA
cgcggcatcgccgccgccggcttttacttccaaaac

SEQ ID NO: 59604 - RNA, 36 nt, synthetic construct
  misc_feature 1..36: note = derived and/or modified sequence opt11 from anti-HIV_CDR
  source 1..36: mol_type = other RNA
caatcgtacgatacctcgctcacggacacgggcgtg

SEQ ID NO: 59605 - RNA, 36 nt, synthetic construct
  misc_feature 1..36: note = derived and/or modified sequence opt11 from anti-HIV_CDR
  source 1..36: mol_type = other RNA
caatcctacgacacctccctctccgacaccggcgtc

SEQ ID NO: 59606 - RNA, 36 nt, synthetic construct; identical to SEQ ID NO: 21396
  misc_feature 1..36: note = derived and/or modified sequence opt11 from anti-HIV_CDR
  source 1..36: mol_type = other RNA

SEQ ID NO: 59607 - RNA, 36 nt, synthetic construct; identical to SEQ ID NO: 21397
  misc_feature 1..36: note = derived and/or modified sequence opt11 from anti-HIV_CDR
  source 1..36: mol_type = other RNA

SEQ ID NO: 59608 - RNA, 36 nt, synthetic construct; identical to SEQ ID NO: 21398
  misc_feature 1..36: note = derived and/or modified sequence opt11 from anti-HIV_CDR
  source 1..36: mol_type = other RNA

SEQ ID NO: 59609 - RNA, 36 nt, synthetic construct
  misc_feature 1..36: note = derived and/or modified sequence opt11 from anti-HIV_CDR
  source 1..36: mol_type = other RNA
gcggcgtgggatgatagtttggatgggttttgggtg

SEQ ID NO: 59610 - RNA, 36 nt, synthetic construct
  misc_feature 1..36: note = derived and/or modified sequence opt11 from anti-HIV_CDR
  source 1..36: mol_type = other RNA
ttgcggaggggatattacgatagcggggaagattac

SEQ ID NO: 59611 - RNA, 36 nt, synthetic construct
  misc_feature 1..36: note = derived and/or modified sequence opt11 from anti-HIV_CDR
  source 1..36: mol_type = other RNA
ctaaggagagggtactttgactcgggaggggaccat

SEQ ID NO: 59612 - RNA, 36 nt, synthetic construct; identical to SEQ ID NO: 21402
  misc_feature 1..36: note = derived and/or modified sequence opt11 from anti-HIV_CDR
  source 1..36: mol_type = other RNA

SEQ ID NO: 59613 - RNA, 36 nt, synthetic construct
  misc_feature 1..36: note = derived and/or modified sequence opt11 from anti-HIV_CDR
  source 1..36: mol_type = other RNA
ctcgacggcgaagccttccgctactacttcgactcc

SEQ ID NO: 59614 - RNA, 36 nt, synthetic construct
  misc_feature 1..36: note = derived and/or modified sequence opt11 from anti-HIV_CDR
  source 1..36: mol_type = other RNA
cgccgaggccaacgactactcgcctacttcgactac

SEQ ID NO: 59615 - RNA, 36 nt, synthetic construct
  misc_feature 1..36: note = derived and/or modified sequence opt11 from anti-HIV_CDR
  source 1..36: mol_type = other RNA
ccccaatacaacctcggccgcgaacccctaaacgtc

SEQ ID NO: 59616 - RNA, 36 nt, synthetic construct
  misc_feature 1..36: note = derived and/or modified sequence opt11 from anti-HIV_CDR
  source 1..36: mol_type = other RNA
gcccatcacgacttctggcgcgcgccagtagacgta

SEQ ID NO: 59617 - RNA, 36 nt, synthetic construct
  misc_feature 1..36: note = derived and/or modified sequence opt11 from anti-HIV_CDR
  source 1..36: mol_type = other RNA
ggccggcgcgaaggcctgaactttctactggactat

SEQ ID NO: 59618 - RNA, 36 nt, synthetic construct
  misc_feature 1..36: note = derived and/or modified sequence opt11 from anti-HIV_CDR
  source 1..36: mol_type = other RNA
cccgaaccctcctccatcgtcggcgccctctactac

SEQ ID NO: 59619 - RNA, 36 nt, synthetic construct
  misc_feature 1..36: note = derived and/or modified sequence opt11 from anti-HIV_CDR
  source 1..36: mol_type = other RNA
ggccccgacgacttctggtccggctacccaaaatac

SEQ ID NO: 59620 - RNA, 36 nt, synthetic construct
  misc_feature 1..36: note = derived and/or modified sequence opt11 from anti-HIV_CDR
  source 1..36: mol_type = other RNA
gactactcagccgccggccgacacctattcgactca

SEQ ID NO: 59621 - RNA, 36 nt, synthetic construct
  misc_feature 1..36: note = derived and/or modified sequence opt11 from anti-HIV_CDR
  source 1..36: mol_type = other RNA
gactacaccgcccgcggccgacacttcttcgactat

SEQ ID NO: 59622 - RNA, 36 nt, synthetic construct
  misc_feature 1..36: note = derived and/or modified sequence opt11 from anti-HIV_CDR
  source 1..36: mol_type = other RNA
gactacaccgcctccggccgacacttcttcgactac

SEQ ID NO: 59623 - RNA, 36 nt, synthetic construct
  misc_feature 1..36: note = derived and/or modified sequence opt11 from anti-HIV_CDR
  source 1..36: mol_type = other RNA
cagagctatgactcgagcttgagcgggagctgggtc

SEQ ID NO: 59624 - RNA, 36 nt, synthetic construct
  misc_feature 1..36: note = derived and/or modified sequence opt11 from anti-HIV_CDR
  source 1..36: mol_type = other RNA
cccgcgcaagcgggcgtgggcccgcgatttgactat

SEQ ID NO: 59625 - RNA, 36 nt, synthetic construct; identical to SEQ ID NO: 21415
  misc_feature 1..36: note = derived and/or modified sequence opt11 from anti-HIV_CDR
  source 1..36: mol_type = other RNA

SEQ ID NO: 59626 - RNA, 36 nt, synthetic construct; identical to SEQ ID NO: 21416
  misc_feature 1..36: note = derived and/or modified sequence opt11 from anti-HIV_CDR
  source 1..36: mol_type = other RNA

SEQ ID NO: 59627 - RNA, 36 nt, synthetic construct; identical to SEQ ID NO: 21417
  misc_feature 1..36: note = derived and/or modified sequence opt11 from anti-HIV_CDR
  source 1..36: mol_type = other RNA

SEQ ID NO: 59628 - RNA, 36 nt, synthetic construct
  misc_feature 1..36: note = derived and/or modified sequence opt11 from anti-HIV_CDR
  source 1..36: mol_type = other RNA
tgggtcgtgaccgcggccgaggaatatttcgattac

SEQ ID NO: 59629 - RNA, 39 nt, synthetic construct
  misc_feature 1..39: note = derived and/or modified sequence opt11 from anti-HIV_CDR
  source 1..39: mol_type = other RNA
gacccgcaagtggaagtgcgcgggaacgcgttcgatatc

SEQ ID NO: 59630 - RNA, 39 nt, synthetic construct
  misc_feature 1..39: note = derived and/or modified sequence opt11 from anti-HIV_CDR
  source 1..39: mol_type = other RNA
gaccacggcgacccccgaaccggctactacttcgactac

SEQ ID NO: 59631 - RNA, 39 nt, synthetic construct
  misc_feature 1..39: note = derived and/or modified sequence opt11 from anti-HIV_CDR
  source 1..39: mol_type = other RNA
gacgaaagcggatacgacctcaactggcatctcgacagc

SEQ ID NO: 59632 - RNA, 39 nt, synthetic construct
  misc_feature 1..39: note = derived and/or modified sequence opt11 from anti-HIV_CDR
  source 1..39: mol_type = other RNA
gacggaagcggagacgacagaaactggcatctagaccca

SEQ ID NO: 59633 - RNA, 39 nt, synthetic construct
  misc_feature 1..39: note = derived and/or modified sequence opt11 from anti-HIV_CDR
  source 1..39: mol_type = other RNA
gacagacgagacgacggactagactggctactagaccca

SEQ ID NO: 59634 - RNA, 39 nt, synthetic construct
  misc_feature 1..39: note = derived and/or modified sequence opt11 from anti-HIV_CDR
  source 1..39: mol_type = other RNA
gatggggggggggatgataggacgtggttgttggatgcg

SEQ ID NO: 59635 - RNA, 39 nt, synthetic construct
  misc_feature 1..39: note = derived and/or modified sequence opt11 from anti-HIV_CDR
  source 1..39: mol_type = other RNA
gacggaagcggagacgcaagagactggcacctacaccca

SEQ ID NO: 59636 - RNA, 39 nt, synthetic construct
  misc_feature 1..39: note = derived and/or modified sequence opt11 from anti-HIV_CDR
  source 1..39: mol_type = other RNA
gacggatcaggcgacgacacaagctggtacctggacccg

SEQ ID NO: 59637 - RNA, 39 nt, synthetic construct
  misc_feature 1..39: note = derived and/or modified sequence opt11 from anti-HIV_CDR
  source 1..39: mol_type = other RNA
gatggatcgggcgatgacacgagctggcacttggacccg

SEQ ID NO: 59638 - RNA, 39 nt, synthetic construct
  misc_feature 1..39: note = derived and/or modified sequence opt11 from anti-HIV_CDR
  source 1..39: mol_type = other RNA
gacaggcgcgatgacgatcgcgcgtggttgctcgatcca

SEQ ID NO: 59639 - RNA, 39 nt, synthetic construct
  misc_feature 1..39: note = derived and/or modified sequence opt11 from anti-HIV_CDR
  source 1..39: mol_type = other RNA
gacgggagcggggacgcgagagattggcatctagatcca

SEQ ID NO: 59640 - RNA, 39 nt, synthetic construct
  misc_feature 1..39: note = derived and/or modified sequence opt11 from anti-HIV_CDR
  source 1..39: mol_type = other RNA
gatggctcgggcgatgccacgagctggcacttgcacccg

SEQ ID NO: 59641 - RNA, 39 nt, synthetic construct
  misc_feature 1..39: note = derived and/or modified sequence opt11 from anti-HIV_CDR
  source 1..39: mol_type = other RNA
gacgaatccggcgacgacctcaaatggcacctccaccca

SEQ ID NO: 59642 - RNA, 39 nt, synthetic construct
  misc_feature 1..39: note = derived and/or modified sequence opt11 from anti-HIV_CDR
  source 1..39: mol_type = other RNA
gatggctcgggcgatgacacgagctggcacttgcacccg

SEQ ID NO: 59643 - RNA, 39 nt, synthetic construct
  misc_feature 1..39: note = derived and/or modified sequence opt11 from anti-HIV_CDR
  source 1..39: mol_type = other RNA
gcccaaggcgacatcctaaccgaaggctacttcgactac

SEQ ID NO: 59644 - RNA, 39 nt, synthetic construct
  misc_feature 1..39: note = derived and/or modified sequence opt11 from anti-HIV_CDR
  source 1..39: mol_type = other RNA
gaccgcatgttctggcaacagctcgcgaaatatgactcg

SEQ ID NO: 59645 - RNA, 39 nt, synthetic construct
  misc_feature 1..39: note = derived and/or modified sequence opt11 from anti-HIV_CDR
  source 1..39: mol_type = other RNA
tcaacctgggactactccctctccgcccacgaagacgtc

SEQ ID NO: 59646 - RNA, 39 nt, synthetic construct
  misc_feature 1..39: note = derived and/or modified sequence opt11 from anti-HIV_CDR
  source 1..39: mol_type = other RNA
gcggcctgggacgatagcttgagcgggctaaattgggtg

SEQ ID NO: 59647 - RNA, 39 nt, synthetic construct
  misc_feature 1..39: note = derived and/or modified sequence opt11 from anti-HIV_CDR
  source 1..39: mol_type = other RNA
ctctcgagcgatcgcatagtcgtggtcgggcccgattac

SEQ ID NO: 59648 - RNA, 39 nt, synthetic construct
  misc_feature 1..39: note = derived and/or modified sequence opt11 from anti-HIV_CDR
  source 1..39: mol_type = other RNA
gaagccggctcagtaaccgccaccggacccttcgactca

SEQ ID NO: 59649 - RNA, 39 nt, synthetic construct
  misc_feature 1..39: note = derived and/or modified sequence opt11 from anti-HIV_CDR
  source 1..39: mol_type = other RNA
gatttcgggcgcgcgtacgcgatcgggtactttgaatat

SEQ ID NO: 59650 - RNA, 39 nt, synthetic construct
  misc_feature 1..39: note = derived and/or modified sequence opt11 from anti-HIV_CDR
  source 1..39: mol_type = other RNA
gatcgcgcgccctatggcgcgttcgagccctttgacttt

SEQ ID NO: 59651 - RNA, 39 nt, synthetic construct
  misc_feature 1..39: note = derived and/or modified sequence opt11 from anti-HIV_CDR
  source 1..39: mol_type = other RNA
aacgggcactcgagcttgggcgggggctatttcccgcac

SEQ ID NO: 59652 - RNA, 39 nt, synthetic construct
  misc_feature 1..39: note = derived and/or modified sequence opt11 from anti-HIV_CDR
  source 1..39: mol_type = other RNA
aacggccactccgcactcggcggcgaatacttccaacac

SEQ ID NO: 59653 - RNA, 39 nt, synthetic construct
  misc_feature 1..39: note = derived and/or modified sequence opt11 from anti-HIV_CDR
  source 1..39: mol_type = other RNA
gcggccaggcgcgcgttctattactattacatggacgtg

SEQ ID NO: 59654 - RNA, 39 nt, synthetic construct
  misc_feature 1..39: note = derived and/or modified sequence opt11 from anti-HIV_CDR
  source 1..39: mol_type = other RNA
gccaactactacgacagctccggctacggcctagacata

SEQ ID NO: 59655 - RNA, 39 nt, synthetic construct
  misc_feature 1..39: note = derived and/or modified sequence opt11 from anti-HIV_CDR
  source 1..39: mol_type = other RNA
cactcacgccccggcgccccaccccactacttcgactac

SEQ ID NO: 59656 - RNA, 39 nt, synthetic construct
  misc_feature 1..39: note = derived and/or modified sequence opt11 from anti-HIV_CDR
  source 1..39: mol_type = other RNA
ggcctaaccgtcgccaccctctacgacgccttcgacgtc

SEQ ID NO: 59657 - RNA, 39 nt, synthetic construct
  misc_feature 1..39: note = derived and/or modified sequence opt11 from anti-HIV_CDR
  source 1..39: mol_type = other RNA
cgcgaccgctacaactggaaatactactacctcgacgtc

SEQ ID NO: 59658 - RNA, 39 nt, synthetic construct
  misc_feature 1..39: note = derived and/or modified sequence opt11 from anti-HIV_CDR
  source 1..39: mol_type = other RNA
gatagagggagctcgggctggtacgggtggttggacccg

SEQ ID NO: 59659 - RNA, 39 nt, synthetic construct
  misc_feature 1..39: note = derived and/or modified sequence opt11 from anti-HIV_CDR
  source 1..39: mol_type = other RNA
gatcgattgagctcgttctggagcgggggcatagaccag

SEQ ID NO: 59660 - RNA, 39 nt, synthetic construct
  misc_feature 1..39: note = derived and/or modified sequence opt11 from anti-HIV_CDR
  source 1..39: mol_type = other RNA
gacgtgatcgtgggcgcgctcttgggcgcgttcgatatc

SEQ ID NO: 59661 - RNA, 39 nt, synthetic construct; identical to SEQ ID NO: 21451
  misc_feature 1..39: note = derived and/or modified sequence opt11 from anti-HIV_CDR
  source 1..39: mol_type = other RNA

SEQ ID NO: 59662 - RNA, 39 nt, synthetic construct
  misc_feature 1..39: note = derived and/or modified sequence opt11 from anti-HIV_CDR
  source 1..39: mol_type = other RNA
gactcgcgcccgcaagcgctcgtggccgcgctcgatgtc

SEQ ID NO: 59663 - RNA, 39 nt, synthetic construct
  misc_feature 1..39: note = derived and/or modified sequence opt11 from anti-HIV_CDR
  source 1..39: mol_type = other RNA
gacgagatcgtgggcgcgctcttgggcgcgttcgatatc

SEQ ID NO: 59664 - RNA, 39 nt, synthetic construct
  misc_feature 1..39: note = derived and/or modified sequence opt11 from anti-HIV_CDR
  source 1..39: mol_type = other RNA
agcgatcccgcgatcgcggccgcgggctcgctcgatctc

SEQ ID NO: 59665 - RNA, 39 nt, synthetic construct
  misc_feature 1..39: note = derived and/or modified sequence opt11 from anti-HIV_CDR
  source 1..39: mol_type = other RNA
ccctacgtccaaaccgtcgccaccaccaccttcgacttc

SEQ ID NO: 59666 - RNA, 39 nt, synthetic construct
  misc_feature 1..39: note = derived and/or modified sequence opt11 from anti-HIV_CDR
  source 1..39: mol_type = other RNA
ggccccaaatccgtcgcctccctctcctacttcgacaaa

SEQ ID NO: 59667 - RNA, 39 nt, synthetic construct
  misc_feature 1..39: note = derived and/or modified sequence opt11 from anti-HIV_CDR
  source 1..39: mol_type = other RNA
ggcgcgctctggttcgggcaattgcgcgggctcgatcca

SEQ ID NO: 59668 - RNA, 39 nt, synthetic construct
  misc_feature 1..39: note = derived and/or modified sequence opt11 from anti-HIV_CDR
  source 1..39: mol_type = other RNA
gatctcaggccaatgcgcgggaactgggccatgcacgtg

SEQ ID NO: 59669 - RNA, 39 nt, synthetic construct
  misc_feature 1..39: note = derived and/or modified sequence opt11 from anti-HIV_CDR
  source 1..39: mol_type = other RNA
gacccgcaagtgaacaggcgcgggaactgtttcgaccac

SEQ ID NO: 59670 - RNA, 39 nt, synthetic construct
  misc_feature 1..39: note = derived and/or modified sequence opt11 from anti-HIV_CDR
  source 1..39: mol_type = other RNA
gacccacaaatagaaatccgcggcaacgccttcgacatc

SEQ ID NO: 59671 - RNA, 39 nt, synthetic construct
  misc_feature 1..39: note = derived and/or modified sequence opt11 from anti-HIV_CDR
  source 1..39: mol_type = other RNA
gtcccgcgcacgaccgcgaccagaaacgcattcgacatc

SEQ ID NO: 59672 - RNA, 39 nt, synthetic construct; identical to SEQ ID NO: 52030
  misc_feature 1..39: note = derived and/or modified sequence opt11 from anti-HIV_CDR
  source 1..39: mol_type = other RNA

SEQ ID NO: 59673 - RNA, 39 nt, synthetic construct
  misc_feature 1..39: note = derived and/or modified sequence opt11 from anti-HIV_CDR
  source 1..39: mol_type = other RNA
gactccgaagactacgtcgactactactacatggacgta

SEQ ID NO: 59674 - RNA, 39 nt, synthetic construct
  misc_feature 1..39: note = derived and/or modified sequence opt11 from anti-HIV_CDR
  source 1..39: mol_type = other RNA
ctcccgcgcacgaccggaatcagaaacgcattcgacatc

SEQ ID NO: 59675 - RNA, 39 nt, synthetic construct
  misc_feature 1..39: note = derived and/or modified sequence opt11 from anti-HIV_CDR
  source 1..39: mol_type = other RNA
ctcccccgcacaaccggcatcagaaacgccttcgacttc

SEQ ID NO: 59676 - RNA, 42 nt, synthetic construct
  misc_feature 1..42: note = derived and/or modified sequence opt11 from anti-HIV_CDR
  source 1..42: mol_type = other RNA
gggacattgtggtttggcgagagcgggctcaggctcgatcac

SEQ ID NO: 59677 - RNA, 42 nt, synthetic construct
  misc_feature 1..42: note = derived and/or modified sequence opt11 from anti-HIV_CDR
  source 1..42: mol_type = other RNA
gtcgcctacgtccacgtcgtcaccacccgctcactcgacaac

SEQ ID NO: 59678 - RNA, 42 nt, synthetic construct; identical to SEQ ID NO: 21468
  misc_feature 1..42: note = derived and/or modified sequence opt11 from anti-HIV_CDR
  source 1..42: mol_type = other RNA

SEQ ID NO: 59679 - RNA, 42 nt, synthetic construct; identical to SEQ ID NO: 21469
  misc_feature 1..42: note = derived and/or modified sequence opt11 from anti-HIV_CDR
  source 1..42: mol_type = other RNA

SEQ ID NO: 59680 - RNA, 42 nt, synthetic construct
  misc_feature 1..42: note = derived and/or modified sequence opt11 from anti-HIV_CDR
  source 1..42: mol_type = other RNA
ggcgggctctattgctcgagcataagctgtatcatggacgtg

SEQ ID NO: 59681 - RNA, 42 nt, synthetic construct
  misc_feature 1..42: note = derived and/or modified sequence opt11 from anti-HIV_CDR
  source 1..42: mol_type = other RNA
aacgaaccccaataccactccctccccggcatgttcgactac

SEQ ID NO: 59682 - RNA, 42 nt, synthetic construct
  misc_feature 1..42: note = derived and/or modified sequence opt11 from anti-HIV_CDR
  source 1..42: mol_type = other RNA
gagcccagggaaatgggcacgctcacggccgggttcgagtac

SEQ ID NO: 59683 - RNA, 42 nt, synthetic construct
  misc_feature 1..42: note = derived and/or modified sequence opt11 from anti-HIV_CDR
  source 1..42: mol_type = other RNA
gcgaccgggtactcgtacgggtacttggacgcgttcgatatc

SEQ ID NO: 59684 - RNA, 42 nt, synthetic construct
  misc_feature 1..42: note = derived and/or modified sequence opt11 from anti-HIV_CDR
  source 1..42: mol_type = other RNA
ggctcgctctggttcggggaatcgggattgagattggaccat

SEQ ID NO: 59685 - RNA, 42 nt, synthetic construct
  misc_feature 1..42: note = derived and/or modified sequence opt11 from anti-HIV_CDR
  source 1..42: mol_type = other RNA
gataacacgatctcgggcgtggtcccgcgctggttcgattac

SEQ ID NO: 59686 - RNA, 42 nt, synthetic construct; identical to SEQ ID NO: 21476
  misc_feature 1..42: note = derived and/or modified sequence opt11 from anti-HIV_CDR
  source 1..42: mol_type = other RNA

SEQ ID NO: 59687 - RNA, 42 nt, synthetic construct
  misc_feature 1..42: note = derived and/or modified sequence opt11 from anti-HIV_CDR
  source 1..42: mol_type = other RNA
gaccgctttaactggaacgatggcgggtactttttcgatagc

SEQ ID NO: 59688 - RNA, 42 nt, synthetic construct
  misc_feature 1..42: note = derived and/or modified sequence opt11 from anti-HIV_CDR
  source 1..42: mol_type = other RNA
ggccactcctcctcctggaccaaattcaactggttcggcccc

SEQ ID NO: 59689 - RNA, 42 nt, synthetic construct
  misc_feature 1..42: note = derived and/or modified sequence opt11 from anti-HIV_CDR
  source 1..42: mol_type = other RNA
tccatagccgccgacgactactactactactacatggacgtc

SEQ ID NO: 59690 - RNA, 42 nt, synthetic construct; identical to SEQ ID NO: 21480
  misc_feature 1..42: note = derived and/or modified sequence opt11 from anti-HIV_CDR
  source 1..42: mol_type = other RNA

SEQ ID NO: 59691 - RNA, 42 nt, synthetic construct
  misc_feature 1..42: note = derived and/or modified sequence opt11 from anti-HIV_CDR
  source 1..42: mol_type = other RNA
gacaaagacgcctccatctacggctaccgcatactcaaccac

SEQ ID NO: 59692 - RNA, 42 nt, synthetic construct
  misc_feature 1..42: note = derived and/or modified sequence opt11 from anti-HIV_CDR
  source 1..42: mol_type = other RNA
gtcctgaccgacctcgaccaaggaaacccacgcatggacgta

SEQ ID NO: 59693 - RNA, 42 nt, synthetic construct
  misc_feature 1..42: note = derived and/or modified sequence opt11 from anti-HIV_CDR
  source 1..42: mol_type = other RNA
cgcgagatcaagttcggggaattgagcttttactttgactcg

SEQ ID NO: 59694 - RNA, 42 nt, synthetic construct
  misc_feature 1..42: note = derived and/or modified sequence opt11 from anti-HIV_CDR
  source 1..42: mol_type = other RNA
cgcgaaatccgcttcggcgaactctccttctacttcgactac

SEQ ID NO: 59695 - RNA, 42 nt, synthetic construct; identical to SEQ ID NO: 21485
  misc_feature 1..42: note = derived and/or modified sequence opt11 from anti-HIV_CDR
  source 1..42: mol_type = other RNA

SEQ ID NO: 59696 - RNA, 42 nt, synthetic construct
  misc_feature 1..42: note = derived and/or modified sequence opt11 from anti-HIV_CDR
  source 1..42: mol_type = other RNA
ggcgactacgacatcctcacctcctcctaccaattcgactac

SEQ ID NO: 59697 - RNA, 42 nt, synthetic construct
  misc_feature 1..42: note = derived and/or modified sequence opt11 from anti-HIV_CDR
  source 1..42: mol_type = other RNA
tcaaccccactcgtctggccccccgccaacggcctcgacgtc

SEQ ID NO: 59698 - RNA, 42 nt, synthetic construct; identical to SEQ ID NO: 21488
  misc_feature 1..42: note = derived and/or modified sequence opt11 from anti-HIV_CDR
  source 1..42: mol_type = other RNA

SEQ ID NO: 59699 - RNA, 45 nt, synthetic construct
  misc_feature 1..45: note = derived and/or modified sequence opt11 from anti-HIV_CDR
  source 1..45: mol_type = other RNA
gaaaaaggccaatggctcaccgtccccccctactacttcgactcc

SEQ ID NO: 59700 - RNA, 45 nt, synthetic construct
  misc_feature 1..45: note = derived and/or modified sequence opt11 from anti-HIV_CDR
  source 1..45: mol_type = other RNA
gggagcgggcgctggaccataggcgcgcgcatatactttgacaat

SEQ ID NO: 59701 - RNA, 45 nt, synthetic construct
  misc_feature 1..45: note = derived and/or modified sequence opt11 from anti-HIV_CDR
  source 1..45: mol_type = other RNA
ctcgaggccgacggcgcagactatagcccgaaaatgttcgatttc

SEQ ID NO: 59702 - RNA, 45 nt, synthetic construct
  misc_feature 1..45: note = derived and/or modified sequence opt11 from anti-HIV_CDR
  source 1..45: mol_type = other RNA
ctcgaggccgacggcggagactacagcccgaaaatgttcgattac

SEQ ID NO: 59703 - RNA, 45 nt, synthetic construct
  misc_feature 1..45: note = derived and/or modified sequence opt11 from anti-HIV_CDR
  source 1..45: mol_type = other RNA
ctcgaagccgacggcgacaactacagcccaaaaatggtcgactac

SEQ ID NO: 59704 - RNA, 45 nt, synthetic construct
  misc_feature 1..45: note = derived and/or modified sequence opt11 from anti-HIV_CDR
  source 1..45: mol_type = other RNA
ctcgaagccgacggcgacgactacagcccaaaaatgttcgactac

SEQ ID NO: 59705 - RNA, 45 nt, synthetic construct
  misc_feature 1..45: note = derived and/or modified sequence opt11 from anti-HIV_CDR
  source 1..45: mol_type = other RNA
ctcgaggccgacggctcagactacagcccgaaaatgttcgacttc

SEQ ID NO: 59706 - RNA, 45 nt, synthetic construct
  misc_feature 1..45: note = derived and/or modified sequence opt11 from anti-HIV_CDR
  source 1..45: mol_type = other RNA
ctcgaggccgacggcgatgactatagcccgaaaatgttcgatcac

SEQ ID NO: 59707 - RNA, 45 nt, synthetic construct
  misc_feature 1..45: note = derived and/or modified sequence opt11 from anti-HIV_CDR
  source 1..45: mol_type = other RNA
ctcgaggccgacggcgatgactatagcccgaaaatggtcgattac

SEQ ID NO: 59708 - RNA, 45 nt, synthetic construct
  misc_feature 1..45: note = derived and/or modified sequence opt11 from anti-HIV_CDR
  source 1..45: mol_type = other RNA
gcgcccaggctcgatctcggggaattgagctcgggctttcacttt

SEQ ID NO: 59709 - RNA, 45 nt, synthetic construct
  misc_feature 1..45: note = derived and/or modified sequence opt11 from anti-HIV_CDR
  source 1..45: mol_type = other RNA
gccccccgcctcgaactcggcgaactctcctccggcttccactac

SEQ ID NO: 59710 - RNA, 45 nt, synthetic construct
  misc_feature 1..45: note = derived and/or modified sequence opt11 from anti-HIV_CDR
  source 1..45: mol_type = other RNA
gggcgattgctaatgcaatggcccccgcgcgggggctttgacccg

SEQ ID NO: 59711 - RNA, 45 nt, synthetic construct
  misc_feature 1..45: note = derived and/or modified sequence opt11 from anti-HIV_CDR
  source 1..45: mol_type = other RNA
ggccgactattcatgcaatggcccccacgcggcggcttcgaccca

SEQ ID NO: 59712 - RNA, 45 nt, synthetic construct
  misc_feature 1..45: note = derived and/or modified sequence opt11 from anti-HIV_CDR
  source 1..45: mol_type = other RNA
ggccgactattcgtacaatggccaccccaaggcggcttcgacccc

SEQ ID NO: 59713 - RNA, 45 nt, synthetic construct
  misc_feature 1..45: note = derived and/or modified sequence opt11 from anti-HIV_CDR
  source 1..45: mol_type = other RNA
ggccgactattcatgcaatggccaccccaaggcggcttcgacccc

SEQ ID NO: 59714 - RNA, 45 nt, synthetic construct
  misc_feature 1..45: note = derived and/or modified sequence opt11 from anti-HIV_CDR
  source 1..45: mol_type = other RNA
ggccgactattcgtacaatggcccccccaaggcggcttcgacaca

SEQ ID NO: 59715 - RNA, 45 nt, synthetic construct
  misc_feature 1..45: note = derived and/or modified sequence opt11 from anti-HIV_CDR
  source 1..45: mol_type = other RNA
aacaacaacacccgaaaatcaatcaacatcggccccggccgcgcc

SEQ ID NO: 59716 - RNA, 45 nt, synthetic construct
  misc_feature 1..45: note = derived and/or modified sequence opt11 from anti-HIV_CDR
  source 1..45: mol_type = other RNA
cccggatactgcaacaacaacatctgcacacactggttcgacacc

SEQ ID NO: 59717 - RNA, 45 nt, synthetic construct
  misc_feature 1..45: note = derived and/or modified sequence opt11 from anti-HIV_CDR
  source 1..45: mol_type = other RNA
gacctcctccccgactaccccgtctcctccgcccccgaagacttc

SEQ ID NO: 59718 - RNA, 45 nt, synthetic construct
  misc_feature 1..45: note = derived and/or modified sequence opt11 from anti-HIV_CDR
  source 1..45: mol_type = other RNA
gagagctggctctatagcaatggcgattactattacatggacgtg

SEQ ID NO: 59719 - RNA, 45 nt, synthetic construct; identical to SEQ ID NO: 21509
  misc_feature 1..45: note = derived and/or modified sequence opt11 from anti-HIV_CDR
  source 1..45: mol_type = other RNA

SEQ ID NO: 59720 - RNA, 45 nt, synthetic construct
  misc_feature 1..45: note = derived and/or modified sequence opt11 from anti-HIV_CDR
  source 1..45: mol_type = other RNA
caaacaaccgacgaaggccgccaatggctagtcggattccaacac

SEQ ID NO: 59721 - RNA, 45 nt, synthetic construct
  misc_feature 1..45: note = derived and/or modified sequence opt11 from anti-HIV_CDR
  source 1..45: mol_type = other RNA
ccctcgtacgggggctatgacgatcaagggtggtatttcgagtac

SEQ ID NO: 59722 - RNA, 45 nt, synthetic construct
  misc_feature 1..45: note = derived and/or modified sequence opt11 from anti-HIV_CDR
  source 1..45: mol_type = other RNA
gccgccatccccatcggcgactccaaatactcctacttcgactcc

SEQ ID NO: 59723 - RNA, 45 nt, synthetic construct
  misc_feature 1..45: note = derived and/or modified sequence opt11 from anti-HIV_CDR
  source 1..45: mol_type = other RNA
gccccaccccccggctcaaccgaatgggcctactacttcgactac

SEQ ID NO: 59724 - RNA, 45 nt, synthetic construct
  misc_feature 1..45: note = derived and/or modified sequence opt11 from anti-HIV_CDR
  source 1..45: mol_type = other RNA
gcccaattccacaactccggctactactactccggcctcgactac

SEQ ID NO: 59725 - RNA, 45 nt, synthetic construct
  misc_feature 1..45: note = derived and/or modified sequence opt11 from anti-HIV_CDR
  source 1..45: mol_type = other RNA
ggcggctacgactacggcgaccactactactactacatggacgta

SEQ ID NO: 59726 - RNA, 45 nt, synthetic construct
  misc_feature 1..45: note = derived and/or modified sequence opt11 from anti-HIV_CDR
  source 1..45: mol_type = other RNA
ggcacacaatcctactccgccgtcgcccccggctggttcgaccca

SEQ ID NO: 59727 - RNA, 45 nt, synthetic construct
  misc_feature 1..45: note = derived and/or modified sequence opt11 from anti-HIV_CDR
  source 1..45: mol_type = other RNA
atcaagggcccgcccaggggcaatttcggggtcgcgttctatttc

SEQ ID NO: 59728 - RNA, 45 nt, synthetic construct
  misc_feature 1..45: note = derived and/or modified sequence opt11 from anti-HIV_CDR
  source 1..45: mol_type = other RNA
aaagtgtactcggacgggtggtcgcccccgaccgggttcgtgtac

SEQ ID NO: 59729 - RNA, 45 nt, synthetic construct
  misc_feature 1..45: note = derived and/or modified sequence opt11 from anti-HIV_CDR
  source 1..45: mol_type = other RNA
cgctacaaatacctccccggcgaccaacacatgccctgggacaac

SEQ ID NO: 59730 - RNA, 45 nt, synthetic construct
  misc_feature 1..45: note = derived and/or modified sequence opt11 from anti-HIV_CDR
  source 1..45: mol_type = other RNA
cgctacaaatacctccccggcgaccaacacatgccctgggactac

SEQ ID NO: 59731 - RNA, 45 nt, synthetic construct
  misc_feature 1..45: note = derived and/or modified sequence opt11 from anti-HIV_CDR
  source 1..45: mol_type = other RNA
gggggggggtatgcggtggtggggccgaagtatgggttggatgtg

SEQ ID NO: 59732 - RNA, 45 nt, synthetic construct
  misc_feature 1..45: note = derived and/or modified sequence opt11 from anti-HIV_CDR
  source 1..45: mol_type = other RNA
ctcgatagctcgagcgggtgggaggaagtgggctatttcgatcgc

SEQ ID NO: 59733 - RNA, 45 nt, synthetic construct
  misc_feature 1..45: note = derived and/or modified sequence opt11 from anti-HIV_CDR
  source 1..45: mol_type = other RNA
gagaactatagcgatggatgggaagaggtagggcactttgactat

SEQ ID NO: 59734 - RNA, 45 nt, synthetic construct
  misc_feature 1..45: note = derived and/or modified sequence opt11 from anti-HIV_CDR
  source 1..45: mol_type = other RNA
gagaactatagcgatggatgggaagaggtagggcactttgactcg

SEQ ID NO: 59735 - RNA, 45 nt, synthetic construct
  misc_feature 1..45: note = derived and/or modified sequence opt11 from anti-HIV_CDR
  source 1..45: mol_type = other RNA
gagaactatagcgatggctggaacgaggtcgggcactttgacttt

SEQ ID NO: 59736 - RNA, 45 nt, synthetic construct
  misc_feature 1..45: note = derived and/or modified sequence opt11 from anti-HIV_CDR
  source 1..45: mol_type = other RNA
gaaaactacagcgacggctggtacgaagtcggacacttcgacctg

SEQ ID NO: 59737 - RNA, 45 nt, synthetic construct
  misc_feature 1..45: note = derived and/or modified sequence opt11 from anti-HIV_CDR
  source 1..45: mol_type = other RNA
gatcgcaggcgctttctcgagtggtcgctctatggcatggacgtg

SEQ ID NO: 59738 - RNA, 45 nt, synthetic construct
  misc_feature 1..45: note = derived and/or modified sequence opt11 from anti-HIV_CDR
  source 1..45: mol_type = other RNA
gggcccagggtctttttcgagagctcgggctattactttcgcgat

SEQ ID NO: 59739 - RNA, 45 nt, synthetic construct
  misc_feature 1..45: note = derived and/or modified sequence opt11 from anti-HIV_CDR
  source 1..45: mol_type = other RNA
ggcccccgcgtcctcttcgaatcctccggccactacctccgcgac

SEQ ID NO: 59740 - RNA, 45 nt, synthetic construct
  misc_feature 1..45: note = derived and/or modified sequence opt11 from anti-HIV_CDR
  source 1..45: mol_type = other RNA
ggcccccgcgtcttcttcgaatcctccggctactacttccgcaac

SEQ ID NO: 59741 - RNA, 45 nt, synthetic construct
  misc_feature 1..45: note = derived and/or modified sequence opt11 from anti-HIV_CDR
  source 1..45: mol_type = other RNA
gagggggggagtttgtggtttgggggggcgaattggttggatccg

SEQ ID NO: 59742 - RNA, 45 nt, synthetic construct
  misc_feature 1..45: note = derived and/or modified sequence opt11 from anti-HIV_CDR
  source 1..45: mol_type = other RNA
gccgattacgataacatatgggacagcaggggcgggttcgatcta

SEQ ID NO: 59743 - RNA, 45 nt, synthetic construct
  misc_feature 1..45: note = derived and/or modified sequence opt11 from anti-HIV_CDR
  source 1..45: mol_type = other RNA
gtgggcgggaccgtgtggtcgggctatagcaattacttggactat

SEQ ID NO: 59744 - RNA, 45 nt, synthetic construct
  misc_feature 1..45: note = derived and/or modified sequence opt11 from anti-HIV_CDR
  source 1..45: mol_type = other RNA
gacaatcgcgatcaatggctcgtgctcaggagctggttcgaccca

SEQ ID NO: 59745 - RNA, 45 nt, synthetic construct
  misc_feature 1..45: note = derived and/or modified sequence opt11 from anti-HIV_CDR
  source 1..45: mol_type = other RNA
gaaaaaggccaatgggtcaccctcccaccctactacttcgactcc

SEQ ID NO: 59746 - RNA, 48 nt, synthetic construct
  misc_feature 1..48: note = derived and/or modified sequence opt11 from anti-HIV_CDR
  source 1..48: mol_type = other RNA
tacttctccgacaccgaccgctccgaatactccccctccctccgctcc

SEQ ID NO: 59747 - RNA, 48 nt, synthetic construct
  misc_feature 1..48: note = derived and/or modified sequence opt11 from anti-HIV_CDR
  source 1..48: mol_type = other RNA
tacataagcgatcgcgagagcgcgacctataacccgagcttgaactcg

SEQ ID NO: 59748 - RNA, 48 nt, synthetic construct
  misc_feature 1..48: note = derived and/or modified sequence opt11 from anti-HIV_CDR
  source 1..48: mol_type = other RNA
tacttctccgacaccgaaaaatccaactacaacccctccctccgctcc

SEQ ID NO: 59749 - RNA, 48 nt, synthetic construct
  misc_feature 1..48: note = derived and/or modified sequence opt11 from anti-HIV_CDR
  source 1..48: mol_type = other RNA
tacatatccgaccgcgcctccgccacctacaacccatccctaaactca

SEQ ID NO: 59750 - RNA, 48 nt, synthetic construct
  misc_feature 1..48: note = derived and/or modified sequence opt11 from anti-HIV_CDR
  source 1..48: mol_type = other RNA
tacgtccaccactccggcgacaccaactacaacccctccctcaaacgc

SEQ ID NO: 59751 - RNA, 48 nt, synthetic construct
  misc_feature 1..48: note = derived and/or modified sequence opt11 from anti-HIV_CDR
  source 1..48: mol_type = other RNA
tacgtccacaaatccggcgacaccaactactccccctccctcaaatcc

SEQ ID NO: 59752 - RNA, 48 nt, synthetic construct
  misc_feature 1..48: note = derived and/or modified sequence opt11 from anti-HIV_CDR
  source 1..48: mol_type = other RNA
tacgtccacgactccggcgacaccaactacaacccctccctcaaatcc

SEQ ID NO: 59753 - RNA, 48 nt, synthetic construct
  misc_feature 1..48: note = derived and/or modified sequence opt11 from anti-HIV_CDR
  source 1..48: mol_type = other RNA
tacatctccaaatccgaatccgccaactacaacccctccctcaactcc

SEQ ID NO: 59754 - RNA, 48 nt, synthetic construct
  misc_feature 1..48: note = derived and/or modified sequence opt11 from anti-HIV_CDR
  source 1..48: mol_type = other RNA
tacatctactactccggctccaccaactacaacccctccctcaaatcc

SEQ ID NO: 59755 - RNA, 48 nt, synthetic construct
  misc_feature 1..48: note = derived and/or modified sequence opt11 from anti-HIV_CDR
  source 1..48: mol_type = other RNA
tacgtccacgactccggcgacatcaactacaacccctccctcaaaaac

SEQ ID NO: 59756 - RNA, 48 nt, synthetic construct
  misc_feature 1..48: note = derived and/or modified sequence opt11 from anti-HIV_CDR
  source 1..48: mol_type = other RNA
tcatactacgacttctccatcggcgacggcaacgacgccttcgacgtc

SEQ ID NO: 59757 - RNA, 48 nt, synthetic construct; identical to SEQ ID NO: 21547
  misc_feature 1..48: note = derived and/or modified sequence opt11 from anti-HIV_CDR
  source 1..48: mol_type = other RNA

SEQ ID NO: 59758 - RNA, 48 nt, synthetic construct; identical to SEQ ID NO: 21548
  misc_feature 1..48: note = derived and/or modified sequence opt11 from anti-HIV_CDR
  source 1..48: mol_type = other RNA

SEQ ID NO: 59759 - RNA, 48 nt, synthetic construct
  misc_feature 1..48: note = derived and/or modified sequence opt11 from anti-HIV_CDR
  source 1..48: mol_type = other RNA
gatgggttgggggaggtggcgccggattataggtatgggatagatgtg

SEQ ID NO: 59760 - RNA, 48 nt, synthetic construct
  misc_feature 1..48: note = derived and/or modified sequence opt11 from anti-HIV_CDR
  source 1..48: mol_type = other RNA
gatggcttgggcgagctcgcgcccgcgtaccagtacgggatcgatgtc

SEQ ID NO: 59761 - RNA, 48 nt, synthetic construct
  misc_feature 1..48: note = derived and/or modified sequence opt11 from anti-HIV_CDR
  source 1..48: mol_type = other RNA
gatggcttgggcgagctcgcgcccgcgtaccattacgggatcgatgtc

SEQ ID NO: 59762 - RNA, 48 nt, synthetic construct
  misc_feature 1..48: note = derived and/or modified sequence opt11 from anti-HIV_CDR
  source 1..48: mol_type = other RNA
gatggcttgggcgaggtcgcgcccgcgtacttgtacgggatcgatgcc

SEQ ID NO: 59763 - RNA, 48 nt, synthetic construct
  misc_feature 1..48: note = derived and/or modified sequence opt11 from anti-HIV_CDR
  source 1..48: mol_type = other RNA
gcggtgaaggggttttggtttgatgaggtgtataattggtttgggccg

SEQ ID NO: 59764 - RNA, 48 nt, synthetic construct
  misc_feature 1..48: note = derived and/or modified sequence opt11 from anti-HIV_CDR
  source 1..48: mol_type = other RNA
gccgtcaaaggcttctggttcgacgacccctacacctggttcggcccc

SEQ ID NO: 59765 - RNA, 48 nt, synthetic construct
  misc_feature 1..48: note = derived and/or modified sequence opt11 from anti-HIV_CDR
  source 1..48: mol_type = other RNA
gcagtaaagggattctggtttgacgagccgagtacatggttcgggccg

SEQ ID NO: 59766 - RNA, 48 nt, synthetic construct
  misc_feature 1..48: note = derived and/or modified sequence opt11 from anti-HIV_CDR
  source 1..48: mol_type = other RNA
gccgtgaaagggctctggttcgacgaaacgtacacatggttcggcccg

SEQ ID NO: 59767 - RNA, 48 nt, synthetic construct
  misc_feature 1..48: note = derived and/or modified sequence opt11 from anti-HIV_CDR
  source 1..48: mol_type = other RNA
gccgtagccggcctctggttcgaagacgcctacaactggttcggacca

SEQ ID NO: 59768 - RNA, 48 nt, synthetic construct
  misc_feature 1..48: note = derived and/or modified sequence opt11 from anti-HIV_CDR
  source 1..48: mol_type = other RNA
gcggaagcggaatcgcaatcgcactcgcgcccgatcatgttcgattac

SEQ ID NO: 59769 - RNA, 48 nt, synthetic construct
  misc_feature 1..48: note = derived and/or modified sequence opt11 from anti-HIV_CDR
  source 1..48: mol_type = other RNA
gcggaagcggcctcggactcgcactcgcgcccgatcatgttcgatcac

SEQ ID NO: 59770 - RNA, 48 nt, synthetic construct
  misc_feature 1..48: note = derived and/or modified sequence opt11 from anti-HIV_CDR
  source 1..48: mol_type = other RNA
ctcgaagccgaatccgactcccactcccgccccatcatgttcgaccac

SEQ ID NO: 59771 - RNA, 48 nt, synthetic construct
  misc_feature 1..48: note = derived and/or modified sequence opt11 from anti-HIV_CDR
  source 1..48: mol_type = other RNA
gcggaagcggaatcgcaatcgcactcgcgcccgatcatgttcgatagc

SEQ ID NO: 59772 - RNA, 48 nt, synthetic construct
  misc_feature 1..48: note = derived and/or modified sequence opt11 from anti-HIV_CDR
  source 1..48: mol_type = other RNA
gcggaagcggaatcgcaatcgcactcgcgcccgatcatgttcgatttc

SEQ ID NO: 59773 - RNA, 48 nt, synthetic construct
  misc_feature 1..48: note = derived and/or modified sequence opt11 from anti-HIV_CDR
  source 1..48: mol_type = other RNA
gacaaccccctcctccaatccggcgaattctcctcctccctcgaaaac

SEQ ID NO: 59774 - RNA, 48 nt, synthetic construct
  misc_feature 1..48: note = derived and/or modified sequence opt11 from anti-HIV_CDR
  source 1..48: mol_type = other RNA
gataacccgctcttgcaatcgggcgagttctcgagctcgctcgataac

SEQ ID NO: 59775 - RNA, 48 nt, synthetic construct
  misc_feature 1..48: note = derived and/or modified sequence opt11 from anti-HIV_CDR
  source 1..48: mol_type = other RNA
gggcgcgattacaatttctggggcgggggcgggaaaataaactttcca

SEQ ID NO: 59776 - RNA, 48 nt, synthetic construct; identical to SEQ ID NO: 21566
  misc_feature 1..48: note = derived and/or modified sequence opt11 from anti-HIV_CDR
  source 1..48: mol_type = other RNA

SEQ ID NO: 59777 - RNA, 48 nt, synthetic construct; identical to SEQ ID NO: 21567
  misc_feature 1..48: note = derived and/or modified sequence opt11 from anti-HIV_CDR
  source 1..48: mol_type = other RNA

SEQ ID NO: 59778 - RNA, 48 nt, synthetic construct
  misc_feature 1..48: note = derived and/or modified sequence opt11 from anti-HIV_CDR
  source 1..48: mol_type = other RNA
caagtctcctcctactcctcctccggctaccgccgcgaattcgactac

SEQ ID NO: 59779 - RNA, 48 nt, synthetic construct
  misc_feature 1..48: note = derived and/or modified sequence opt11 from anti-HIV_CDR
  source 1..48: mol_type = other RNA
cgcatggccacactcaccggcggctactactactactacatggacgtc

SEQ ID NO: 59780 - RNA, 48 nt, synthetic construct
  misc_feature 1..48: note = derived and/or modified sequence opt11 from anti-HIV_CDR
  source 1..48: mol_type = other RNA
gagggcgggtactcggacttttggtcgggctatagcgggttcgattac

SEQ ID NO: 59781 - RNA, 48 nt, synthetic construct; identical to SEQ ID NO: 21571
  misc_feature 1..48: note = derived and/or modified sequence opt11 from anti-HIV_CDR
  source 1..48: mol_type = other RNA

SEQ ID NO: 59782 - RNA, 48 nt, synthetic construct
  misc_feature 1..48: note = derived and/or modified sequence opt11 from anti-HIV_CDR
  source 1..48: mol_type = other RNA
gcgagggagggccgatggtttagcgataactattacgcgatggatgtc

SEQ ID NO: 59783 - RNA, 48 nt, synthetic construct
  misc_feature 1..48: note = derived and/or modified sequence opt11 from anti-HIV_CDR
  source 1..48: mol_type = other RNA
gatcgagtgggcaggcgcttgggcgagctctcggccgggttcgattac

SEQ ID NO: 59784 - RNA, 48 nt, synthetic construct
  misc_feature 1..48: note = derived and/or modified sequence opt11 from anti-HIV_CDR
  source 1..48: mol_type = other RNA
gcgagaccgagatcgccatgggactcgaccgggtggtcggtcgggtac

SEQ ID NO: 59785 - RNA, 48 nt, synthetic construct; identical to SEQ ID NO: 21575
  misc_feature 1..48: note = derived and/or modified sequence opt11 from anti-HIV_CDR
  source 1..48: mol_type = other RNA

SEQ ID NO: 59786 - RNA, 48 nt, synthetic construct
  misc_feature 1..48: note = derived and/or modified sequence opt11 from anti-HIV_CDR
  source 1..48: mol_type = other RNA
tcctactacgacttccaaaccgactccggcaacgacgccttcgacgtc

SEQ ID NO: 59787 - RNA, 48 nt, synthetic construct
  misc_feature 1..48: note = derived and/or modified sequence opt11 from anti-HIV_CDR
  source 1..48: mol_type = other RNA
gacaaccccgtcctccaactcggcgaactctcctcctccctcgactac

SEQ ID NO: 59788 - RNA, 48 nt, synthetic construct
  misc_feature 1..48: note = derived and/or modified sequence opt11 from anti-HIV_CDR
  source 1..48: mol_type = other RNA
ggcttccgcggctcccccttctcctccggctccatgtacttcgactca

SEQ ID NO: 59789 - RNA, 48 nt, synthetic construct; identical to SEQ ID NO: 21579
  misc_feature 1..48: note = derived and/or modified sequence opt11 from anti-HIV_CDR
  source 1..48: mol_type = other RNA

SEQ ID NO: 59790 - RNA, 48 nt, synthetic construct; identical to SEQ ID NO: 21580
  misc_feature 1..48: note = derived and/or modified sequence opt11 from anti-HIV_CDR
  source 1..48: mol_type = other RNA

SEQ ID NO: 59791 - RNA, 48 nt, synthetic construct
  misc_feature 1..48: note = derived and/or modified sequence opt11 from anti-HIV_CDR
  source 1..48: mol_type = other RNA
gatcgcttgagctttagcgtgcaagtggaacagggcgtgctcgattac

SEQ ID NO: 59792 - RNA, 48 nt, synthetic construct
  misc_feature 1..48: note = derived and/or modified sequence opt11 from anti-HIV_CDR
  source 1..48: mol_type = other RNA
gatcgcttgagctttagcgtgcaagtggaacagggcgtgctccagttc

SEQ ID NO: 59793 - RNA, 48 nt, synthetic construct; identical to SEQ ID NO: 21583
  misc_feature 1..48: note = derived and/or modified sequence opt11 from anti-HIV_CDR
  source 1..48: mol_type = other RNA

SEQ ID NO: 59794 - RNA, 51 nt, synthetic construct
  misc_feature 1..51: note = derived and/or modified sequence opt11 from anti-HIV_CDR
  source 1..51: mol_type = other RNA
tacatctcctccggctcctccaccctccactacgccgacaccgtcaaaggc

SEQ ID NO: 59795 - RNA, 51 nt, synthetic construct
  misc_feature 1..51: note = derived and/or modified sequence opt11 from anti-HIV_CDR
  source 1..51: mol_type = other RNA
agatacctagactggtcaccaatcggccgcgacacctacggcacagacgtc

SEQ ID NO: 59796 - RNA, 51 nt, synthetic construct
  misc_feature 1..51: note = derived and/or modified sequence opt11 from anti-HIV_CDR
  source 1..51: mol_type = other RNA
cgctacttcgactggtccccattccgccgcgacacctacggcaccgacgtc

SEQ ID NO: 59797 - RNA, 51 nt, synthetic construct
  misc_feature 1..51: note = derived and/or modified sequence opt11 from anti-HIV_CDR
  source 1..51: mol_type = other RNA
gggcgagattacaatttctggagcgggggcgggcgctattactttgacttt

SEQ ID NO: 59798 - RNA, 51 nt, synthetic construct
  misc_feature 1..51: note = derived and/or modified sequence opt11 from anti-HIV_CDR
  source 1..51: mol_type = other RNA
ggcatacaagaggactacgacttctggagggaataccgagagctcgactac

SEQ ID NO: 59799 - RNA, 51 nt, synthetic construct
  misc_feature 1..51: note = derived and/or modified sequence opt11 from anti-HIV_CDR
  source 1..51: mol_type = other RNA
gtcctcaacaacaacacccgcaaatcaatcaacatcggccccggccgcgcc

SEQ ID NO: 59800 - RNA, 51 nt, synthetic construct; identical to SEQ ID NO: 21590
  misc_feature 1..51: note = derived and/or modified sequence opt11 from anti-HIV_CDR
  source 1..51: mol_type = other RNA

SEQ ID NO: 59801 - RNA, 51 nt, synthetic construct
  misc_feature 1..51: note = derived and/or modified sequence opt11 from anti-HIV_CDR
  source 1..51: mol_type = other RNA
catggcaggaccgtgttcggggtcgtgcgcaattactattacatggacgtg

SEQ ID NO: 59802 - RNA, 51 nt, synthetic construct
  misc_feature 1..51: note = derived and/or modified sequence opt11 from anti-HIV_CDR
  source 1..51: mol_type = other RNA
cactactacggctccggcctcaccaaagactactacgaatacatcgacgtc

SEQ ID NO: 59803 - RNA, 51 nt, synthetic construct
  misc_feature 1..51: note = derived and/or modified sequence opt11 from anti-HIV_CDR
  source 1..51: mol_type = other RNA
acctactacaacttctggtccgaccaatcacaaggcctcgacttcgactac

SEQ ID NO: 59804 - RNA, 51 nt, synthetic construct
  misc_feature 1..51: note = derived and/or modified sequence opt11 from anti-HIV_CDR
  source 1..51: mol_type = other RNA
ggagtgtgggaggccccggacgggagctcgtactattactatatggcggac

SEQ ID NO: 59805 - RNA, 51 nt, synthetic construct
  misc_feature 1..51: note = derived and/or modified sequence opt11 from anti-HIV_CDR
  source 1..51: mol_type = other RNA
gaccaaggcggctaccccgtctcaccagtcggccccaaatggttcgaccca

SEQ ID NO: 59806 - RNA, 51 nt, synthetic construct
  misc_feature 1..51: note = derived and/or modified sequence opt11 from anti-HIV_CDR
  source 1..51: mol_type = other RNA
cgcgataaatatcaatatatcgatagctcgggcgattacccgttcgatcgc

SEQ ID NO: 59807 - RNA, 51 nt, synthetic construct
  misc_feature 1..51: note = derived and/or modified sequence opt11 from anti-HIV_CDR
  source 1..51: mol_type = other RNA
caactccgcgcccccacaacccgcttccgccacggcggctacttcgaaaac

SEQ ID NO: 59808 - RNA, 51 nt, synthetic construct
  misc_feature 1..51: note = derived and/or modified sequence opt11 from anti-HIV_CDR
  source 1..51: mol_type = other RNA
caagtgcgcgcgcccacgctcaggttcaggcacgggggctatttcgagacc

SEQ ID NO: 59809 - RNA, 51 nt, synthetic construct
  misc_feature 1..51: note = derived and/or modified sequence opt11 from anti-HIV_CDR
  source 1..51: mol_type = other RNA
gtctcgatcacgtacgcgggcttgatcgtggtcccgggcgcgttcgatgtc

SEQ ID NO: 59810 - RNA, 51 nt, synthetic construct; identical to SEQ ID NO: 21600
  misc_feature 1..51: note = derived and/or modified sequence opt11 from anti-HIV_CDR
  source 1..51: mol_type = other RNA

SEQ ID NO: 59811 - RNA, 51 nt, synthetic construct
  misc_feature 1..51: note = derived and/or modified sequence opt11 from anti-HIV_CDR
  source 1..51: mol_type = other RNA
agcttgaccgggcgcttgcacttgggcgagctctcgagcgggatcgggccc

SEQ ID NO: 59812 - RNA, 51 nt, synthetic construct
  misc_feature 1..51: note = derived and/or modified sequence opt11 from anti-HIV_CDR
  source 1..51: mol_type = other RNA
ggcggctccgccctcataaccatattcggcgtcgaccccaaattcgacccc

SEQ ID NO: 59813 - RNA, 51 nt, synthetic construct
  misc_feature 1..51: note = derived and/or modified sequence opt11 from anti-HIV_CDR
  source 1..51: mol_type = other RNA
atggcgctcacgagcgggccctatgacgtgagcgggtactatttcgattac

SEQ ID NO: 59814 - RNA, 51 nt, synthetic construct
  misc_feature 1..51: note = derived and/or modified sequence opt11 from anti-HIV_CDR
  source 1..51: mol_type = other RNA
atggcgctcgcgagcgggccctatgacgtgagcgggtactatttcgattac

SEQ ID NO: 59815 - RNA, 51 nt, synthetic construct
  misc_feature 1..51: note = derived and/or modified sequence opt11 from anti-HIV_CDR
  source 1..51: mol_type = other RNA
atggcgctaccgagcgggccattggacaggagcgggtactatttcgatgac

SEQ ID NO: 59816 - RNA, 54 nt, synthetic construct
  misc_feature 1..54: note = derived and/or modified sequence opt11 from anti-HIV_CDR
  source 1..54: mol_type = other RNA
gtcgtccccatgttctccatcttcggcgtcgtcaaagccaactacttcgactac

SEQ ID NO: 59817 - RNA, 54 nt, synthetic construct
  misc_feature 1..54: note = derived and/or modified sequence opt11 from anti-HIV_CDR
  source 1..54: mol_type = other RNA
aacagacgcgtggccatgcccgaggccatgatcctaagcttctacatggacgta

SEQ ID NO: 59818 - RNA, 54 nt, synthetic construct
  misc_feature 1..54: note = derived and/or modified sequence opt11 from anti-HIV_CDR
  source 1..54: mol_type = other RNA
gggttgtgtaggggggggaattgtaggttggggccgagtgggtggttggatccg

SEQ ID NO: 59819 - RNA, 54 nt, synthetic construct
  misc_feature 1..54: note = derived and/or modified sequence opt11 from anti-HIV_CDR
  source 1..54: mol_type = other RNA
acccccccccactacgacgtcctcaccggctacccctcctccgtcctcgaattc

SEQ ID NO: 59820 - RNA, 54 nt, synthetic construct
  misc_feature 1..54: note = derived and/or modified sequence opt11 from anti-HIV_CDR
  source 1..54: mol_type = other RNA
atcccctaccactccgaatcctactacaaagtcgtcatcggcggcttcgacgtc

SEQ ID NO: 59821 - RNA, 54 nt, synthetic construct
  misc_feature 1..54: note = derived and/or modified sequence opt11 from anti-HIV_CDR
  source 1..54: mol_type = other RNA
gccgaccccttcaaagtcgcccaagacgaaggcctcttcgtcatcttcgactac

SEQ ID NO: 59822 - RNA, 54 nt, synthetic construct
  misc_feature 1..54: note = derived and/or modified sequence opt11 from anti-HIV_CDR
  source 1..54: mol_type = other RNA
gccgaccccttcaaagtcgcccaagacgaaggcctctacgtcatcttcgactac

SEQ ID NO: 59823 - RNA, 54 nt, synthetic construct
  misc_feature 1..54: note = derived and/or modified sequence opt11 from anti-HIV_CDR
  source 1..54: mol_type = other RNA
gccgaccgcttcaaagtcgcccaagacgaaggcctattcgtcatcttcgactac

SEQ ID NO: 59824 - RNA, 54 nt, synthetic construct
  misc_feature 1..54: note = derived and/or modified sequence opt11 from anti-HIV_CDR
  source 1..54: mol_type = other RNA
gggcgccagacctttcgcgcaatctggagcgggcccccggccgtgttcgatatc

SEQ ID NO: 59825 - RNA, 54 nt, synthetic construct
  misc_feature 1..54: note = derived and/or modified sequence opt11 from anti-HIV_CDR
  source 1..54: mol_type = other RNA
ggccgccaaaccttccgcgcaatctggtccggcccacccgtcgtattcgacatc

SEQ ID NO: 59826 - RNA, 54 nt, synthetic construct
  misc_feature 1..54: note = derived and/or modified sequence opt11 from anti-HIV_CDR
  source 1..54: mol_type = other RNA
tcccgcggcgactacaacttctggtccggctaccccgaataccacttcgaccgc

SEQ ID NO: 59827 - RNA, 54 nt, synthetic construct
  misc_feature 1..54: note = derived and/or modified sequence opt11 from anti-HIV_CDR
  source 1..54: mol_type = other RNA
ctccccaaatcccgcatggtcggcggcgaccacctccccttctaccccgacttc

SEQ ID NO: 59828 - RNA, 54 nt, synthetic construct
  misc_feature 1..54: note = derived and/or modified sequence opt11 from anti-HIV_CDR
  source 1..54: mol_type = other RNA
ctcaccggcccctccggctactgcgactcctccggctgttactggttcgacccc

SEQ ID NO: 59829 - RNA, 54 nt, synthetic construct
  misc_feature 1..54: note = derived and/or modified sequence opt11 from anti-HIV_CDR
  source 1..54: mol_type = other RNA
ggcgggagcatgatcaggggcgtgccctcgcccttttactatggcatggacgtg

SEQ ID NO: 59830 - RNA, 54 nt, synthetic construct
  misc_feature 1..54: note = derived and/or modified sequence opt11 from anti-HIV_CDR
  source 1..54: mol_type = other RNA
ctatttggcgcgaaaaggctcggggtcgcgccatcgggctattacatggacgtg

SEQ ID NO: 59831 - RNA, 54 nt, synthetic construct
  misc_feature 1..54: note = derived and/or modified sequence opt11 from anti-HIV_CDR
  source 1..54: mol_type = other RNA
gataggtatgaggcggcgtggtttggggcggataaggtgtatgggatggatgtg

SEQ ID NO: 59832 - RNA, 54 nt, synthetic construct
  misc_feature 1..54: note = derived and/or modified sequence opt11 from anti-HIV_CDR
  source 1..54: mol_type = other RNA
gaacaccgcctccccccccccaccggccgccgcacccgcaactggttcgaccca

SEQ ID NO: 59833 - RNA, 54 nt, synthetic construct
  misc_feature 1..54: note = derived and/or modified sequence opt11 from anti-HIV_CDR
  source 1..54: mol_type = other RNA
ggcaggggctcgttccagggctttcaacagtacgagtactatggcatggacgtg

SEQ ID NO: 59834 - RNA, 54 nt, synthetic construct
  misc_feature 1..54: note = derived and/or modified sequence opt11 from anti-HIV_CDR
  source 1..54: mol_type = other RNA
ggccgaggctacagccacggcttccaacaatacaactactacggcatggacgta

SEQ ID NO: 59835 - RNA, 54 nt, synthetic construct
  misc_feature 1..54: note = derived and/or modified sequence opt11 from anti-HIV_CDR
  source 1..54: mol_type = other RNA
ggccgcggcagcttcaccggattcgaccaataccactactacggaatggacgtc

SEQ ID NO: 59836 - RNA, 54 nt, synthetic construct
  misc_feature 1..54: note = derived and/or modified sequence opt11 from anti-HIV_CDR
  source 1..54: mol_type = other RNA
ggccgcggctccaccttcccctccgcccaattctcctacttcggcctcgacgtc

SEQ ID NO: 59837 - RNA, 54 nt, synthetic construct
  misc_feature 1..54: note = derived and/or modified sequence opt11 from anti-HIV_CDR
  source 1..54: mol_type = other RNA
gatctcgcgcgctatggcgtgacctcgatcgtgcccgagttcgggttcgatttc

SEQ ID NO: 59838 - RNA, 54 nt, synthetic construct; identical to SEQ ID NO: 21628
  misc_feature 1..54: note = derived and/or modified sequence opt11 from anti-HIV_CDR
  source 1..54: mol_type = other RNA

SEQ ID NO: 59839 - RNA, 54 nt, synthetic construct
  misc_feature 1..54: note = derived and/or modified sequence opt11 from anti-HIV_CDR
  source 1..54: mol_type = other RNA
ggaccgggctcgatggtgagagggctaatagtaacgagctatggcatggacgtg

SEQ ID NO: 59840 - RNA, 54 nt, synthetic construct
  misc_feature 1..54: note = derived and/or modified sequence opt11 from anti-HIV_CDR
  source 1..54: mol_type = other RNA
aagcgcgtgaccatattcggggtcgtggacacgcccaggggctatttcgattac

SEQ ID NO: 59841 - RNA, 54 nt, synthetic construct
  misc_feature 1..54: note = derived and/or modified sequence opt11 from anti-HIV_CDR
  source 1..54: mol_type = other RNA
ggccaacgcaacgtcctccacttcctcgaacgcaaaaacgacgccttcgacatc

SEQ ID NO: 59842 - RNA, 54 nt, synthetic construct
  misc_feature 1..54: note = derived and/or modified sequence opt11 from anti-HIV_CDR
  source 1..54: mol_type = other RNA
gaacaaaaagactacgacttctggaacggcctctacaaatacggcatggacgta

SEQ ID NO: 59843 - RNA, 57 nt, synthetic construct
  misc_feature 1..57: note = derived and/or modified sequence opt11 from anti-HIV_CDR
  source 1..57: mol_type = other RNA
gacacaaccacattcacaaccttcggcggcggcccaaacatgggcggattcgaccca

SEQ ID NO: 59844 - RNA, 57 nt, synthetic construct
  misc_feature 1..57: note = derived and/or modified sequence opt11 from anti-HIV_CDR
  source 1..57: mol_type = other RNA
gccgggctagattacaatttctggaacgggaaagggcgaaagggcgcgttcgatgta

SEQ ID NO: 59845 - RNA, 57 nt, synthetic construct
  misc_feature 1..57: note = derived and/or modified sequence opt11 from anti-HIV_CDR
  source 1..57: mol_type = other RNA
aacgaggccgactaccacgacgggaacgggcactcgctcagaggcatgttcgactac

SEQ ID NO: 59846 - RNA, 57 nt, synthetic construct
  misc_feature 1..57: note = derived and/or modified sequence opt11 from anti-HIV_CDR
  source 1..57: mol_type = other RNA
aacgaaccccaataccacgacggcaacggacactcactcccaggcatgttcgacagc

SEQ ID NO: 59847 - RNA, 57 nt, synthetic construct
  misc_feature 1..57: note = derived and/or modified sequence opt11 from anti-HIV_CDR
  source 1..57: mol_type = other RNA
aacgaaccccaataccacgacgacaacggccactcactccccggcatgatcgactac

SEQ ID NO: 59848 - RNA, 57 nt, synthetic construct
  misc_feature 1..57: note = derived and/or modified sequence opt11 from anti-HIV_CDR
  source 1..57: mol_type = other RNA
aacgaaccccaataccacgacggcaacggccactcactccccggcatgttcgacttc

SEQ ID NO: 59849 - RNA, 57 nt, synthetic construct
  misc_feature 1..57: note = derived and/or modified sequence opt11 from anti-HIV_CDR
  source 1..57: mol_type = other RNA
aacgaaccccaatacttcgacggctccggccactcactccccggcatgttcgactac

SEQ ID NO: 59850 - RNA, 57 nt, synthetic construct
  misc_feature 1..57: note = derived and/or modified sequence opt11 from anti-HIV_CDR
  source 1..57: mol_type = other RNA
cgcgaggccgattaccatgacgggaacgggcacacgctcccgggcatgttcgatttc

SEQ ID NO: 59851 - RNA, 57 nt, synthetic construct
  misc_feature 1..57: note = derived and/or modified sequence opt11 from anti-HIV_CDR
  source 1..57: mol_type = other RNA
aacgagccccagtactacgacggaagcggacactcactcccgggcatgttcgactac

SEQ ID NO: 59852 - RNA, 57 nt, synthetic construct
  misc_feature 1..57: note = derived and/or modified sequence opt11 from anti-HIV_CDR
  source 1..57: mol_type = other RNA
aacgaaccccaataccacgacggcaacggccactcactccccggcatgttcgactac

SEQ ID NO: 59853 - RNA, 57 nt, synthetic construct
  misc_feature 1..57: note = derived and/or modified sequence opt11 from anti-HIV_CDR
  source 1..57: mol_type = other RNA
caagatagcgatttccatgacgggcacgggcacacgctcaggggcatgttcgatagc

SEQ ID NO: 59854 - RNA, 57 nt, synthetic construct
  misc_feature 1..57: note = derived and/or modified sequence opt11 from anti-HIV_CDR
  source 1..57: mol_type = other RNA
ctcgattgggtgcgcggggtcatgaacttggtcgagaaccattacgcgatggatgtc

SEQ ID NO: 59855 - RNA, 57 nt, synthetic construct
  misc_feature 1..57: note = derived and/or modified sequence opt11 from anti-HIV_CDR
  source 1..57: mol_type = other RNA
acgaacgggacggagatatttaggccgggggggggggatatgagggacaattggagg

SEQ ID NO: 59856 - RNA, 57 nt, synthetic construct
  misc_feature 1..57: note = derived and/or modified sequence opt11 from anti-HIV_CDR
  source 1..57: mol_type = other RNA
gacggccgctactccggcgacgaccaatactactaccactactactacatggacgtc

SEQ ID NO: 59857 - RNA, 57 nt, synthetic construct
  misc_feature 1..57: note = derived and/or modified sequence opt11 from anti-HIV_CDR
  source 1..57: mol_type = other RNA
ctcacgaaaaacccctcacaagacttctggggctcgtacctgtactacttcgaggac

SEQ ID NO: 59858 - RNA, 57 nt, synthetic construct
  misc_feature 1..57: note = derived and/or modified sequence opt11 from anti-HIV_CDR
  source 1..57: mol_type = other RNA
ggcgcgacctattactatgactcgagcgggcaccagagcaggcgcgcgttcgatatc

SEQ ID NO: 59859 - RNA, 57 nt, synthetic construct
  misc_feature 1..57: note = derived and/or modified sequence opt11 from anti-HIV_CDR
  source 1..57: mol_type = other RNA
gcgttccaggcctcgatggtgcgcggggtcatagtcgatccctatggcatggacgtg

SEQ ID NO: 59860 - RNA, 57 nt, synthetic construct
  misc_feature 1..57: note = derived and/or modified sequence opt11 from anti-HIV_CDR
  source 1..57: mol_type = other RNA
caccgagccgactacgacttctggaacggctccaacctccgcggctacttcgacccc

SEQ ID NO: 59861 - RNA, 57 nt, synthetic construct
  misc_feature 1..57: note = derived and/or modified sequence opt11 from anti-HIV_CDR
  source 1..57: mol_type = other RNA
caccgcgccaactacgacttctggggcggctcaaacctccgcggctacttcgaccca

SEQ ID NO: 59862 - RNA, 57 nt, synthetic construct
  misc_feature 1..57: note = derived and/or modified sequence opt11 from anti-HIV_CDR
  source 1..57: mol_type = other RNA
ggctttcacttttggtcgggcacgggcacgcgcccgcgcaattggtatttcgatctc

SEQ ID NO: 59863 - RNA, 57 nt, synthetic construct
  misc_feature 1..57: note = derived and/or modified sequence opt11 from anti-HIV_CDR
  source 1..57: mol_type = other RNA
aactacctcatcgaatcccgctacgacgaaaaagactactactacgccatggacgtc

SEQ ID NO: 59864 - RNA, 57 nt, synthetic construct
  misc_feature 1..57: note = derived and/or modified sequence opt11 from anti-HIV_CDR
  source 1..57: mol_type = other RNA
tcacgcggctacgcctacgactccggcggccactacttccccacatggttcgaccca

SEQ ID NO: 59865 - RNA, 57 nt, synthetic construct
  misc_feature 1..57: note = derived and/or modified sequence opt11 from anti-HIV_CDR
  source 1..57: mol_type = other RNA
gacacgacaacgttcggggcctttggcgggagcccgaacatgggcgggctagatcca

SEQ ID NO: 59866 - RNA, 57 nt, synthetic construct
  misc_feature 1..57: note = derived and/or modified sequence opt11 from anti-HIV_CDR
  source 1..57: mol_type = other RNA
catctcgtggtcgcggtcgcggccgggcccgattactttagctatggcatggacgtg

SEQ ID NO: 59867 - RNA, 57 nt, synthetic construct; identical to SEQ ID NO: 21657
  misc_feature 1..57: note = derived and/or modified sequence opt11 from anti-HIV_CDR
  source 1..57: mol_type = other RNA

SEQ ID NO: 59868 - RNA, 57 nt, synthetic construct
  misc_feature 1..57: note = derived and/or modified sequence opt11 from anti-HIV_CDR
  source 1..57: mol_type = other RNA
gacacgacaacgttcggggcatttggagggggagcgaacatgggcgggctagatcca

SEQ ID NO: 59869 - RNA, 57 nt, synthetic construct
  misc_feature 1..57: note = derived and/or modified sequence opt11 from anti-HIV_CDR
  source 1..57: mol_type = other RNA
gacacaaccacattcacctccttcggctcacccccccgcatgggcggcctcgacccc

SEQ ID NO: 59870 - RNA, 57 nt, synthetic construct; identical to SEQ ID NO: 21660
  misc_feature 1..57: note = derived and/or modified sequence opt11 from anti-HIV_CDR
  source 1..57: mol_type = other RNA

SEQ ID NO: 59871 - RNA, 57 nt, synthetic construct
  misc_feature 1..57: note = derived and/or modified sequence opt11 from anti-HIV_CDR
  source 1..57: mol_type = other RNA
gatcgagtgagcgattacgatttctggagcgggaaaaggggctatggcatggacgtg

SEQ ID NO: 59872 - RNA, 57 nt, synthetic construct
  misc_feature 1..57: note = derived and/or modified sequence opt11 from anti-HIV_CDR
  source 1..57: mol_type = other RNA
gagctctcgggcgagtaccatttctggagcgggacctatcgctatggcgtggacgtg

SEQ ID NO: 59873 - RNA, 57 nt, synthetic construct
  misc_feature 1..57: note = derived and/or modified sequence opt11 from anti-HIV_CDR
  source 1..57: mol_type = other RNA
cacggcgcctccgaaaactacggccccggctcctactccgccgaacacttccaacac

SEQ ID NO: 59874 - RNA, 57 nt, synthetic construct
  misc_feature 1..57: note = derived and/or modified sequence opt11 from anti-HIV_CDR
  source 1..57: mol_type = other RNA
cacggcgcctccgccaactacggccccggctcctactccgccgaacacttccaacac

SEQ ID NO: 59875 - RNA, 60 nt, synthetic construct
  misc_feature 1..60: note = derived and/or modified sequence opt11 from anti-HIV_CDR
  source 1..60: mol_type = other RNA
cacgaagccccccgctactcctacgccttccgccgctactaccactacggcctcgacgtc

SEQ ID NO: 59876 - RNA, 60 nt, synthetic construct
  misc_feature 1..60: note = derived and/or modified sequence opt11 from anti-HIV_CDR
  source 1..60: mol_type = other RNA
acctccacctacgaccaatggtccggcctccaccacgacggcgtcatggccttctcctcc

SEQ ID NO: 59877 - RNA, 60 nt, synthetic construct
  misc_feature 1..60: note = derived and/or modified sequence opt11 from anti-HIV_CDR
  source 1..60: mol_type = other RNA
ggggaatttgactcgagcgggttcgattacgagagctggtacccgtactatatggatgtc

SEQ ID NO: 59878 - RNA, 60 nt, synthetic construct
  misc_feature 1..60: note = derived and/or modified sequence opt11 from anti-HIV_CDR
  source 1..60: mol_type = other RNA
ggccaaaccgacctcaacgacgacttctggtccgaatactccacccccggcttcgactac

SEQ ID NO: 59879 - RNA, 60 nt, synthetic construct
  misc_feature 1..60: note = derived and/or modified sequence opt11 from anti-HIV_CDR
  source 1..60: mol_type = other RNA
ggccaaaccgacctcaacgacgacctctggtccgactactcaacccccggcttcgactac

SEQ ID NO: 59880 - RNA, 60 nt, synthetic construct
  misc_feature 1..60: note = derived and/or modified sequence opt11 from anti-HIV_CDR
  source 1..60: mol_type = other RNA
aacctcatcgaagaatcccaaacccaacaagaaatcaacgaacgcgacctcctcgccctc

SEQ ID NO: 59881 - RNA, 60 nt, synthetic construct
  misc_feature 1..60: note = derived and/or modified sequence opt11 from anti-HIV_CDR
  source 1..60: mol_type = other RNA
aacctgatcgaggaatcgcaaatacaacaggaaaagaacgagaaagagctcctggaactg

SEQ ID NO: 59882 - RNA, 60 nt, synthetic construct
  misc_feature 1..60: note = derived and/or modified sequence opt11 from anti-HIV_CDR
  source 1..60: mol_type = other RNA
agcctgatcgaaaactcacaaatacaacaggaaaaaaacgaacaagacctcctgcaactg

SEQ ID NO: 59883 - RNA, 60 nt, synthetic construct
  misc_feature 1..60: note = derived and/or modified sequence opt11 from anti-HIV_CDR
  source 1..60: mol_type = other RNA
agcctgatcgaggaatcgcaaatacaacaggaaaagaacgagaaagagctcctggaactg

SEQ ID NO: 59884 - RNA, 60 nt, synthetic construct
  misc_feature 1..60: note = derived and/or modified sequence opt11 from anti-HIV_CDR
  source 1..60: mol_type = other RNA
cgcctgatcgaggaatcgcaaacgcaacaggaaaagaacgagcaagagctcttggaattg

SEQ ID NO: 59885 - RNA, 60 nt, synthetic construct
  misc_feature 1..60: note = derived and/or modified sequence opt11 from anti-HIV_CDR
  source 1..60: mol_type = other RNA
agcctgatcgaggaatcgcaaacgcaacaggaaaagaacgagaaagagctcttggaattg

SEQ ID NO: 59886 - RNA, 60 nt, synthetic construct
  misc_feature 1..60: note = derived and/or modified sequence opt11 from anti-HIV_CDR
  source 1..60: mol_type = other RNA
aacctgctcgaagaatcacaaaaccaacaggagaaaaacgaacaagaactcctggaactg

SEQ ID NO: 59887 - RNA, 60 nt, synthetic construct
  misc_feature 1..60: note = derived and/or modified sequence opt11 from anti-HIV_CDR
  source 1..60: mol_type = other RNA
acactcatagaagaaagccagaaccagcaagagaaaaacgaactggaactgctcgaactc

SEQ ID NO: 59888 - RNA, 60 nt, synthetic construct
  misc_feature 1..60: note = derived and/or modified sequence opt11 from anti-HIV_CDR
  source 1..60: mol_type = other RNA
accctccaagaagaaagccaaaaccaacaagaaaaaaacgaacaagaactcctcgaactc

SEQ ID NO: 59889 - RNA, 60 nt, synthetic construct
  misc_feature 1..60: note = derived and/or modified sequence opt11 from anti-HIV_CDR
  source 1..60: mol_type = other RNA
agcctgctcgaagaatcacaaaaccaacaggagaaaaacgaacaagaactcctggaactg

SEQ ID NO: 59890 - RNA, 60 nt, synthetic construct
  misc_feature 1..60: note = derived and/or modified sequence opt11 from anti-HIV_CDR
  source 1..60: mol_type = other RNA
accctcatcgaagaatcccaaaaccaacaagaaaaaaaccaacaagaactcctccaactc

SEQ ID NO: 59891 - RNA, 60 nt, synthetic construct
  misc_feature 1..60: note = derived and/or modified sequence opt11 from anti-HIV_CDR
  source 1..60: mol_type = other RNA
accctcatcgaagaatcccaaaaccaacaagaaaaaaacgaacaagaactcctcggcctc

SEQ ID NO: 59892 - RNA, 60 nt, synthetic construct
  misc_feature 1..60: note = derived and/or modified sequence opt11 from anti-HIV_CDR
  source 1..60: mol_type = other RNA
accctcatcgaagaatcccaaaaccaacaagaaaaaaacgaacaagaactcctcgaactc

SEQ ID NO: 59893 - RNA, 60 nt, synthetic construct
  misc_feature 1..60: note = derived and/or modified sequence opt11 from anti-HIV_CDR
  source 1..60: mol_type = other RNA
agcctgatcgaggactcgcaaatacaacaggaaaagaacgagaaagagctcctggaactg

SEQ ID NO: 59894 - RNA, 60 nt, synthetic construct
  misc_feature 1..60: note = derived and/or modified sequence opt11 from anti-HIV_CDR
  source 1..60: mol_type = other RNA
tccctcctcgaaaaatcccaaacccaacaagaaaaaaacgaacaagaactcctcgaactc

SEQ ID NO: 59895 - RNA, 60 nt, synthetic construct
  misc_feature 1..60: note = derived and/or modified sequence opt11 from anti-HIV_CDR
  source 1..60: mol_type = other RNA
agcctgatcgaagaatcacaaaaccaacaggagaaaaacgaacaagaactcctggaactg

SEQ ID NO: 59896 - RNA, 60 nt, synthetic construct
  misc_feature 1..60: note = derived and/or modified sequence opt11 from anti-HIV_CDR
  source 1..60: mol_type = other RNA
ggcgatctcttgggctataccgacagctggtacgagttcgattactattacatggacgtg

SEQ ID NO: 59897 - RNA, 60 nt, synthetic construct
  misc_feature 1..60: note = derived and/or modified sequence opt11 from anti-HIV_CDR
  source 1..60: mol_type = other RNA
gacacgaatgggacggagatatttaggccgggggggggggatatgagggataattggagg

SEQ ID NO: 59898 - RNA, 60 nt, synthetic construct
  misc_feature 1..60: note = derived and/or modified sequence opt11 from anti-HIV_CDR
  source 1..60: mol_type = other RNA
gatgtggtggagaggccggggtttggggattttaggtatgattattatgggatggatgtg

SEQ ID NO: 59899 - RNA, 60 nt, synthetic construct
  misc_feature 1..60: note = derived and/or modified sequence opt11 from anti-HIV_CDR
  source 1..60: mol_type = other RNA
gatcaaagggactgcagcacgaacaggtgcttcggcgtgttcgggtactatatggacgta

SEQ ID NO: 59900 - RNA, 60 nt, synthetic construct
  misc_feature 1..60: note = derived and/or modified sequence opt11 from anti-HIV_CDR
  source 1..60: mol_type = other RNA
gaccgctgggtcaggccccagttcccgagcatggactttcaatataacgggctcgacgtc

SEQ ID NO: 59901 - RNA, 60 nt, synthetic construct
  misc_feature 1..60: note = derived and/or modified sequence opt11 from anti-HIV_CDR
  source 1..60: mol_type = other RNA
gactccggcttcgacctcgactactacgacacaaacgaactctacttcggcttcgactac

SEQ ID NO: 59902 - RNA, 60 nt, synthetic construct
  misc_feature 1..60: note = derived and/or modified sequence opt11 from anti-HIV_CDR
  source 1..60: mol_type = other RNA
aaataccccgcctactacgacatcctcaccgccaactaccgctcctactacttcgactac

SEQ ID NO: 59903 - RNA, 60 nt, synthetic construct
  misc_feature 1..60: note = derived and/or modified sequence opt11 from anti-HIV_CDR
  source 1..60: mol_type = other RNA
aaataccccgcctactacgacatcctcaccggctactaccgcaactactacttcgactac

SEQ ID NO: 59904 - RNA, 60 nt, synthetic construct
  misc_feature 1..60: note = derived and/or modified sequence opt11 from anti-HIV_CDR
  source 1..60: mol_type = other RNA
cgcgtaaaattccccctctggttcggcgaaaccacatactactactacggcatggacgtc

SEQ ID NO: 59905 - RNA, 60 nt, synthetic construct
  misc_feature 1..60: note = derived and/or modified sequence opt11 from anti-HIV_CDR
  source 1..60: mol_type = other RNA
gagcgctcgaccaagtactcgttctggagcgcggtcatgcgcccggacgcgttcgatctc

SEQ ID NO: 59906 - RNA, 60 nt, synthetic construct
  misc_feature 1..60: note = derived and/or modified sequence opt11 from anti-HIV_CDR
  source 1..60: mol_type = other RNA
cacgaagccccccgctactcctacgccttccgcaactactaccactacggcctcgacgtc

SEQ ID NO: 59907 - RNA, 60 nt, synthetic construct
  misc_feature 1..60: note = derived and/or modified sequence opt11 from anti-HIV_CDR
  source 1..60: mol_type = other RNA
gaaaacgtcctcatggaatccgacgactacaacgactactactactactacatggacgtc

SEQ ID NO: 59908 - RNA, 60 nt, synthetic construct
  misc_feature 1..60: note = derived and/or modified sequence opt11 from anti-HIV_CDR
  source 1..60: mol_type = other RNA
gagcgcgtgctcgtgttcccggaccaggacgcggactattactattactttttcgatgtc

SEQ ID NO: 59909 - RNA, 60 nt, synthetic construct
  misc_feature 1..60: note = derived and/or modified sequence opt11 from anti-HIV_CDR
  source 1..60: mol_type = other RNA
gaacgcgtcctcgtcgtccccgaccaagacgccgactactactactacttcttcgacgtc

SEQ ID NO: 59910 - RNA, 63 nt, synthetic construct
  misc_feature 1..63: note = derived and/or modified sequence opt11 from anti-HIV_CDR
  source 1..63: mol_type = other RNA
gaccgctcctccgccatcggctactgctcctccatctcctgctacaaaggctccttcgacatc

SEQ ID NO: 59911 - RNA, 63 nt, synthetic construct
  misc_feature 1..63: note = derived and/or modified sequence opt11 from anti-HIV_CDR
  source 1..63: mol_type = other RNA
gtcgtgaaaatagaaccgctcggggtcgcgcccacgaaagcgaaaagggtcgcgcgcgagaaa

SEQ ID NO: 59912 - RNA, 63 nt, synthetic construct
  misc_feature 1..63: note = derived and/or modified sequence opt11 from anti-HIV_CDR
  source 1..63: mol_type = other RNA
gtggtgaggatagagccgttgggggtggcgccgacgaaggcgaagagggtggagagggagaag

SEQ ID NO: 59913 - RNA, 63 nt, synthetic construct
  misc_feature 1..63: note = derived and/or modified sequence opt11 from anti-HIV_CDR
  source 1..63: mol_type = other RNA
gtcgtgcgcatagaaccgctcgggatcgcgcccacgcgcgcgaaaagggtcgagcgcgagaaa

SEQ ID NO: 59914 - RNA, 63 nt, synthetic construct
  misc_feature 1..63: note = derived and/or modified sequence opt11 from anti-HIV_CDR
  source 1..63: mol_type = other RNA
gtggtgaagatagagccgataggggtggcgccgacgaaggcgaggagggtggagagggagaag

SEQ ID NO: 59915 - RNA, 63 nt, synthetic construct
  misc_feature 1..63: note = derived and/or modified sequence opt11 from anti-HIV_CDR
  source 1..63: mol_type = other RNA
gtcgtgaaaatagaaccgctcggggtcgcgcccacgcgcgcgaaaagggtcgagcgcgagaaa

SEQ ID NO: 59916 - RNA, 63 nt, synthetic construct
  misc_feature 1..63: note = derived and/or modified sequence opt11 from anti-HIV_CDR
  source 1..63: mol_type = other RNA
gtcgtgcaaatagaaccgctcggggtcgcgcccacgcgcgcgaaaagggtcgagcgcgagaaa

SEQ ID NO: 59917 - RNA, 63 nt, synthetic construct
  misc_feature 1..63: note = derived and/or modified sequence opt11 from anti-HIV_CDR
  source 1..63: mol_type = other RNA
gtggtgaggatagagccgttgggggtggcgccgacgaaggcgaagagggtgcagagggagaag

SEQ ID NO: 59918 - RNA, 63 nt, synthetic construct
  misc_feature 1..63: note = derived and/or modified sequence opt11 from anti-HIV_CDR
  source 1..63: mol_type = other RNA
gtcgtcaaaatcgaacccctcggcgtcgcccccaccaaagccaaacgcgtccaacgcaaaaaa

SEQ ID NO: 59919 - RNA, 63 nt, synthetic construct
  misc_feature 1..63: note = derived and/or modified sequence opt11 from anti-HIV_CDR
  source 1..63: mol_type = other RNA
gtcatcaaaatcgaacccctcatcgtcgcccccaccaaagccaaacgcgtccaacgcgaaaaa

SEQ ID NO: 59920 - RNA, 63 nt, synthetic construct
  misc_feature 1..63: note = derived and/or modified sequence opt11 from anti-HIV_CDR
  source 1..63: mol_type = other RNA
gtcgtgaaaatagaaccgctcggggtcgcgcccacgaaagcgcgcagggtccagcgcgagaaa

SEQ ID NO: 59921 - RNA, 63 nt, synthetic construct
  misc_feature 1..63: note = derived and/or modified sequence opt11 from anti-HIV_CDR
  source 1..63: mol_type = other RNA
gtggtgaagatagagttgttgggggtggcgccgacgaaggcgaagagggtgcagagggagaag

SEQ ID NO: 59922 - RNA, 63 nt, synthetic construct
  misc_feature 1..63: note = derived and/or modified sequence opt11 from anti-HIV_CDR
  source 1..63: mol_type = other RNA
gtggtgacgatagagccgttgggggtggcgccgacgaaggcgaagagggtgcagagggagaag

SEQ ID NO: 59923 - RNA, 63 nt, synthetic construct
  misc_feature 1..63: note = derived and/or modified sequence opt11 from anti-HIV_CDR
  source 1..63: mol_type = other RNA
gtagtgaaaatagagccgctgggggtggcgccgacgaaggcgaaaagggtacagagagagaaa

SEQ ID NO: 59924 - RNA, 63 nt, synthetic construct
  misc_feature 1..63: note = derived and/or modified sequence opt11 from anti-HIV_CDR
  source 1..63: mol_type = other RNA
gacctcgtctccgtctccccaccctacggcaactacggccccgacaacaactggttcgacttc

SEQ ID NO: 59925 - RNA, 63 nt, synthetic construct
  misc_feature 1..63: note = derived and/or modified sequence opt11 from anti-HIV_CDR
  source 1..63: mol_type = other RNA
atgaacccaccctggttccgcggcggctccaacaacccctactcctactactacatggacgtc

SEQ ID NO: 59926 - RNA, 63 nt, synthetic construct
  misc_feature 1..63: note = derived and/or modified sequence opt11 from anti-HIV_CDR
  source 1..63: mol_type = other RNA
gactggatcgggtacgattacgatggctcgggctcgcacttgcgcgatgaatcgttcgatatc

SEQ ID NO: 59927 - RNA, 63 nt, synthetic construct
  misc_feature 1..63: note = derived and/or modified sequence opt11 from anti-HIV_CDR
  source 1..63: mol_type = other RNA
tgctcgatcgtgggcaatggcgatttcttggaagaggactcgcactatcccgcgatggatgtc

SEQ ID NO: 59928 - RNA, 63 nt, synthetic construct
  misc_feature 1..63: note = derived and/or modified sequence opt11 from anti-HIV_CDR
  source 1..63: mol_type = other RNA
gatttcgtgagcatatacggggtcgcgtactttaccgggggcgggccctcgagcccggacata

SEQ ID NO: 59929 - RNA, 66 nt, synthetic construct
  misc_feature 1..66: note = derived and/or modified sequence opt11 from anti-HIV_CDR
  source 1..66: mol_type = other RNA
aaagccaaagactactactacgaatcctccgactactccccctactactactactacatggacgtc

SEQ ID NO: 59930 - RNA, 66 nt, synthetic construct
  misc_feature 1..66: note = derived and/or modified sequence opt11 from anti-HIV_CDR
  source 1..66: mol_type = other RNA
gaccacggcatcaaacccgacaactactacgacatctccggctacaacctcgactacttcgactac

SEQ ID NO: 59931 - RNA, 66 nt, synthetic construct
  misc_feature 1..66: note = derived and/or modified sequence opt11 from anti-HIV_CDR
  source 1..66: mol_type = other RNA
ggctccctctacgactaccgcgacaacgccgacctcaaaccctcctactactacgccatggacgtc

SEQ ID NO: 59932 - RNA, 66 nt, synthetic construct
  misc_feature 1..66: note = derived and/or modified sequence opt11 from anti-HIV_CDR
  source 1..66: mol_type = other RNA
gatgaggcgagttgggtggaggcggcggatgagtgggatgagcatttgtttagggagatggcggtg

SEQ ID NO: 59933 - RNA, 66 nt, synthetic construct
  misc_feature 1..66: note = derived and/or modified sequence opt11 from anti-HIV_CDR
  source 1..66: mol_type = other RNA
gatgaggtgagttgggtggaggcggcggatgagtgggatgagcatttgtttagggagatggcggtg

SEQ ID NO: 59934 - RNA, 66 nt, synthetic construct
  misc_feature 1..66: note = derived and/or modified sequence opt11 from anti-HIV_CDR
  source 1..66: mol_type = other RNA
gatgaggggagttgggtggaggcggcggatgagtgggatgagcatttgtttagggagatggcggtg

SEQ ID NO: 59935 - RNA, 66 nt, synthetic construct
  misc_feature 1..66: note = derived and/or modified sequence opt11 from anti-HIV_CDR
  source 1..66: mol_type = other RNA
gatcaaaggggcaggtactcgttcgggttcgtgaccgggcaaacgaaagtgagcgcgatctcggac

SEQ ID NO: 59936 - RNA, 66 nt, synthetic construct
  misc_feature 1..66: note = derived and/or modified sequence opt11 from anti-HIV_CDR
  source 1..66: mol_type = other RNA
gatcaattgggcaggtactcgttcgggttcgtgaccgggcaaaataaagtgagcgcgatctcggac

SEQ ID NO: 59937 - RNA, 66 nt, synthetic construct
  misc_feature 1..66: note = derived and/or modified sequence opt11 from anti-HIV_CDR
  source 1..66: mol_type = other RNA
gatcaagtgggcaggtactcgttcgggttcgcgaccgggcaacagcgcgtgagcgcgatctcggac

SEQ ID NO: 59938 - RNA, 69 nt, synthetic construct
  misc_feature 1..69: note = derived and/or modified sequence opt11 from anti-HIV_CDR
  source 1..69: mol_type = other RNA
gtggtgaagatagagccgttgggggtggcgccgacgaaggcgaagaggagggtggtgcagagggagaag

SEQ ID NO: 59939 - RNA, 69 nt, synthetic construct; identical to SEQ ID NO: 21729
  misc_feature 1..69: note = derived and/or modified sequence opt11 from anti-HIV_CDR
  source 1..69: mol_type = other RNA

SEQ ID NO: 59940 - RNA, 69 nt, synthetic construct
  misc_feature 1..69: note = derived and/or modified sequence opt11 from anti-HIV_CDR
  source 1..69: mol_type = other RNA
gacaaacccgcctacgacgaatacgccgaagaaaccatcgccccccacaactaccacgccatggacctc

SEQ ID NO: 59941 - RNA, 69 nt, synthetic construct
  misc_feature 1..69: note = derived and/or modified sequence opt11 from anti-HIV_CDR
  source 1..69: mol_type = other RNA
caaaacatagccgcccgcgcagccgaaaaactatacgaaaacgactactacttctacggcatggacgta

SEQ ID NO: 59942 - RNA, 69 nt, synthetic construct
  misc_feature 1..69: note = derived and/or modified sequence opt11 from anti-HIV_CDR
  source 1..69: mol_type = other RNA
cagaacatagccgcacgcacggccgaacgcctgtacgaaaacgactactacttctacggcatggacgta

SEQ ID NO: 59943 - RNA, 72 nt, synthetic construct
  misc_feature 1..72: note = derived and/or modified sequence opt11 from anti-HIV_CDR
  source 1..72: mol_type = other RNA
gcgcaacagggcaagcgcatatacgggatcgtgagctttggcgagttcttttactattactatatggatgcc

SEQ ID NO: 59944 - RNA, 72 nt, synthetic construct
  misc_feature 1..72: note = derived and/or modified sequence opt11 from anti-HIV_CDR
  source 1..72: mol_type = other RNA
acccaacaaggcaaacgcatctacggcgtcgtctccttcggcgaattcttccactactactacatggacgcc

SEQ ID NO: 59945 - RNA, 72 nt, synthetic construct
  misc_feature 1..72: note = derived and/or modified sequence opt11 from anti-HIV_CDR
  source 1..72: mol_type = other RNA
gcgcgcaggggccagcgcatatacggggtcgtgagctttggcgagttcttttactattactcgatggatgtc

SEQ ID NO: 59946 - RNA, 72 nt, synthetic construct
  misc_feature 1..72: note = derived and/or modified sequence opt11 from anti-HIV_CDR
  source 1..72: mol_type = other RNA
accctccacggccgccgcatctacggcatcgtcgccttcaacgaatggttcacctacttctacatggacgtc

SEQ ID NO: 59947 - RNA, 72 nt, synthetic construct
  misc_feature 1..72: note = derived and/or modified sequence opt11 from anti-HIV_CDR
  source 1..72: mol_type = other RNA
accaaacacggccgccgcatctacggcatcgtcgccttcaacgaatggttcacctacttctacatggacgtc

SEQ ID NO: 59948 - RNA, 72 nt, synthetic construct
  misc_feature 1..72: note = derived and/or modified sequence opt11 from anti-HIV_CDR
  source 1..72: mol_type = other RNA
gcccgccacggccaacgcatctacggcgtcgtctccttcggcgaattcttcacctactactcaatggacgtc

SEQ ID NO: 59949 - RNA, 72 nt, synthetic construct
  misc_feature 1..72: note = derived and/or modified sequence opt11 from anti-HIV_CDR
  source 1..72: mol_type = other RNA
acgcaacagggcaagcgcatatacggggtcgtgagcttcggcgactactactactactactacatggacgtc

SEQ ID NO: 59950 - RNA, 72 nt, synthetic construct
  misc_feature 1..72: note = derived and/or modified sequence opt11 from anti-HIV_CDR
  source 1..72: mol_type = other RNA
accaagcacgggcgcaggatctatggcgtggtcgcgttcggggaatggttcacgtacttttacatggacgtg

SEQ ID NO: 59951 - RNA, 72 nt, synthetic construct
  misc_feature 1..72: note = derived and/or modified sequence opt11 from anti-HIV_CDR
  source 1..72: mol_type = other RNA
gccgtcatcaccgacctccacaccttcggcgactacgaactcgaagacccctcctactactacatggacgtc

SEQ ID NO: 59952 - RNA, 72 nt, synthetic construct
  misc_feature 1..72: note = derived and/or modified sequence opt11 from anti-HIV_CDR
  source 1..72: mol_type = other RNA
gacagaggagacacaagactgctggactacggagactacgaagacgaaagatactactacggaatggacgta

SEQ ID NO: 59953 - RNA, 72 nt, synthetic construct
  misc_feature 1..72: note = derived and/or modified sequence opt11 from anti-HIV_CDR
  source 1..72: mol_type = other RNA
ggcaccagatacgacttctggtccggcttctcaaacagagacggccgcgccctcgccggctacttcgactac

SEQ ID NO: 59954 - RNA, 72 nt, synthetic construct
  misc_feature 1..72: note = derived and/or modified sequence opt11 from anti-HIV_CDR
  source 1..72: mol_type = other RNA
gatggcaagggcaaggcctattacgacttctggagcgggtacaggaaccagaaatattacgggctcgatgtc

SEQ ID NO: 59955 - RNA, 72 nt, synthetic construct
  misc_feature 1..72: note = derived and/or modified sequence opt11 from anti-HIV_CDR
  source 1..72: mol_type = other RNA
gccgtcatcaccgacctccacaccttcgccgactacgaactcggcgacccctcctacttctacatggacgtc

SEQ ID NO: 59956 - RNA, 72 nt, synthetic construct
  misc_feature 1..72: note = derived and/or modified sequence opt11 from anti-HIV_CDR
  source 1..72: mol_type = other RNA
tccgtcatcaccgacctccacaccttcggcgactacgaatccggcgacccctcctactactacatggacgtc

SEQ ID NO: 59957 - RNA, 81 nt, synthetic construct
  misc_feature 1..81: note = derived and/or modified sequence opt11 from anti-HIV_CDR
  source 1..81: mol_type = other RNA
gacttcccccgcttccaccgcctcgtcggcaactacgacttctggcgcggcaccctagaccgcttctcctacatggaccta

SEQ ID NO: 59958 - RNA, 105 nt, synthetic construct
  misc_feature 1..105: note = derived and/or modified sequence opt11 from anti-HIV_CDR
  source 1..105: mol_type = other RNA
cgcatactcgcggtcgagcgctatctcaaggaccagcaattgctcgggatctggggctgtagcgggaaaataatctgtcccacgatggtgccctggaactcgagc

SEQ ID NO: 59959 - RNA, 105 nt, synthetic construct
  misc_feature 1..105: note = derived and/or modified sequence opt11 from anti-HIV_CDR
  source 1..105: mol_type = other RNA
cgcgtcctcgccgtcgaacgctacctccaagaccaacgcctcctcggcatgtggggctgctccggcaaacacatctgcaccaccttcgtcccctggaactcctcc

SEQ ID NO: 59960 - RNA, 105 nt, synthetic construct
  misc_feature 1..105: note = derived and/or modified sequence opt11 from anti-HIV_CDR
  source 1..105: mol_type = other RNA
cgcgtgctcgcggtcgagagctatctcaaggaccagcaattgctcgggatctggggctgtagcgggaaacatatctgtaccacgaccgtgccctggaactcgagc

SEQ ID NO: 59961 - RNA, 105 nt, synthetic construct
  misc_feature 1..105: note = derived and/or modified sequence opt11 from anti-HIV_CDR
  source 1..105: mol_type = other RNA
cgcgtcctcgccgtcgaacgctacctccgcgaccaacaactcctcggcatctggggctgctccggccgccacatctgcaccaccaacgtcccctggaactcctcc

SEQ ID NO: 59962 - RNA, 105 nt, synthetic construct
  misc_feature 1..105: note = derived and/or modified sequence opt11 from anti-HIV_CDR
  source 1..105: mol_type = other RNA
cgcatactcgcggtcgagcgctatctcaaggaccagcaattgctcgggatctggggctgtagcgggaaattgatctgtaccacgaccgtgccctggaactcgagc

SEQ ID NO: 59963 - RNA, 105 nt, synthetic construct
  misc_feature 1..105: note = derived and/or modified sequence opt11 from anti-HIV_CDR
  source 1..105: mol_type = other RNA
cgcatactcgcggtcgagcgctatctcaaggaccagcaattgctcgggatctggggctgtagcgggaaacatatctgtaccacgaacgtgccctggaactcgagc

SEQ ID NO: 59964 - RNA, 105 nt, synthetic construct
  misc_feature 1..105: note = derived and/or modified sequence opt11 from anti-HIV_CDR
  source 1..105: mol_type = other RNA
cgcgtcctagccgtcgaacgctacctccgcgaccaacaactcctcggcatctggggctgctccggcaaactcatctgcaccaccaccgtcccctggaacgcctcc

SEQ ID NO: 59965 - RNA, 105 nt, synthetic construct
  misc_feature 1..105: note = derived and/or modified sequence opt11 from anti-HIV_CDR
  source 1..105: mol_type = other RNA
agggtcttggccgtggaaaggtacttgcgcgatcaacagctcttgggcatatgggggtgctcgggcaagctcatatgcacgaccgcggtcccgtggaatgcctcg

SEQ ID NO: 59966 - RNA, 105 nt, synthetic construct
  misc_feature 1..105: note = derived and/or modified sequence opt11 from anti-HIV_CDR
  source 1..105: mol_type = other RNA
cgcgtgctcgcggtcgagcgctatctcaaggaccagcaattgctcgggatctggggctgtagcgggaaattgatctgtaccacgaccgtgccctggaacgcgagc

SEQ ID NO: 59967 - RNA, 105 nt, synthetic construct
  misc_feature 1..105: note = derived and/or modified sequence opt11 from anti-HIV_CDR
  source 1..105: mol_type = other RNA
cgcatactcgcggtcgagcgctatctcaaggaccagcaattgctcgggttctggggctgtagcgggaaattgatctgtaccacggccgtgccctggaacgcgagc

SEQ ID NO: 59968 - RNA, 105 nt, synthetic construct
  misc_feature 1..105: note = derived and/or modified sequence opt11 from anti-HIV_CDR
  source 1..105: mol_type = other RNA
cgcgtcctcgccgtcgaacgctacctccgcgaccaacaactcctcggcatctggggctgctccggcaaactcatctgcaccaccaccgtcccctggaacacctcc

SEQ ID NO: 59969 - RNA, 105 nt, synthetic construct
  misc_feature 1..105: note = derived and/or modified sequence opt11 from anti-HIV_CDR
  source 1..105: mol_type = other RNA
cgcgtgctcgcggtcgagcgctatctcaaggaccagcaattgctcgggatctggggctgtagcgggaaattgatctgtaccacggccgtgccctggaacgcgagc

SEQ ID NO: 59970 - RNA, 105 nt, synthetic construct
  misc_feature 1..105: note = derived and/or modified sequence opt11 from anti-HIV_CDR
  source 1..105: mol_type = other RNA
cgcgtgctcgcggtcgagcgctatctcaaggaccagcaattgctcgggttctggggctgtagcgggaaattgatctgtaccacgaccgtgccctggaacgcgagc

SEQ ID NO: 59971 - RNA, 105 nt, synthetic construct
  misc_feature 1..105: note = derived and/or modified sequence opt11 from anti-HIV_CDR
  source 1..105: mol_type = other RNA
cgcatactcgcggtcgagcgctatctcaaggaccagcaattgctcgggatctggggctgtagcgggaaattgatctgtaccacggccgtgccctggaacgcgagc

SEQ ID NO: 59972-59997 - skipped (26 entries)

SEQ ID NO: 59998 - RNA, 12 nt, synthetic construct
  misc_feature 1..12: note = derived and/or modified sequence opt11 from anti-influenza_CDR
  source 1..12: mol_type = other RNA
gacgtgccagat

SEQ ID NO: 59999 - RNA, 12 nt, synthetic construct
  misc_feature 1..12: note = derived and/or modified sequence opt11 from anti-influenza_CDR
  source 1..12: mol_type = other RNA
agattgagcggg

SEQ ID NO: 60000 - RNA, 12 nt, synthetic construct
  misc_feature 1..12: note = derived and/or modified sequence opt11 from anti-influenza_CDR
  source 1..12: mol_type = other RNA
ttctgggacctg

SEQ ID NO: 60001 - RNA, 15 nt, synthetic construct
  misc_feature 1..15: note = derived and/or modified sequence opt11 from anti-influenza_CDR
  source 1..15: mol_type = other RNA
acaggcctaagaaac

SEQ ID NO: 60002 - RNA, 15 nt, synthetic construct
  misc_feature 1..15: note = derived and/or modified sequence opt11 from anti-influenza_CDR
  source 1..15: mol_type = other RNA
caacaatcccgcacc

SEQ ID NO: 60003 - RNA, 15 nt, synthetic construct
  misc_feature 1..15: note = derived and/or modified sequence opt11 from anti-influenza_CDR
  source 1..15: mol_type = other RNA
caactctcccgcacc

SEQ ID NO: 60004 - RNA, 15 nt, synthetic construct
  misc_feature 1..15: note = derived and/or modified sequence opt11 from anti-influenza_CDR
  source 1..15: mol_type = other RNA
tccaactacatcacc

SEQ ID NO: 60005 - RNA, 15 nt, synthetic construct
  misc_feature 1..15: note = derived and/or modified sequence opt11 from anti-influenza_CDR
  source 1..15: mol_type = other RNA
gactacagctggaac

SEQ ID NO: 60006 - RNA, 15 nt, synthetic construct
  misc_feature 1..15: note = derived and/or modified sequence opt11 from anti-influenza_CDR
  source 1..15: mol_type = other RNA
aactacgccttctca

SEQ ID NO: 60007 - RNA, 15 nt, synthetic construct
  misc_feature 1..15: note = derived and/or modified sequence opt11 from anti-influenza_CDR
  source 1..15: mol_type = other RNA
aagaacgcgatctcg

SEQ ID NO: 60008 - RNA, 15 nt, synthetic construct
  misc_feature 1..15: note = derived and/or modified sequence opt11 from anti-influenza_CDR
  source 1..15: mol_type = other RNA
tcgcactggatgacg

SEQ ID NO: 60009 - RNA, 15 nt, synthetic construct
  misc_feature 1..15: note = derived and/or modified sequence opt11 from anti-influenza_CDR
  source 1..15: mol_type = other RNA
aactacgacatcaac

SEQ ID NO: 60010 - RNA, 15 nt, synthetic construct
  misc_feature 1..15: note = derived and/or modified sequence opt11 from anti-influenza_CDR
  source 1..15: mol_type = other RNA
gattatggggtgacg

SEQ ID NO: 60011 - RNA, 15 nt, synthetic construct
  misc_feature 1..15: note = derived and/or modified sequence opt11 from anti-influenza_CDR
  source 1..15: mol_type = other RNA
aactacggcatcaac

SEQ ID NO: 60012 - RNA, 15 nt, synthetic construct
  misc_feature 1..15: note = derived and/or modified sequence opt11 from anti-influenza_CDR
  source 1..15: mol_type = other RNA
gggtacacgatcacg

SEQ ID NO: 60013 - RNA, 15 nt, synthetic construct
  misc_feature 1..15: note = derived and/or modified sequence opt11 from anti-influenza_CDR
  source 1..15: mol_type = other RNA
aactacggcatcagc

SEQ ID NO: 60014 - RNA, 15 nt, synthetic construct
  misc_feature 1..15: note = derived and/or modified sequence opt11 from anti-influenza_CDR
  source 1..15: mol_type = other RNA
gacgactactggaca

SEQ ID NO: 60015 - RNA, 15 nt, synthetic construct
  misc_feature 1..15: note = derived and/or modified sequence opt11 from anti-influenza_CDR
  source 1..15: mol_type = other RNA
acctacgccatgcac

SEQ ID NO: 60016 - RNA, 15 nt, synthetic construct
  misc_feature 1..15: note = derived and/or modified sequence opt11 from anti-influenza_CDR
  source 1..15: mol_type = other RNA
tcctacgccatgcac

SEQ ID NO: 60017 - RNA, 15 nt, synthetic construct
  misc_feature 1..15: note = derived and/or modified sequence opt11 from anti-influenza_CDR
  source 1..15: mol_type = other RNA
agctattactggaac

SEQ ID NO: 60018 - RNA, 15 nt, synthetic construct
  misc_feature 1..15: note = derived and/or modified sequence opt11 from anti-influenza_CDR
  source 1..15: mol_type = other RNA
acgtatccggtcgcg

SEQ ID NO: 60019 - RNA, 15 nt, synthetic construct
  misc_feature 1..15: note = derived and/or modified sequence opt11 from anti-influenza_CDR
  source 1..15: mol_type = other RNA
cactacttctggtcc

SEQ ID NO: 60020 - RNA, 15 nt, synthetic construct
  misc_feature 1..15: note = derived and/or modified sequence opt11 from anti-influenza_CDR
  source 1..15: mol_type = other RNA
gactactactggaca

SEQ ID NO: 60021 - RNA, 15 nt, synthetic construct
  misc_feature 1..15: note = derived and/or modified sequence opt11 from anti-influenza_CDR
  source 1..15: mol_type = other RNA
gactactactggtca

SEQ ID NO: 60022 - RNA, 15 nt, synthetic construct
  misc_feature 1..15: note = derived and/or modified sequence opt11 from anti-influenza_CDR
  source 1..15: mol_type = other RNA
ggctactacatgcac

SEQ ID NO: 60023 - RNA, 15 nt, synthetic construct
  misc_feature 1..15: note = derived and/or modified sequence opt11 from anti-influenza_CDR
  source 1..15: mol_type = other RNA
tcccactactggtcc

SEQ ID NO: 60024 - RNA, 15 nt, synthetic construct
  misc_feature 1..15: note = derived and/or modified sequence opt11 from anti-influenza_CDR
  source 1..15: mol_type = other RNA
aattactggatcggg

SEQ ID NO: 60025 - RNA, 15 nt, synthetic construct
  misc_feature 1..15: note = derived and/or modified sequence opt11 from anti-influenza_CDR
  source 1..15: mol_type = other RNA
aactacgccatcata

SEQ ID NO: 60026 - RNA, 15 nt, synthetic construct
  misc_feature 1..15: note = derived and/or modified sequence opt11 from anti-influenza_CDR
  source 1..15: mol_type = other RNA
gactactacatccat

SEQ ID NO: 60027 - RNA, 15 nt, synthetic construct
  misc_feature 1..15: note = derived and/or modified sequence opt11 from anti-influenza_CDR
  source 1..15: mol_type = other RNA
ggctacgacatgcat

SEQ ID NO: 60028 - RNA, 15 nt, synthetic construct
  misc_feature 1..15: note = derived and/or modified sequence opt11 from anti-influenza_CDR
  source 1..15: mol_type = other RNA
ggctactacatccac

SEQ ID NO: 60029 - RNA, 15 nt, synthetic construct
  misc_feature 1..15: note = derived and/or modified sequence opt11 from anti-influenza_CDR
  source 1..15: mol_type = other RNA
ggctattacgtgcac

SEQ ID NO: 60030 - RNA, 15 nt, synthetic construct
  misc_feature 1..15: note = derived and/or modified sequence opt11 from anti-influenza_CDR
  source 1..15: mol_type = other RNA
aactactggatgagc

SEQ ID NO: 60031 - RNA, 15 nt, synthetic construct
  misc_feature 1..15: note = derived and/or modified sequence opt11 from anti-influenza_CDR
  source 1..15: mol_type = other RNA
ggcgagagcacgcta

SEQ ID NO: 60032 - RNA, 15 nt, synthetic construct
  misc_feature 1..15: note = derived and/or modified sequence opt11 from anti-influenza_CDR
  source 1..15: mol_type = other RNA
aactactactggtcc

SEQ ID NO: 60033 - RNA, 15 nt, synthetic construct
  misc_feature 1..15: note = derived and/or modified sequence opt11 from anti-influenza_CDR
  source 1..15: mol_type = other RNA
tccaactacatgtcc

SEQ ID NO: 60034 - RNA, 15 nt, synthetic construct
  misc_feature 1..15: note = derived and/or modified sequence opt11 from anti-influenza_CDR
  source 1..15: mol_type = other RNA
agcgattactggagc

SEQ ID NO: 60035 - RNA, 15 nt, synthetic construct
  misc_feature 1..15: note = derived and/or modified sequence opt11 from anti-influenza_CDR
  source 1..15: mol_type = other RNA
agctataactggatc

SEQ ID NO: 60036 - RNA, 15 nt, synthetic construct
  misc_feature 1..15: note = derived and/or modified sequence opt11 from anti-influenza_CDR
  source 1..15: mol_type = other RNA
agcacgtacatgaac

SEQ ID NO: 60037 - RNA, 15 nt, synthetic construct
  misc_feature 1..15: note = derived and/or modified sequence opt11 from anti-influenza_CDR
  source 1..15: mol_type = other RNA
aactacgccatgtcc

SEQ ID NO: 60038 - RNA, 15 nt, synthetic construct
  misc_feature 1..15: note = derived and/or modified sequence opt11 from anti-influenza_CDR
  source 1..15: mol_type = other RNA
agcgatttctggagc

SEQ ID NO: 60039 - RNA, 15 nt, synthetic construct
  misc_feature 1..15: note = derived and/or modified sequence opt11 from anti-influenza_CDR
  source 1..15: mol_type = other RNA
tactacgccatgtcc

SEQ ID NO: 60040 - RNA, 15 nt, synthetic construct
  misc_feature 1..15: note = derived and/or modified sequence opt11 from anti-influenza_CDR
  source 1..15: mol_type = other RNA
ggctattacgtgtac

SEQ ID NO: 60041 - RNA, 15 nt, synthetic construct
  misc_feature 1..15: note = derived and/or modified sequence opt11 from anti-influenza_CDR
  source 1..15: mol_type = other RNA
tcctacgccatctcc

SEQ ID NO: 60042 - RNA, 15 nt, synthetic construct
  misc_feature 1..15: note = derived and/or modified sequence opt11 from anti-influenza_CDR
  source 1..15: mol_type = other RNA
tcctactcctggtcc

SEQ ID NO: 60043 - RNA, 15 nt, synthetic construct
  misc_feature 1..15: note = derived and/or modified sequence opt11 from anti-influenza_CDR
  source 1..15: mol_type = other RNA
aattcgttctggggc

SEQ ID NO: 60044 - RNA, 15 nt, synthetic construct
  misc_feature 1..15: note = derived and/or modified sequence opt11 from anti-influenza_CDR
  source 1..15: mol_type = other RNA
gcctaccactggtca

SEQ ID NO: 60045 - RNA, 15 nt, synthetic construct
  misc_feature 1..15: note = derived and/or modified sequence opt11 from anti-influenza_CDR
  source 1..15: mol_type = other RNA
gacaactacatcaat

SEQ ID NO: 60046 - RNA, 15 nt, synthetic construct
  misc_feature 1..15: note = derived and/or modified sequence opt11 from anti-influenza_CDR
  source 1..15: mol_type = other RNA
tcgggctttagcgtg

SEQ ID NO: 60047 - RNA, 15 nt, synthetic construct
  misc_feature 1..15: note = derived and/or modified sequence opt11 from anti-influenza_CDR
  source 1..15: mol_type = other RNA
gcgtacgcgttcacg

SEQ ID NO: 60048 - RNA, 15 nt, synthetic construct
  misc_feature 1..15: note = derived and/or modified sequence opt11 from anti-influenza_CDR
  source 1..15: mol_type = other RNA
ggctcggccattagt

SEQ ID NO: 60049 - RNA, 15 nt, synthetic construct
  misc_feature 1..15: note = derived and/or modified sequence opt11 from anti-influenza_CDR
  source 1..15: mol_type = other RNA
tcgtacgcgatcacg

SEQ ID NO: 60050 - RNA, 15 nt, synthetic construct
  misc_feature 1..15: note = derived and/or modified sequence opt11 from anti-influenza_CDR
  source 1..15: mol_type = other RNA
tcctactacatgcac

SEQ ID NO: 60051 - RNA, 15 nt, synthetic construct
  misc_feature 1..15: note = derived and/or modified sequence opt11 from anti-influenza_CDR
  source 1..15: mol_type = other RNA
atctacgccatgtcc

SEQ ID NO: 60052 - RNA, 15 nt, synthetic construct
  misc_feature 1..15: note = derived and/or modified sequence opt11 from anti-influenza_CDR
  source 1..15: mol_type = other RNA
tcctactccatgaac

SEQ ID NO: 60053 - RNA, 15 nt, synthetic construct
  misc_feature 1..15: note = derived and/or modified sequence opt11 from anti-influenza_CDR
  source 1..15: mol_type = other RNA
agctacggcattagc

SEQ ID NO: 60054 - RNA, 15 nt, synthetic construct
  misc_feature 1..15: note = derived and/or modified sequence opt11 from anti-influenza_CDR
  source 1..15: mol_type = other RNA
ttctactccatgtcc

SEQ ID NO: 60055 - RNA, 15 nt, synthetic construct
  misc_feature 1..15: note = derived and/or modified sequence opt11 from anti-influenza_CDR
  source 1..15: mol_type = other RNA
acccacgccatctca

SEQ ID NO: 60056 - RNA, 15 nt, synthetic construct
  misc_feature 1..15: note = derived and/or modified sequence opt11 from anti-influenza_CDR
  source 1..15: mol_type = other RNA
gggtacgcgatctcg

SEQ ID NO: 60057 - RNA, 15 nt, synthetic construct
  misc_feature 1..15: note = derived and/or modified sequence opt11 from anti-influenza_CDR
  source 1..15: mol_type = other RNA
tctaactcaatctcc

SEQ ID NO: 60058 - RNA, 15 nt, synthetic construct
  misc_feature 1..15: note = derived and/or modified sequence opt11 from anti-influenza_CDR
  source 1..15: mol_type = other RNA
aacttcgccatcaac

SEQ ID NO: 60059 - RNA, 15 nt, synthetic construct
  misc_feature 1..15: note = derived and/or modified sequence opt11 from anti-influenza_CDR
  source 1..15: mol_type = other RNA
tccaatgccgtctcc

SEQ ID NO: 60060 - RNA, 15 nt, synthetic construct
  misc_feature 1..15: note = derived and/or modified sequence opt11 from anti-influenza_CDR
  source 1..15: mol_type = other RNA
gataacgcgatctcg

SEQ ID NO: 60061 - RNA, 15 nt, synthetic construct
  misc_feature 1..15: note = derived and/or modified sequence opt11 from anti-influenza_CDR
  source 1..15: mol_type = other RNA
tttagcgaggtcgag

SEQ ID NO: 60062 - RNA, 15 nt, synthetic construct
  misc_feature 1..15: note = derived and/or modified sequence opt11 from anti-influenza_CDR
  source 1..15: mol_type = other RNA
gcccaccacatgcat

SEQ ID NO: 60063 - RNA, 15 nt, synthetic construct
  misc_feature 1..15: note = derived and/or modified sequence opt11 from anti-influenza_CDR
  source 1..15: mol_type = other RNA
agtcagtggataggg

SEQ ID NO: 60064 - RNA, 15 nt, synthetic construct
  misc_feature 1..15: note = derived and/or modified sequence opt11 from anti-influenza_CDR
  source 1..15: mol_type = other RNA
gactacgccatgaat

SEQ ID NO: 60065 - RNA, 15 nt, synthetic construct
  misc_feature 1..15: note = derived and/or modified sequence opt11 from anti-influenza_CDR
  source 1..15: mol_type = other RNA
aacgcgtggatgagc

SEQ ID NO: 60066 - RNA, 15 nt, synthetic construct
  misc_feature 1..15: note = derived and/or modified sequence opt11 from anti-influenza_CDR
  source 1..15: mol_type = other RNA
gactacgccatcaat

SEQ ID NO: 60067 - RNA, 15 nt, synthetic construct
  misc_feature 1..15: note = derived and/or modified sequence opt11 from anti-influenza_CDR
  source 1..15: mol_type = other RNA
cgccacggcataagc

SEQ ID NO: 60068 - RNA, 15 nt, synthetic construct
  misc_feature 1..15: note = derived and/or modified sequence opt11 from anti-influenza_CDR
  source 1..15: mol_type = other RNA
gaactctccatccac

SEQ ID NO: 60069 - RNA, 15 nt, synthetic construct
  misc_feature 1..15: note = derived and/or modified sequence opt11 from anti-influenza_CDR
  source 1..15: mol_type = other RNA
tcctccaactactac

SEQ ID NO: 60070 - RNA, 15 nt, synthetic construct
  misc_feature 1..15: note = derived and/or modified sequence opt11 from anti-influenza_CDR
  source 1..15: mol_type = other RNA
acctacgccatgtcc

SEQ ID NO: 60071 - RNA, 15 nt, synthetic construct
  misc_feature 1..15: note = derived and/or modified sequence opt11 from anti-influenza_CDR
  source 1..15: mol_type = other RNA
aactacgccatctca

SEQ ID NO: 60072 - RNA, 18 nt, synthetic construct
  misc_feature 1..18: note = derived and/or modified sequence opt11 from anti-influenza_CDR
  source 1..18: mol_type = other RNA
tttggcgcgatagcgggc

SEQ ID NO: 60073 - RNA, 18 nt, synthetic construct
  misc_feature 1..18: note = derived and/or modified sequence opt11 from anti-influenza_CDR
  source 1..18: mol_type = other RNA
caagacatctcccgctac

SEQ ID NO: 60074 - RNA, 18 nt, synthetic construct
  misc_feature 1..18: note = derived and/or modified sequence opt11 from anti-influenza_CDR
  source 1..18: mol_type = other RNA
cagaatatagggccgtgg

SEQ ID NO: 60075 - RNA, 18 nt, synthetic construct
  misc_feature 1..18: note = derived and/or modified sequence opt11 from anti-influenza_CDR
  source 1..18: mol_type = other RNA
cagagcgtgaacaggcgc

SEQ ID NO: 60076 - RNA, 18 nt, synthetic construct
  misc_feature 1..18: note = derived and/or modified sequence opt11 from anti-influenza_CDR
  source 1..18: mol_type = other RNA
caatccatctccacctac

SEQ ID NO: 60077 - RNA, 18 nt, synthetic construct
  misc_feature 1..18: note = derived and/or modified sequence opt11 from anti-influenza_CDR
  source 1..18: mol_type = other RNA
cagggcataatcacgtac

SEQ ID NO: 60078 - RNA, 18 nt, synthetic construct
  misc_feature 1..18: note = derived and/or modified sequence opt11 from anti-influenza_CDR
  source 1..18: mol_type = other RNA
caaggcatctccagctac

SEQ ID NO: 60079 - RNA, 18 nt, synthetic construct
  misc_feature 1..18: note = derived and/or modified sequence opt11 from anti-influenza_CDR
  source 1..18: mol_type = other RNA
caggacgtgagtacgtgg

SEQ ID NO: 60080 - RNA, 18 nt, synthetic construct
  misc_feature 1..18: note = derived and/or modified sequence opt11 from anti-influenza_CDR
  source 1..18: mol_type = other RNA
caagacatctacatctac

SEQ ID NO: 60081 - RNA, 18 nt, synthetic construct
  misc_feature 1..18: note = derived and/or modified sequence opt11 from anti-influenza_CDR
  source 1..18: mol_type = other RNA
gaaaacatctggaacaac

SEQ ID NO: 60082 - RNA, 18 nt, synthetic construct
  misc_feature 1..18: note = derived and/or modified sequence opt11 from anti-influenza_CDR
  source 1..18: mol_type = other RNA
gggttcacggtcacgagt

SEQ ID NO: 60083 - RNA, 18 nt, synthetic construct
  misc_feature 1..18: note = derived and/or modified sequence opt11 from anti-influenza_CDR
  source 1..18: mol_type = other RNA
caggacataagcgggcac

SEQ ID NO: 60084 - RNA, 18 nt, synthetic construct
  misc_feature 1..18: note = derived and/or modified sequence opt11 from anti-influenza_CDR
  source 1..18: mol_type = other RNA
tcactactgaccgaagtc

SEQ ID NO: 60085 - RNA, 18 nt, synthetic construct
  misc_feature 1..18: note = derived and/or modified sequence opt11 from anti-influenza_CDR
  source 1..18: mol_type = other RNA
ggctcgagcataagcaat

SEQ ID NO: 60086 - RNA, 18 nt, synthetic construct
  misc_feature 1..18: note = derived and/or modified sequence opt11 from anti-influenza_CDR
  source 1..18: mol_type = other RNA
ggcgggagcataacatcg

SEQ ID NO: 60087 - RNA, 18 nt, synthetic construct
  misc_feature 1..18: note = derived and/or modified sequence opt11 from anti-influenza_CDR
  source 1..18: mol_type = other RNA
ggcgggagcataagctcg

SEQ ID NO: 60088 - RNA, 18 nt, synthetic construct
  misc_feature 1..18: note = derived and/or modified sequence opt11 from anti-influenza_CDR
  source 1..18: mol_type = other RNA
ggcctctccgtctcctca

SEQ ID NO: 60089 - RNA, 18 nt, synthetic construct
  misc_feature 1..18: note = derived and/or modified sequence opt11 from anti-influenza_CDR
  source 1..18: mol_type = other RNA
ggcgcgagcataagctcg

SEQ ID NO: 60090 - RNA, 18 nt, synthetic construct
  misc_feature 1..18: note = derived and/or modified sequence opt11 from anti-influenza_CDR
  source 1..18: mol_type = other RNA
ggcgacagcataagctcg

SEQ ID NO: 60091 - RNA, 18 nt, synthetic construct
  misc_feature 1..18: note = derived and/or modified sequence opt11 from anti-influenza_CDR
  source 1..18: mol_type = other RNA
ggcgggagcataagcaat

SEQ ID NO: 60092 - RNA, 18 nt, synthetic construct
  misc_feature 1..18: note = derived and/or modified sequence opt11 from anti-influenza_CDR
  source 1..18: mol_type = other RNA
ggcgggagcataagcgcg

SEQ ID NO: 60093 - RNA, 18 nt, synthetic construct
  misc_feature 1..18: note = derived and/or modified sequence opt11 from anti-influenza_CDR
  source 1..18: mol_type = other RNA
ggcttcagcgtgtccgat

SEQ ID NO: 60094 - RNA, 18 nt, synthetic construct
  misc_feature 1..18: note = derived and/or modified sequence opt11 from anti-influenza_CDR
  source 1..18: mol_type = other RNA
tcgcgatcgctcgatgtc

SEQ ID NO: 60095 - RNA, 18 nt, synthetic construct
  misc_feature 1..18: note = derived and/or modified sequence opt11 from anti-influenza_CDR
  source 1..18: mol_type = other RNA
cgctcacaacagaccgta

SEQ ID NO: 60096 - RNA, 18 nt, synthetic construct
  misc_feature 1..18: note = derived and/or modified sequence opt11 from anti-influenza_CDR
  source 1..18: mol_type = other RNA
caaaccatcaacaactac

SEQ ID NO: 60097 - RNA, 18 nt, synthetic construct
  misc_feature 1..18: note = derived and/or modified sequence opt11 from anti-influenza_CDR
  source 1..18: mol_type = other RNA
aacatgggcccgacctcg

SEQ ID NO: 60098 - RNA, 18 nt, synthetic construct
  misc_feature 1..18: note = derived and/or modified sequence opt11 from anti-influenza_CDR
  source 1..18: mol_type = other RNA
caggtagtggggacgaac

SEQ ID NO: 60099 - RNA, 18 nt, synthetic construct
  misc_feature 1..18: note = derived and/or modified sequence opt11 from anti-influenza_CDR
  source 1..18: mol_type = other RNA
cagggcataaacacgcac

SEQ ID NO: 60100 - RNA, 18 nt, synthetic construct
  misc_feature 1..18: note = derived and/or modified sequence opt11 from anti-influenza_CDR
  source 1..18: mol_type = other RNA
caagacatccgcaaccgc

SEQ ID NO: 60101 - RNA, 18 nt, synthetic construct
  misc_feature 1..18: note = derived and/or modified sequence opt11 from anti-influenza_CDR
  source 1..18: mol_type = other RNA
caggggatagggagtaat

SEQ ID NO: 60102 - RNA, 18 nt, synthetic construct
  misc_feature 1..18: note = derived and/or modified sequence opt11 from anti-influenza_CDR
  source 1..18: mol_type = other RNA
caaaccatctaccgctgg

SEQ ID NO: 60103 - RNA, 18 nt, synthetic construct
  misc_feature 1..18: note = derived and/or modified sequence opt11 from anti-influenza_CDR
  source 1..18: mol_type = other RNA
caaaccatcacccgcttc

SEQ ID NO: 60104 - RNA, 18 nt, synthetic construct
  misc_feature 1..18: note = derived and/or modified sequence opt11 from anti-influenza_CDR
  source 1..18: mol_type = other RNA
cgcctgggcgagaaattt

SEQ ID NO: 60105 - RNA, 18 nt, synthetic construct
  misc_feature 1..18: note = derived and/or modified sequence opt11 from anti-influenza_CDR
  source 1..18: mol_type = other RNA
aagctcggggacaagttc

SEQ ID NO: 60106 - RNA, 18 nt, synthetic construct
  misc_feature 1..18: note = derived and/or modified sequence opt11 from anti-influenza_CDR
  source 1..18: mol_type = other RNA
caggggttggggagtaat

SEQ ID NO: 60107 - RNA, 18 nt, synthetic construct
  misc_feature 1..18: note = derived and/or modified sequence opt11 from anti-influenza_CDR
  source 1..18: mol_type = other RNA
tacatcggctcaaaatcc

SEQ ID NO: 60108 - RNA, 18 nt, synthetic construct
  misc_feature 1..18: note = derived and/or modified sequence opt11 from anti-influenza_CDR
  source 1..18: mol_type = other RNA
caactcatctcctcctac

SEQ ID NO: 60109 - RNA, 18 nt, synthetic construct
  misc_feature 1..18: note = derived and/or modified sequence opt11 from anti-influenza_CDR
  source 1..18: mol_type = other RNA
caatccgtctcctccaac

SEQ ID NO: 60110 - RNA, 18 nt, synthetic construct
  misc_feature 1..18: note = derived and/or modified sequence opt11 from anti-influenza_CDR
  source 1..18: mol_type = other RNA
caagtcatctcctcctac

SEQ ID NO: 60111 - RNA, 18 nt, synthetic construct
  misc_feature 1..18: note = derived and/or modified sequence opt11 from anti-influenza_CDR
  source 1..18: mol_type = other RNA
cagagcgtgaacaggaac

SEQ ID NO: 60112 - RNA, 18 nt, synthetic construct
  misc_feature 1..18: note = derived and/or modified sequence opt11 from anti-influenza_CDR
  source 1..18: mol_type = other RNA
gatatcgggagcaagagc

SEQ ID NO: 60113 - RNA, 18 nt, synthetic construct
  misc_feature 1..18: note = derived and/or modified sequence opt11 from anti-influenza_CDR
  source 1..18: mol_type = other RNA
caatccgtctccaccaac

SEQ ID NO: 60114 - RNA, 18 nt, synthetic construct
  misc_feature 1..18: note = derived and/or modified sequence opt11 from anti-influenza_CDR
  source 1..18: mol_type = other RNA
atgattgcgggctggcac

SEQ ID NO: 60115 - RNA, 18 nt, synthetic construct
  misc_feature 1..18: note = derived and/or modified sequence opt11 from anti-influenza_CDR
  source 1..18: mol_type = other RNA
caggacataagcacgtgg

SEQ ID NO: 60116 - RNA, 18 nt, synthetic construct
  misc_feature 1..18: note = derived and/or modified sequence opt11 from anti-influenza_CDR
  source 1..18: mol_type = other RNA
gagaaaatatactcgaac

SEQ ID NO: 60117 - RNA, 21 nt, synthetic construct
  misc_feature 1..21: note = derived and/or modified sequence opt11 from anti-influenza_CDR
  source 1..21: mol_type = other RNA
atctactacaactacaacatc

SEQ ID NO: 60118 - RNA, 21 nt, synthetic construct
  misc_feature 1..21: note = derived and/or modified sequence opt11 from anti-influenza_CDR
  source 1..21: mol_type = other RNA
caatcgatctcgagcgggtac

SEQ ID NO: 60119 - RNA, 21 nt, synthetic construct
  misc_feature 1..21: note = derived and/or modified sequence opt11 from anti-influenza_CDR
  source 1..21: mol_type = other RNA
caatcggtctcgagctcgtac

SEQ ID NO: 60120 - RNA, 21 nt, synthetic construct
  misc_feature 1..21: note = derived and/or modified sequence opt11 from anti-influenza_CDR
  source 1..21: mol_type = other RNA
caaaccgtctcctcatcctac

SEQ ID NO: 60121 - RNA, 21 nt, synthetic construct
  misc_feature 1..21: note = derived and/or modified sequence opt11 from anti-influenza_CDR
  source 1..21: mol_type = other RNA
agcaataacgcggtctggaac

SEQ ID NO: 60122 - RNA, 21 nt, synthetic construct
  misc_feature 1..21: note = derived and/or modified sequence opt11 from anti-influenza_CDR
  source 1..21: mol_type = other RNA
agcaatagcgcggtctggaac

SEQ ID NO: 60123 - RNA, 21 nt, synthetic construct
  misc_feature 1..21: note = derived and/or modified sequence opt11 from anti-influenza_CDR
  source 1..21: mol_type = other RNA
gccgccaccaccctccaatca

SEQ ID NO: 60124 - RNA, 21 nt, synthetic construct
  misc_feature 1..21: note = derived and/or modified sequence opt11 from anti-influenza_CDR
  source 1..21: mol_type = other RNA
agcaatcgcgcgacctggaac

SEQ ID NO: 60125 - RNA, 21 nt, synthetic construct
  misc_feature 1..21: note = derived and/or modified sequence opt11 from anti-influenza_CDR
  source 1..21: mol_type = other RNA
gccacctccaccctccaatca

SEQ ID NO: 60126 - RNA, 21 nt, synthetic construct
  misc_feature 1..21: note = derived and/or modified sequence opt11 from anti-influenza_CDR
  source 1..21: mol_type = other RNA
agcaatagcgcgacctggaac

SEQ ID NO: 60127 - RNA, 21 nt, synthetic construct
  misc_feature 1..21: note = derived and/or modified sequence opt11 from anti-influenza_CDR
  source 1..21: mol_type = other RNA
gcctcctccaccctccaatcc

SEQ ID NO: 60128 - RNA, 21 nt, synthetic construct
  misc_feature 1..21: note = derived and/or modified sequence opt11 from anti-influenza_CDR
  source 1..21: mol_type = other RNA
agctataacgcggtctggaac

SEQ ID NO: 60129 - RNA, 21 nt, synthetic construct
  misc_feature 1..21: note = derived and/or modified sequence opt11 from anti-influenza_CDR
  source 1..21: mol_type = other RNA
gccgcgagctcgcgcttgagc

SEQ ID NO: 60130 - RNA, 21 nt, synthetic construct
  misc_feature 1..21: note = derived and/or modified sequence opt11 from anti-influenza_CDR
  source 1..21: mol_type = other RNA
gccgcgagctcgcgcgggagc

SEQ ID NO: 60131 - RNA, 21 nt, synthetic construct
  misc_feature 1..21: note = derived and/or modified sequence opt11 from anti-influenza_CDR
  source 1..21: mol_type = other RNA
atataccactccggctccgcc

SEQ ID NO: 60132 - RNA, 21 nt, synthetic construct
  misc_feature 1..21: note = derived and/or modified sequence opt11 from anti-influenza_CDR
  source 1..21: mol_type = other RNA
atctattactccggcgtcacc

SEQ ID NO: 60133 - RNA, 21 nt, synthetic construct
  misc_feature 1..21: note = derived and/or modified sequence opt11 from anti-influenza_CDR
  source 1..21: mol_type = other RNA
tccagctatctcgcctggtac

SEQ ID NO: 60134 - RNA, 21 nt, synthetic construct
  misc_feature 1..21: note = derived and/or modified sequence opt11 from anti-influenza_CDR
  source 1..21: mol_type = other RNA
caatccctctcctcctcctcc

SEQ ID NO: 60135 - RNA, 21 nt, synthetic construct
  misc_feature 1..21: note = derived and/or modified sequence opt11 from anti-influenza_CDR
  source 1..21: mol_type = other RNA
cagagcgtgagcataagctat

SEQ ID NO: 60136 - RNA, 21 nt, synthetic construct
  misc_feature 1..21: note = derived and/or modified sequence opt11 from anti-influenza_CDR
  source 1..21: mol_type = other RNA
gacgtaaccgaacgcccgagc

SEQ ID NO: 60137 - RNA, 21 nt, synthetic construct
  misc_feature 1..21: note = derived and/or modified sequence opt11 from anti-influenza_CDR
  source 1..21: mol_type = other RNA
gccgcctcaaccctcctagac

SEQ ID NO: 60138 - RNA, 21 nt, synthetic construct
  misc_feature 1..21: note = derived and/or modified sequence opt11 from anti-influenza_CDR
  source 1..21: mol_type = other RNA
gccgcctccaccctccactca

SEQ ID NO: 60139 - RNA, 21 nt, synthetic construct
  misc_feature 1..21: note = derived and/or modified sequence opt11 from anti-influenza_CDR
  source 1..21: mol_type = other RNA
ggagcaagctcgctacaggga

SEQ ID NO: 60140 - RNA, 21 nt, synthetic construct
  misc_feature 1..21: note = derived and/or modified sequence opt11 from anti-influenza_CDR
  source 1..21: mol_type = other RNA
acaaatggcgtgaacgtgggc

SEQ ID NO: 60141 - RNA, 21 nt, synthetic construct
  misc_feature 1..21: note = derived and/or modified sequence opt11 from anti-influenza_CDR
  source 1..21: mol_type = other RNA
gacgcgagcacgcgcgcgaca

SEQ ID NO: 60142 - RNA, 21 nt, synthetic construct
  misc_feature 1..21: note = derived and/or modified sequence opt11 from anti-influenza_CDR
  source 1..21: mol_type = other RNA
tcagagacctattactggtcc

SEQ ID NO: 60143 - RNA, 21 nt, synthetic construct
  misc_feature 1..21: note = derived and/or modified sequence opt11 from anti-influenza_CDR
  source 1..21: mol_type = other RNA
gaagcggtcaatctagagagc

SEQ ID NO: 60144 - RNA, 21 nt, synthetic construct
  misc_feature 1..21: note = derived and/or modified sequence opt11 from anti-influenza_CDR
  source 1..21: mol_type = other RNA
ggcgcgagcacgcgcgcgaca

SEQ ID NO: 60145 - RNA, 21 nt, synthetic construct
  misc_feature 1..21: note = derived and/or modified sequence opt11 from anti-influenza_CDR
  source 1..21: mol_type = other RNA
gtgagcgggtactattggtcg

SEQ ID NO: 60146 - RNA, 21 nt, synthetic construct
  misc_feature 1..21: note = derived and/or modified sequence opt11 from anti-influenza_CDR
  source 1..21: mol_type = other RNA
ataacgggcgtgcgagtgggc

SEQ ID NO: 60147 - RNA, 21 nt, synthetic construct
  misc_feature 1..21: note = derived and/or modified sequence opt11 from anti-influenza_CDR
  source 1..21: mol_type = other RNA
gacgcgagcaatcgcgcgaca

SEQ ID NO: 60148 - RNA, 21 nt, synthetic construct
  misc_feature 1..21: note = derived and/or modified sequence opt11 from anti-influenza_CDR
  source 1..21: mol_type = other RNA
gaggtcacgaactggccatcg

SEQ ID NO: 60149 - RNA, 21 nt, synthetic construct
  misc_feature 1..21: note = derived and/or modified sequence opt11 from anti-influenza_CDR
  source 1..21: mol_type = other RNA
aaagatagcgagcgcccgagc

SEQ ID NO: 60150 - RNA, 21 nt, synthetic construct
  misc_feature 1..21: note = derived and/or modified sequence opt11 from anti-influenza_CDR
  source 1..21: mol_type = other RNA
agcgggaactattactggaac

SEQ ID NO: 60151 - RNA, 21 nt, synthetic construct
  misc_feature 1..21: note = derived and/or modified sequence opt11 from anti-influenza_CDR
  source 1..21: mol_type = other RNA
tccacaaccatccgccactcc

SEQ ID NO: 60152 - RNA, 21 nt, synthetic construct
  misc_feature 1..21: note = derived and/or modified sequence opt11 from anti-influenza_CDR
  source 1..21: mol_type = other RNA
gacgatagcgggcgaccgagc

SEQ ID NO: 60153 - RNA, 21 nt, synthetic construct
  misc_feature 1..21: note = derived and/or modified sequence opt11 from anti-influenza_CDR
  source 1..21: mol_type = other RNA
cgcaatgacttgcgaccgagc

SEQ ID NO: 60154 - RNA, 21 nt, synthetic construct
  misc_feature 1..21: note = derived and/or modified sequence opt11 from anti-influenza_CDR
  source 1..21: mol_type = other RNA
tccgtcgaccactactggtcc

SEQ ID NO: 60155 - RNA, 21 nt, synthetic construct
  misc_feature 1..21: note = derived and/or modified sequence opt11 from anti-influenza_CDR
  source 1..21: mol_type = other RNA
gccgtctccatcctccaatcc

SEQ ID NO: 60156 - RNA, 21 nt, synthetic construct
  misc_feature 1..21: note = derived and/or modified sequence opt11 from anti-influenza_CDR
  source 1..21: mol_type = other RNA
gacgacaccgaccgcccatca

SEQ ID NO: 60157 - RNA, 21 nt, synthetic construct
  misc_feature 1..21: note = derived and/or modified sequence opt11 from anti-influenza_CDR
  source 1..21: mol_type = other RNA
gaaaataacaagcgcccgagc

SEQ ID NO: 60158 - RNA, 21 nt, synthetic construct
  misc_feature 1..21: note = derived and/or modified sequence opt11 from anti-influenza_CDR
  source 1..21: mol_type = other RNA
gactcgagcaatcgcgcgcca

SEQ ID NO: 60159 - RNA, 21 nt, synthetic construct
  misc_feature 1..21: note = derived and/or modified sequence opt11 from anti-influenza_CDR
  source 1..21: mol_type = other RNA
gaagtaaccaaacgcccgagc

SEQ ID NO: 60160 - RNA, 21 nt, synthetic construct
  misc_feature 1..21: note = derived and/or modified sequence opt11 from anti-influenza_CDR
  source 1..21: mol_type = other RNA
gccacctccaacacccactca

SEQ ID NO: 60161 - RNA, 21 nt, synthetic construct
  misc_feature 1..21: note = derived and/or modified sequence opt11 from anti-influenza_CDR
  source 1..21: mol_type = other RNA
gccgcaagcaacctcgaaaac

SEQ ID NO: 60162 - RNA, 21 nt, synthetic construct
  misc_feature 1..21: note = derived and/or modified sequence opt11 from anti-influenza_CDR
  source 1..21: mol_type = other RNA
gccgcctccggcctccaatca

SEQ ID NO: 60163 - RNA, 21 nt, synthetic construct
  misc_feature 1..21: note = derived and/or modified sequence opt11 from anti-influenza_CDR
  source 1..21: mol_type = other RNA
ggcttcaccgtctcctccaac

SEQ ID NO: 60164 - RNA, 21 nt, synthetic construct
  misc_feature 1..21: note = derived and/or modified sequence opt11 from anti-influenza_CDR
  source 1..21: mol_type = other RNA
gggggggggtatagttggaat

SEQ ID NO: 60165 - RNA, 21 nt, synthetic construct
  misc_feature 1..21: note = derived and/or modified sequence opt11 from anti-influenza_CDR
  source 1..21: mol_type = other RNA
ggcgcctccaacctccaatca

SEQ ID NO: 60166 - RNA, 21 nt, synthetic construct
  misc_feature 1..21: note = derived and/or modified sequence opt11 from anti-influenza_CDR
  source 1..21: mol_type = other RNA
ggcgcaaccaatctccagagc

SEQ ID NO: 60167 - RNA, 21 nt, synthetic construct
  misc_feature 1..21: note = derived and/or modified sequence opt11 from anti-influenza_CDR
  source 1..21: mol_type = other RNA
ggcgcctccaacctccactcc

SEQ ID NO: 60168 - RNA, 21 nt, synthetic construct
  misc_feature 1..21: note = derived and/or modified sequence opt11 from anti-influenza_CDR
  source 1..21: mol_type = other RNA
ggcgcaagcacgctccagagc

SEQ ID NO: 60169 - RNA, 21 nt, synthetic construct
  misc_feature 1..21: note = derived and/or modified sequence opt11 from anti-influenza_CDR
  source 1..21: mol_type = other RNA
gacaactccgaccgcccatca

SEQ ID NO: 60170 - RNA, 21 nt, synthetic construct
  misc_feature 1..21: note = derived and/or modified sequence opt11 from anti-influenza_CDR
  source 1..21: mol_type = other RNA
ggcgcaagctcgctccagagc

SEQ ID NO: 60171 - RNA, 21 nt, synthetic construct
  misc_feature 1..21: note = derived and/or modified sequence opt11 from anti-influenza_CDR
  source 1..21: mol_type = other RNA
ggcaatagcaatcgcccgagc

SEQ ID NO: 60172 - RNA, 21 nt, synthetic construct
  misc_feature 1..21: note = derived and/or modified sequence opt11 from anti-influenza_CDR
  source 1..21: mol_type = other RNA
gccgcctcctccctccaatca

SEQ ID NO: 60173 - RNA, 21 nt, synthetic construct
  misc_feature 1..21: note = derived and/or modified sequence opt11 from anti-influenza_CDR
  source 1..21: mol_type = other RNA
gccgcctcctccctccactca

SEQ ID NO: 60174 - RNA, 21 nt, synthetic construct
  misc_feature 1..21: note = derived and/or modified sequence opt11 from anti-influenza_CDR
  source 1..21: mol_type = other RNA
ggcgcaagcacgctccagaac

SEQ ID NO: 60175 - RNA, 21 nt, synthetic construct
  misc_feature 1..21: note = derived and/or modified sequence opt11 from anti-influenza_CDR
  source 1..21: mol_type = other RNA
ggcgcaaccgatctccagagc

SEQ ID NO: 60176 - RNA, 21 nt, synthetic construct
  misc_feature 1..21: note = derived and/or modified sequence opt11 from anti-influenza_CDR
  source 1..21: mol_type = other RNA
tccggcgcctactactggacc

SEQ ID NO: 60177 - RNA, 21 nt, synthetic construct
  misc_feature 1..21: note = derived and/or modified sequence opt11 from anti-influenza_CDR
  source 1..21: mol_type = other RNA
gtctccgacaactacatcaac

SEQ ID NO: 60178 - RNA, 21 nt, synthetic construct
  misc_feature 1..21: note = derived and/or modified sequence opt11 from anti-influenza_CDR
  source 1..21: mol_type = other RNA
tgggcgagcacgcgcgagagc

SEQ ID NO: 60179 - RNA, 21 nt, synthetic construct
  misc_feature 1..21: note = derived and/or modified sequence opt11 from anti-influenza_CDR
  source 1..21: mol_type = other RNA
agcaataaccagcgcccgagc

SEQ ID NO: 60180 - RNA, 21 nt, synthetic construct
  misc_feature 1..21: note = derived and/or modified sequence opt11 from anti-influenza_CDR
  source 1..21: mol_type = other RNA
gaagtaagcaatcgcccgagc

SEQ ID NO: 60181 - RNA, 21 nt, synthetic construct
  misc_feature 1..21: note = derived and/or modified sequence opt11 from anti-influenza_CDR
  source 1..21: mol_type = other RNA
aaaaacacccaacgcccctcc

SEQ ID NO: 60182 - RNA, 21 nt, synthetic construct
  misc_feature 1..21: note = derived and/or modified sequence opt11 from anti-influenza_CDR
  source 1..21: mol_type = other RNA
gacaacaacaaacgcccgtca

SEQ ID NO: 60183 - RNA, 21 nt, synthetic construct
  misc_feature 1..21: note = derived and/or modified sequence opt11 from anti-influenza_CDR
  source 1..21: mol_type = other RNA
gacgcgagcacgctcaggagc

SEQ ID NO: 60184 - RNA, 21 nt, synthetic construct
  misc_feature 1..21: note = derived and/or modified sequence opt11 from anti-influenza_CDR
  source 1..21: mol_type = other RNA
caagataacaggcgcccgagc

SEQ ID NO: 60185 - RNA, 21 nt, synthetic construct
  misc_feature 1..21: note = derived and/or modified sequence opt11 from anti-influenza_CDR
  source 1..21: mol_type = other RNA
gacgtaagcaagcgcccgagc

SEQ ID NO: 60186 - RNA, 21 nt, synthetic construct
  misc_feature 1..21: note = derived and/or modified sequence opt11 from anti-influenza_CDR
  source 1..21: mol_type = other RNA
gacgcgagctcgcgcgcgaca

SEQ ID NO: 60187 - RNA, 21 nt, synthetic construct
  misc_feature 1..21: note = derived and/or modified sequence opt11 from anti-influenza_CDR
  source 1..21: mol_type = other RNA
ctcgggagcaatcgcgcgagc

SEQ ID NO: 60188 - RNA, 21 nt, synthetic construct
  misc_feature 1..21: note = derived and/or modified sequence opt11 from anti-influenza_CDR
  source 1..21: mol_type = other RNA
ggagcgagcacgagagcggca

SEQ ID NO: 60189 - RNA, 21 nt, synthetic construct
  misc_feature 1..21: note = derived and/or modified sequence opt11 from anti-influenza_CDR
  source 1..21: mol_type = other RNA
gacgacagcgaccgcccaagc

SEQ ID NO: 60190 - RNA, 21 nt, synthetic construct
  misc_feature 1..21: note = derived and/or modified sequence opt11 from anti-influenza_CDR
  source 1..21: mol_type = other RNA
cgcgatggccagcgaccgagc

SEQ ID NO: 60191 - RNA, 21 nt, synthetic construct
  misc_feature 1..21: note = derived and/or modified sequence opt11 from anti-influenza_CDR
  source 1..21: mol_type = other RNA
ggcgcgagctcgcgcgcgaca

SEQ ID NO: 60192 - RNA, 21 nt, synthetic construct
  misc_feature 1..21: note = derived and/or modified sequence opt11 from anti-influenza_CDR
  source 1..21: mol_type = other RNA
ggcgcgagctcgcgcgcgagc

SEQ ID NO: 60193 - RNA, 21 nt, synthetic construct
  misc_feature 1..21: note = derived and/or modified sequence opt11 from anti-influenza_CDR
  source 1..21: mol_type = other RNA
gccgcctccaccctccaatca

SEQ ID NO: 60194 - RNA, 21 nt, synthetic construct
  misc_feature 1..21: note = derived and/or modified sequence opt11 from anti-influenza_CDR
  source 1..21: mol_type = other RNA
ctcgtgagcaagcgcgcgagc

SEQ ID NO: 60195 - RNA, 21 nt, synthetic construct
  misc_feature 1..21: note = derived and/or modified sequence opt11 from anti-influenza_CDR
  source 1..21: mol_type = other RNA
gacgtcacctaccgcccatca

SEQ ID NO: 60196 - RNA, 21 nt, synthetic construct
  misc_feature 1..21: note = derived and/or modified sequence opt11 from anti-influenza_CDR
  source 1..21: mol_type = other RNA
atgcaagcactcgagaccccg

SEQ ID NO: 60197 - RNA, 21 nt, synthetic construct
  misc_feature 1..21: note = derived and/or modified sequence opt11 from anti-influenza_CDR
  source 1..21: mol_type = other RNA
caaaactacggctcccccttc

SEQ ID NO: 60198 - RNA, 21 nt, synthetic construct
  misc_feature 1..21: note = derived and/or modified sequence opt11 from anti-influenza_CDR
  source 1..21: mol_type = other RNA
caacaatacggctccctcccc

SEQ ID NO: 60199 - RNA, 21 nt, synthetic construct
  misc_feature 1..21: note = derived and/or modified sequence opt11 from anti-influenza_CDR
  source 1..21: mol_type = other RNA
tgggggagctatctcgagagc

SEQ ID NO: 60200 - RNA, 21 nt, synthetic construct
  misc_feature 1..21: note = derived and/or modified sequence opt11 from anti-influenza_CDR
  source 1..21: mol_type = other RNA
agcgcgagcacgcgcgcgacc

SEQ ID NO: 60201 - RNA, 21 nt, synthetic construct
  misc_feature 1..21: note = derived and/or modified sequence opt11 from anti-influenza_CDR
  source 1..21: mol_type = other RNA
ggcgcgagcacgcgcgcgagc

SEQ ID NO: 60202 - RNA, 21 nt, synthetic construct
  misc_feature 1..21: note = derived and/or modified sequence opt11 from anti-influenza_CDR
  source 1..21: mol_type = other RNA
ggcgcgagcacgcgcgataca

SEQ ID NO: 60203 - RNA, 21 nt, synthetic construct
  misc_feature 1..21: note = derived and/or modified sequence opt11 from anti-influenza_CDR
  source 1..21: mol_type = other RNA
aaagtgagcacgctcgagagc

SEQ ID NO: 60204 - RNA, 21 nt, synthetic construct
  misc_feature 1..21: note = derived and/or modified sequence opt11 from anti-influenza_CDR
  source 1..21: mol_type = other RNA
agcaataccgaacgcccgagc

SEQ ID NO: 60205 - RNA, 21 nt, synthetic construct
  misc_feature 1..21: note = derived and/or modified sequence opt11 from anti-influenza_CDR
  source 1..21: mol_type = other RNA
aaaataagcaaccgcgacagc

SEQ ID NO: 60206 - RNA, 21 nt, synthetic construct
  misc_feature 1..21: note = derived and/or modified sequence opt11 from anti-influenza_CDR
  source 1..21: mol_type = other RNA
agcgcgagccatcgctatagc

SEQ ID NO: 60207 - RNA, 21 nt, synthetic construct
  misc_feature 1..21: note = derived and/or modified sequence opt11 from anti-influenza_CDR
  source 1..21: mol_type = other RNA
cagagcgtgcgctcgaacaat

SEQ ID NO: 60208 - RNA, 21 nt, synthetic construct
  misc_feature 1..21: note = derived and/or modified sequence opt11 from anti-influenza_CDR
  source 1..21: mol_type = other RNA
caaagcgtccgctcaggctac

SEQ ID NO: 60209 - RNA, 21 nt, synthetic construct
  misc_feature 1..21: note = derived and/or modified sequence opt11 from anti-influenza_CDR
  source 1..21: mol_type = other RNA
atatactatcgcgggagcacg

SEQ ID NO: 60210 - RNA, 21 nt, synthetic construct
  misc_feature 1..21: note = derived and/or modified sequence opt11 from anti-influenza_CDR
  source 1..21: mol_type = other RNA
gtctactactccggcatcaca

SEQ ID NO: 60211 - RNA, 21 nt, synthetic construct
  misc_feature 1..21: note = derived and/or modified sequence opt11 from anti-influenza_CDR
  source 1..21: mol_type = other RNA
tcccacttcgccaacctcaaa

SEQ ID NO: 60212 - RNA, 21 nt, synthetic construct
  misc_feature 1..21: note = derived and/or modified sequence opt11 from anti-influenza_CDR
  source 1..21: mol_type = other RNA
ctcaacaaatccaaaccctac

SEQ ID NO: 60213 - RNA, 21 nt, synthetic construct
  misc_feature 1..21: note = derived and/or modified sequence opt11 from anti-influenza_CDR
  source 1..21: mol_type = other RNA
aagctagcgaacacgggcacg

SEQ ID NO: 60214 - RNA, 21 nt, synthetic construct
  misc_feature 1..21: note = derived and/or modified sequence opt11 from anti-influenza_CDR
  source 1..21: mol_type = other RNA
gccgcctccaccctcacatca

SEQ ID NO: 60215 - RNA, 21 nt, synthetic construct
  misc_feature 1..21: note = derived and/or modified sequence opt11 from anti-influenza_CDR
  source 1..21: mol_type = other RNA
gacgcgagcaagctcgcgagc

SEQ ID NO: 60216 - RNA, 21 nt, synthetic construct
  misc_feature 1..21: note = derived and/or modified sequence opt11 from anti-influenza_CDR
  source 1..21: mol_type = other RNA
ttcgcgagcaggctcgcgagc

SEQ ID NO: 60217 - RNA, 21 nt, synthetic construct
  misc_feature 1..21: note = derived and/or modified sequence opt11 from anti-influenza_CDR
  source 1..21: mol_type = other RNA
agcgcgagcacgctcgcgagc

SEQ ID NO: 60218 - RNA, 21 nt, synthetic construct
  misc_feature 1..21: note = derived and/or modified sequence opt11 from anti-influenza_CDR
  source 1..21: mol_type = other RNA
gaagtaagccagcgcccgagc

SEQ ID NO: 60219 - RNA, 21 nt, synthetic construct
  misc_feature 1..21: note = derived and/or modified sequence opt11 from anti-influenza_CDR
  source 1..21: mol_type = other RNA
ggcgggacactgaacaattac

SEQ ID NO: 60220 - RNA, 21 nt, synthetic construct
  misc_feature 1..21: note = derived and/or modified sequence opt11 from anti-influenza_CDR
  source 1..21: mol_type = other RNA
gatatcgtgatgacgcaatcg

SEQ ID NO: 60221 - RNA, 24 nt, synthetic construct
  misc_feature 1..24: note = derived and/or modified sequence opt11 from anti-influenza_CDR
  source 1..24: mol_type = other RNA
ggcttcaccttctccaactacgcc

SEQ ID NO: 60222 - RNA, 24 nt, synthetic construct
  misc_feature 1..24: note = derived and/or modified sequence opt11 from anti-influenza_CDR
  source 1..24: mol_type = other RNA
gggttcacgttctcgaactacggc

SEQ ID NO: 60223 - RNA, 24 nt, synthetic construct
  misc_feature 1..24: note = derived and/or modified sequence opt11 from anti-influenza_CDR
  source 1..24: mol_type = other RNA
ggcttcaccttctcctcctacgcc

SEQ ID NO: 60224 - RNA, 24 nt, synthetic construct
  misc_feature 1..24: note = derived and/or modified sequence opt11 from anti-influenza_CDR
  source 1..24: mol_type = other RNA
ggcttcaccttctccacctacgcc

SEQ ID NO: 60225 - RNA, 24 nt, synthetic construct
  misc_feature 1..24: note = derived and/or modified sequence opt11 from anti-influenza_CDR
  source 1..24: mol_type = other RNA
gggggcatattcataagccaggcc

SEQ ID NO: 60226 - RNA, 24 nt, synthetic construct
  misc_feature 1..24: note = derived and/or modified sequence opt11 from anti-influenza_CDR
  source 1..24: mol_type = other RNA
ggcgggatctttagcccgtacgcg

SEQ ID NO: 60227 - RNA, 24 nt, synthetic construct
  misc_feature 1..24: note = derived and/or modified sequence opt11 from anti-influenza_CDR
  source 1..24: mol_type = other RNA
ggcgggccatttagcgggttcgcg

SEQ ID NO: 60228 - RNA, 24 nt, synthetic construct
  misc_feature 1..24: note = derived and/or modified sequence opt11 from anti-influenza_CDR
  source 1..24: mol_type = other RNA
ggcgggacctttaactcgcacgcg

SEQ ID NO: 60229 - RNA, 24 nt, synthetic construct
  misc_feature 1..24: note = derived and/or modified sequence opt11 from anti-influenza_CDR
  source 1..24: mol_type = other RNA
ggctcgaacataggctcgaacacg

SEQ ID NO: 60230 - RNA, 24 nt, synthetic construct
  misc_feature 1..24: note = derived and/or modified sequence opt11 from anti-influenza_CDR
  source 1..24: mol_type = other RNA
ggcgtgacctttagcatgtacgcg

SEQ ID NO: 60231 - RNA, 24 nt, synthetic construct
  misc_feature 1..24: note = derived and/or modified sequence opt11 from anti-influenza_CDR
  source 1..24: mol_type = other RNA
ggcgtgacctttagcatgtacacg

SEQ ID NO: 60232 - RNA, 24 nt, synthetic construct
  misc_feature 1..24: note = derived and/or modified sequence opt11 from anti-influenza_CDR
  source 1..24: mol_type = other RNA
ggcgtcacctcatccaactaccca

SEQ ID NO: 60233 - RNA, 24 nt, synthetic construct
  misc_feature 1..24: note = derived and/or modified sequence opt11 from anti-influenza_CDR
  source 1..24: mol_type = other RNA
atcatcgccatcttcggcaccacc

SEQ ID NO: 60234 - RNA, 24 nt, synthetic construct
  misc_feature 1..24: note = derived and/or modified sequence opt11 from anti-influenza_CDR
  source 1..24: mol_type = other RNA
atcatccccctattcggcaccgcc

SEQ ID NO: 60235 - RNA, 24 nt, synthetic construct
  misc_feature 1..24: note = derived and/or modified sequence opt11 from anti-influenza_CDR
  source 1..24: mol_type = other RNA
atcatccccctcttcggcaccacc

SEQ ID NO: 60236 - RNA, 24 nt, synthetic construct
  misc_feature 1..24: note = derived and/or modified sequence opt11 from anti-influenza_CDR
  source 1..24: mol_type = other RNA
atcataccaatgttcggcgccacc

SEQ ID NO: 60237 - RNA, 24 nt, synthetic construct
  misc_feature 1..24: note = derived and/or modified sequence opt11 from anti-influenza_CDR
  source 1..24: mol_type = other RNA
atcatccccatgttcggcaccacc

SEQ ID NO: 60238 - RNA, 24 nt, synthetic construct
  misc_feature 1..24: note = derived and/or modified sequence opt11 from anti-influenza_CDR
  source 1..24: mol_type = other RNA
ataaactcgggcgggggcgcgaca

SEQ ID NO: 60239 - RNA, 24 nt, synthetic construct
  misc_feature 1..24: note = derived and/or modified sequence opt11 from anti-influenza_CDR
  source 1..24: mol_type = other RNA
atatcggccgtgttcgggaccgcg

SEQ ID NO: 60240 - RNA, 24 nt, synthetic construct
  misc_feature 1..24: note = derived and/or modified sequence opt11 from anti-influenza_CDR
  source 1..24: mol_type = other RNA
atctcctacgacgccaactacaaa

SEQ ID NO: 60241 - RNA, 24 nt, synthetic construct
  misc_feature 1..24: note = derived and/or modified sequence opt11 from anti-influenza_CDR
  source 1..24: mol_type = other RNA
atctcctacgacggcaactacaaa

SEQ ID NO: 60242 - RNA, 24 nt, synthetic construct
  misc_feature 1..24: note = derived and/or modified sequence opt11 from anti-influenza_CDR
  source 1..24: mol_type = other RNA
atcagctacgacggcagcaacaaa

SEQ ID NO: 60243 - RNA, 24 nt, synthetic construct
  misc_feature 1..24: note = derived and/or modified sequence opt11 from anti-influenza_CDR
  source 1..24: mol_type = other RNA
atctcatacgacggctcaaaccag

SEQ ID NO: 60244 - RNA, 24 nt, synthetic construct
  misc_feature 1..24: note = derived and/or modified sequence opt11 from anti-influenza_CDR
  source 1..24: mol_type = other RNA
caacaatactaccgctccccctcc

SEQ ID NO: 60245 - RNA, 24 nt, synthetic construct
  misc_feature 1..24: note = derived and/or modified sequence opt11 from anti-influenza_CDR
  source 1..24: mol_type = other RNA
gtcctcccactcttcggcgtcacc

SEQ ID NO: 60246 - RNA, 24 nt, synthetic construct
  misc_feature 1..24: note = derived and/or modified sequence opt11 from anti-influenza_CDR
  source 1..24: mol_type = other RNA
ggcgggacatttagctcggacgcg

SEQ ID NO: 60247 - RNA, 24 nt, synthetic construct
  misc_feature 1..24: note = derived and/or modified sequence opt11 from anti-influenza_CDR
  source 1..24: mol_type = other RNA
atcatccccgtcttccaaaccgcc

SEQ ID NO: 60248 - RNA, 24 nt, synthetic construct
  misc_feature 1..24: note = derived and/or modified sequence opt11 from anti-influenza_CDR
  source 1..24: mol_type = other RNA
acatcaaacatcggctcaaacgcc

SEQ ID NO: 60249 - RNA, 24 nt, synthetic construct
  misc_feature 1..24: note = derived and/or modified sequence opt11 from anti-influenza_CDR
  source 1..24: mol_type = other RNA
gggtacagcttcacgtcgaggtgg

SEQ ID NO: 60250 - RNA, 24 nt, synthetic construct
  misc_feature 1..24: note = derived and/or modified sequence opt11 from anti-influenza_CDR
  source 1..24: mol_type = other RNA
atatacccctccgactccgacgtc

SEQ ID NO: 60251 - RNA, 24 nt, synthetic construct
  misc_feature 1..24: note = derived and/or modified sequence opt11 from anti-influenza_CDR
  source 1..24: mol_type = other RNA
caacaatacgacaactggctctcc

SEQ ID NO: 60252 - RNA, 24 nt, synthetic construct
  misc_feature 1..24: note = derived and/or modified sequence opt11 from anti-influenza_CDR
  source 1..24: mol_type = other RNA
ggggggacgtttagtaattatggg

SEQ ID NO: 60253 - RNA, 24 nt, synthetic construct
  misc_feature 1..24: note = derived and/or modified sequence opt11 from anti-influenza_CDR
  source 1..24: mol_type = other RNA
ggcgcctccatctcctcctcctac

SEQ ID NO: 60254 - RNA, 24 nt, synthetic construct
  misc_feature 1..24: note = derived and/or modified sequence opt11 from anti-influenza_CDR
  source 1..24: mol_type = other RNA
ggcgggacctttagctcgtacgat

SEQ ID NO: 60255 - RNA, 24 nt, synthetic construct
  misc_feature 1..24: note = derived and/or modified sequence opt11 from anti-influenza_CDR
  source 1..24: mol_type = other RNA
atcatacccatatacggcaccgcc

SEQ ID NO: 60256 - RNA, 24 nt, synthetic construct
  misc_feature 1..24: note = derived and/or modified sequence opt11 from anti-influenza_CDR
  source 1..24: mol_type = other RNA
ggctacacctccaccacctacggc

SEQ ID NO: 60257 - RNA, 24 nt, synthetic construct
  misc_feature 1..24: note = derived and/or modified sequence opt11 from anti-influenza_CDR
  source 1..24: mol_type = other RNA
atcaacccatacaacggcaacccc

SEQ ID NO: 60258 - RNA, 24 nt, synthetic construct
  misc_feature 1..24: note = derived and/or modified sequence opt11 from anti-influenza_CDR
  source 1..24: mol_type = other RNA
atctggtacgacggcgataacaag

SEQ ID NO: 60259 - RNA, 24 nt, synthetic construct
  misc_feature 1..24: note = derived and/or modified sequence opt11 from anti-influenza_CDR
  source 1..24: mol_type = other RNA
ggcttcaccttctccgacttctgg

SEQ ID NO: 60260 - RNA, 24 nt, synthetic construct
  misc_feature 1..24: note = derived and/or modified sequence opt11 from anti-influenza_CDR
  source 1..24: mol_type = other RNA
atagaccaggacgggaacgagaga

SEQ ID NO: 60261 - RNA, 24 nt, synthetic construct
  misc_feature 1..24: note = derived and/or modified sequence opt11 from anti-influenza_CDR
  source 1..24: mol_type = other RNA
agctcgaacataggcaagaactac

SEQ ID NO: 60262 - RNA, 24 nt, synthetic construct
  misc_feature 1..24: note = derived and/or modified sequence opt11 from anti-influenza_CDR
  source 1..24: mol_type = other RNA
ggctacaccttcaccaactactgg

SEQ ID NO: 60263 - RNA, 24 nt, synthetic construct
  misc_feature 1..24: note = derived and/or modified sequence opt11 from anti-influenza_CDR
  source 1..24: mol_type = other RNA
atcttcccccccgactcccaaacc

SEQ ID NO: 60264 - RNA, 24 nt, synthetic construct
  misc_feature 1..24: note = derived and/or modified sequence opt11 from anti-influenza_CDR
  source 1..24: mol_type = other RNA
ggctactcattctccgactactgg

SEQ ID NO: 60265 - RNA, 24 nt, synthetic construct
  misc_feature 1..24: note = derived and/or modified sequence opt11 from anti-influenza_CDR
  source 1..24: mol_type = other RNA
atctaccccgcctcctccgaaatc

SEQ ID NO: 60266 - RNA, 24 nt, synthetic construct
  misc_feature 1..24: note = derived and/or modified sequence opt11 from anti-influenza_CDR
  source 1..24: mol_type = other RNA
agtggggacagtgggacgtggaat

SEQ ID NO: 60267 - RNA, 24 nt, synthetic construct
  misc_feature 1..24: note = derived and/or modified sequence opt11 from anti-influenza_CDR
  source 1..24: mol_type = other RNA
ggcggcaccctaaacaactacgca

SEQ ID NO: 60268 - RNA, 24 nt, synthetic construct
  misc_feature 1..24: note = derived and/or modified sequence opt11 from anti-influenza_CDR
  source 1..24: mol_type = other RNA
atctcccccatcttcggcaccctc

SEQ ID NO: 60269 - RNA, 24 nt, synthetic construct
  misc_feature 1..24: note = derived and/or modified sequence opt11 from anti-influenza_CDR
  source 1..24: mol_type = other RNA
ggcgtgttctttagctcgcacgcg

SEQ ID NO: 60270 - RNA, 24 nt, synthetic construct
  misc_feature 1..24: note = derived and/or modified sequence opt11 from anti-influenza_CDR
  source 1..24: mol_type = other RNA
atctcccccatgttcggcaccacc

SEQ ID NO: 60271 - RNA, 24 nt, synthetic construct
  misc_feature 1..24: note = derived and/or modified sequence opt11 from anti-influenza_CDR
  source 1..24: mol_type = other RNA
ggcttcaccttctcccgcttcggc

SEQ ID NO: 60272 - RNA, 24 nt, synthetic construct
  misc_feature 1..24: note = derived and/or modified sequence opt11 from anti-influenza_CDR
  source 1..24: mol_type = other RNA
atctggtacgacggctcgaacaag

SEQ ID NO: 60273 - RNA, 24 nt, synthetic construct
  misc_feature 1..24: note = derived and/or modified sequence opt11 from anti-influenza_CDR
  source 1..24: mol_type = other RNA
caaacgtacgggggcgtgagcacg

SEQ ID NO: 60274 - RNA, 24 nt, synthetic construct
  misc_feature 1..24: note = derived and/or modified sequence opt11 from anti-influenza_CDR
  source 1..24: mol_type = other RNA
gactcggccgggaataggcattcg

SEQ ID NO: 60275 - RNA, 24 nt, synthetic construct
  misc_feature 1..24: note = derived and/or modified sequence opt11 from anti-influenza_CDR
  source 1..24: mol_type = other RNA
tttcgcgggggcaatagcttgagc

SEQ ID NO: 60276 - RNA, 24 nt, synthetic construct
  misc_feature 1..24: note = derived and/or modified sequence opt11 from anti-influenza_CDR
  source 1..24: mol_type = other RNA
ggctacaccttcaccacctactgg

SEQ ID NO: 60277 - RNA, 24 nt, synthetic construct
  misc_feature 1..24: note = derived and/or modified sequence opt11 from anti-influenza_CDR
  source 1..24: mol_type = other RNA
atagacccctacgactccgaaacc

SEQ ID NO: 60278 - RNA, 24 nt, synthetic construct
  misc_feature 1..24: note = derived and/or modified sequence opt11 from anti-influenza_CDR
  source 1..24: mol_type = other RNA
atccgcaaattcctgaactggtac

SEQ ID NO: 60279 - RNA, 24 nt, synthetic construct
  misc_feature 1..24: note = derived and/or modified sequence opt11 from anti-influenza_CDR
  source 1..24: mol_type = other RNA
caacaatacgacggcctccccttc

SEQ ID NO: 60280 - RNA, 24 nt, synthetic construct
  misc_feature 1..24: note = derived and/or modified sequence opt11 from anti-influenza_CDR
  source 1..24: mol_type = other RNA
atacgcaacagcctgaactggtac

SEQ ID NO: 60281 - RNA, 24 nt, synthetic construct
  misc_feature 1..24: note = derived and/or modified sequence opt11 from anti-influenza_CDR
  source 1..24: mol_type = other RNA
caacaagccaactccttccccctc

SEQ ID NO: 60282 - RNA, 24 nt, synthetic construct
  misc_feature 1..24: note = derived and/or modified sequence opt11 from anti-influenza_CDR
  source 1..24: mol_type = other RNA
tcactcctgaccgaagtcgaaacc

SEQ ID NO: 60283 - RNA, 24 nt, synthetic construct
  misc_feature 1..24: note = derived and/or modified sequence opt11 from anti-influenza_CDR
  source 1..24: mol_type = other RNA
caacaatcctactccatgcccgcc

SEQ ID NO: 60284 - RNA, 24 nt, synthetic construct
  misc_feature 1..24: note = derived and/or modified sequence opt11 from anti-influenza_CDR
  source 1..24: mol_type = other RNA
ggggggccggtgagtggggggggg

SEQ ID NO: 60285 - RNA, 24 nt, synthetic construct
  misc_feature 1..24: note = derived and/or modified sequence opt11 from anti-influenza_CDR
  source 1..24: mol_type = other RNA
caacaatccttctccgtccccgcc

SEQ ID NO: 60286 - RNA, 24 nt, synthetic construct
  misc_feature 1..24: note = derived and/or modified sequence opt11 from anti-influenza_CDR
  source 1..24: mol_type = other RNA
caacaaacctactccatccccctc

SEQ ID NO: 60287 - RNA, 24 nt, synthetic construct
  misc_feature 1..24: note = derived and/or modified sequence opt11 from anti-influenza_CDR
  source 1..24: mol_type = other RNA
caacaatcctactccgtccccgcc

SEQ ID NO: 60288 - RNA, 24 nt, synthetic construct
  misc_feature 1..24: note = derived and/or modified sequence opt11 from anti-influenza_CDR
  source 1..24: mol_type = other RNA
caacaaaccttctccatccccctc

SEQ ID NO: 60289 - RNA, 24 nt, synthetic construct
  misc_feature 1..24: note = derived and/or modified sequence opt11 from anti-influenza_CDR
  source 1..24: mol_type = other RNA
ggcgatagcataacctcgggcgcg

SEQ ID NO: 60290 - RNA, 24 nt, synthetic construct
  misc_feature 1..24: note = derived and/or modified sequence opt11 from anti-influenza_CDR
  source 1..24: mol_type = other RNA
caagcgtgggatagctcgaccgcg

SEQ ID NO: 60291 - RNA, 24 nt, synthetic construct
  misc_feature 1..24: note = derived and/or modified sequence opt11 from anti-influenza_CDR
  source 1..24: mol_type = other RNA
caacagtacgggagctcgctctgg

SEQ ID NO: 60292 - RNA, 24 nt, synthetic construct
  misc_feature 1..24: note = derived and/or modified sequence opt11 from anti-influenza_CDR
  source 1..24: mol_type = other RNA
gcatacggctacacattcgacccc

SEQ ID NO: 60293 - RNA, 24 nt, synthetic construct
  misc_feature 1..24: note = derived and/or modified sequence opt11 from anti-influenza_CDR
  source 1..24: mol_type = other RNA
atgcaagccctccaaacccccctc

SEQ ID NO: 60294 - RNA, 24 nt, synthetic construct
  misc_feature 1..24: note = derived and/or modified sequence opt11 from anti-influenza_CDR
  source 1..24: mol_type = other RNA
caacaatacggctcctccctcacc

SEQ ID NO: 60295 - RNA, 24 nt, synthetic construct
  misc_feature 1..24: note = derived and/or modified sequence opt11 from anti-influenza_CDR
  source 1..24: mol_type = other RNA
caaaaatacaactccgccccctcc

SEQ ID NO: 60296 - RNA, 24 nt, synthetic construct
  misc_feature 1..24: note = derived and/or modified sequence opt11 from anti-influenza_CDR
  source 1..24: mol_type = other RNA
caacagcgctcgaactggctcaaa

SEQ ID NO: 60297 - RNA, 24 nt, synthetic construct
  misc_feature 1..24: note = derived and/or modified sequence opt11 from anti-influenza_CDR
  source 1..24: mol_type = other RNA
agctcgcaatcgcgctcgagcacg

SEQ ID NO: 60298 - RNA, 24 nt, synthetic construct
  misc_feature 1..24: note = derived and/or modified sequence opt11 from anti-influenza_CDR
  source 1..24: mol_type = other RNA
ccctacgacgtccccgactacgaa

SEQ ID NO: 60299 - RNA, 24 nt, synthetic construct
  misc_feature 1..24: note = derived and/or modified sequence opt11 from anti-influenza_CDR
  source 1..24: mol_type = other RNA
ccctacgacgtccccgactacgcc

SEQ ID NO: 60300 - RNA, 24 nt, synthetic construct
  misc_feature 1..24: note = derived and/or modified sequence opt11 from anti-influenza_CDR
  source 1..24: mol_type = other RNA
cccggcgacttcaacgactacgaa

SEQ ID NO: 60301 - RNA, 24 nt, synthetic construct
  misc_feature 1..24: note = derived and/or modified sequence opt11 from anti-influenza_CDR
  source 1..24: mol_type = other RNA
ccgaaagtacgcgatcaagagagc

SEQ ID NO: 60302 - RNA, 24 nt, synthetic construct
  misc_feature 1..24: note = derived and/or modified sequence opt11 from anti-influenza_CDR
  source 1..24: mol_type = other RNA
acctcctacacctcctccaacacc

SEQ ID NO: 60303 - RNA, 24 nt, synthetic construct
  misc_feature 1..24: note = derived and/or modified sequence opt11 from anti-influenza_CDR
  source 1..24: mol_type = other RNA
ggcgggaactttaacaattacgcg

SEQ ID NO: 60304 - RNA, 24 nt, synthetic construct
  misc_feature 1..24: note = derived and/or modified sequence opt11 from anti-influenza_CDR
  source 1..24: mol_type = other RNA
atctcccccatcttcggctccacc

SEQ ID NO: 60305 - RNA, 24 nt, synthetic construct
  misc_feature 1..24: note = derived and/or modified sequence opt11 from anti-influenza_CDR
  source 1..24: mol_type = other RNA
tcctcctacacctcctccaacacc

SEQ ID NO: 60306 - RNA, 24 nt, synthetic construct
  misc_feature 1..24: note = derived and/or modified sequence opt11 from anti-influenza_CDR
  source 1..24: mol_type = other RNA
ggcgggacctttaacaattacgcg

SEQ ID NO: 60307 - RNA, 24 nt, synthetic construct
  misc_feature 1..24: note = derived and/or modified sequence opt11 from anti-influenza_CDR
  source 1..24: mol_type = other RNA
atctcccccatcttcggctccgtc

SEQ ID NO: 60308 - RNA, 24 nt, synthetic construct
  misc_feature 1..24: note = derived and/or modified sequence opt11 from anti-influenza_CDR
  source 1..24: mol_type = other RNA
tcctccaacatcggccacaacttc

SEQ ID NO: 60309 - RNA, 24 nt, synthetic construct
  misc_feature 1..24: note = derived and/or modified sequence opt11 from anti-influenza_CDR
  source 1..24: mol_type = other RNA
ggcacgtgggatagctcgctctcg

SEQ ID NO: 60310 - RNA, 24 nt, synthetic construct
  misc_feature 1..24: note = derived and/or modified sequence opt11 from anti-influenza_CDR
  source 1..24: mol_type = other RNA
ggcgggatcatacgcaagtacgcg

SEQ ID NO: 60311 - RNA, 24 nt, synthetic construct
  misc_feature 1..24: note = derived and/or modified sequence opt11 from anti-influenza_CDR
  source 1..24: mol_type = other RNA
ataatcgccatcttcaacaccgcc

SEQ ID NO: 60312 - RNA, 24 nt, synthetic construct
  misc_feature 1..24: note = derived and/or modified sequence opt11 from anti-influenza_CDR
  source 1..24: mol_type = other RNA
ggctacaccttcaccgcctacaca

SEQ ID NO: 60313 - RNA, 24 nt, synthetic construct
  misc_feature 1..24: note = derived and/or modified sequence opt11 from anti-influenza_CDR
  source 1..24: mol_type = other RNA
ataaacgcaggcaacggccacacc

SEQ ID NO: 60314 - RNA, 24 nt, synthetic construct
  misc_feature 1..24: note = derived and/or modified sequence opt11 from anti-influenza_CDR
  source 1..24: mol_type = other RNA
ggcggcaccttcatcaactacgca

SEQ ID NO: 60315 - RNA, 24 nt, synthetic construct
  misc_feature 1..24: note = derived and/or modified sequence opt11 from anti-influenza_CDR
  source 1..24: mol_type = other RNA
atcatccccgtctacggcacctcc

SEQ ID NO: 60316 - RNA, 24 nt, synthetic construct
  misc_feature 1..24: note = derived and/or modified sequence opt11 from anti-influenza_CDR
  source 1..24: mol_type = other RNA
ggcttcaccttccgctcacacgca

SEQ ID NO: 60317 - RNA, 24 nt, synthetic construct
  misc_feature 1..24: note = derived and/or modified sequence opt11 from anti-influenza_CDR
  source 1..24: mol_type = other RNA
atctcgtacgacgaagtgaacaag

SEQ ID NO: 60318 - RNA, 24 nt, synthetic construct
  misc_feature 1..24: note = derived and/or modified sequence opt11 from anti-influenza_CDR
  source 1..24: mol_type = other RNA
ggctacaacttcgccgcctactat

SEQ ID NO: 60319 - RNA, 24 nt, synthetic construct
  misc_feature 1..24: note = derived and/or modified sequence opt11 from anti-influenza_CDR
  source 1..24: mol_type = other RNA
tcaaatccaaacaccggcggcgcc

SEQ ID NO: 60320 - RNA, 24 nt, synthetic construct
  misc_feature 1..24: note = derived and/or modified sequence opt11 from anti-influenza_CDR
  source 1..24: mol_type = other RNA
ggctacaccctcatcgactactat

SEQ ID NO: 60321 - RNA, 24 nt, synthetic construct
  misc_feature 1..24: note = derived and/or modified sequence opt11 from anti-influenza_CDR
  source 1..24: mol_type = other RNA
atcaacccaatcaacggcggcacc

SEQ ID NO: 60322 - RNA, 24 nt, synthetic construct
  misc_feature 1..24: note = derived and/or modified sequence opt11 from anti-influenza_CDR
  source 1..24: mol_type = other RNA
ggcttcaccttctccgcctacgca

SEQ ID NO: 60323 - RNA, 24 nt, synthetic construct
  misc_feature 1..24: note = derived and/or modified sequence opt11 from anti-influenza_CDR
  source 1..24: mol_type = other RNA
acgagctatgacgggcgcgatagc

SEQ ID NO: 60324 - RNA, 24 nt, synthetic construct
  misc_feature 1..24: note = derived and/or modified sequence opt11 from anti-influenza_CDR
  source 1..24: mol_type = other RNA
ggcttcaccttcaccaactacgcc

SEQ ID NO: 60325 - RNA, 24 nt, synthetic construct
  misc_feature 1..24: note = derived and/or modified sequence opt11 from anti-influenza_CDR
  source 1..24: mol_type = other RNA
atcagcttcgacgaagacaacaaa

SEQ ID NO: 60326 - RNA, 24 nt, synthetic construct
  misc_feature 1..24: note = derived and/or modified sequence opt11 from anti-influenza_CDR
  source 1..24: mol_type = other RNA
ggctttaactttagctcgtacggg

SEQ ID NO: 60327 - RNA, 24 nt, synthetic construct
  misc_feature 1..24: note = derived and/or modified sequence opt11 from anti-influenza_CDR
  source 1..24: mol_type = other RNA
atatggagcgggggatcgaacaag

SEQ ID NO: 60328 - RNA, 24 nt, synthetic construct
  misc_feature 1..24: note = derived and/or modified sequence opt11 from anti-influenza_CDR
  source 1..24: mol_type = other RNA
ggctttatctttggcgacttcgcg

SEQ ID NO: 60329 - RNA, 24 nt, synthetic construct
  misc_feature 1..24: note = derived and/or modified sequence opt11 from anti-influenza_CDR
  source 1..24: mol_type = other RNA
ggctttaactttgacgagtacgtg

SEQ ID NO: 60330 - RNA, 24 nt, synthetic construct
  misc_feature 1..24: note = derived and/or modified sequence opt11 from anti-influenza_CDR
  source 1..24: mol_type = other RNA
ataggggcggatgggagggggacg

SEQ ID NO: 60331 - RNA, 24 nt, synthetic construct
  misc_feature 1..24: note = derived and/or modified sequence opt11 from anti-influenza_CDR
  source 1..24: mol_type = other RNA
ggcgggagcgtgagcaattactat

SEQ ID NO: 60332 - RNA, 24 nt, synthetic construct
  misc_feature 1..24: note = derived and/or modified sequence opt11 from anti-influenza_CDR
  source 1..24: mol_type = other RNA
ggcgggacctttagctattacgcg

SEQ ID NO: 60333 - RNA, 24 nt, synthetic construct
  misc_feature 1..24: note = derived and/or modified sequence opt11 from anti-influenza_CDR
  source 1..24: mol_type = other RNA
ataatcccaatcgtcggcaccgcc

SEQ ID NO: 60334 - RNA, 24 nt, synthetic construct
  misc_feature 1..24: note = derived and/or modified sequence opt11 from anti-influenza_CDR
  source 1..24: mol_type = other RNA
acctccaacatcggctccaacacc

SEQ ID NO: 60335 - RNA, 24 nt, synthetic construct
  misc_feature 1..24: note = derived and/or modified sequence opt11 from anti-influenza_CDR
  source 1..24: mol_type = other RNA
ggctacaacttccccaaatactgg

SEQ ID NO: 60336 - RNA, 24 nt, synthetic construct
  misc_feature 1..24: note = derived and/or modified sequence opt11 from anti-influenza_CDR
  source 1..24: mol_type = other RNA
atataccccggcgactccgacgtc

SEQ ID NO: 60337 - RNA, 24 nt, synthetic construct
  misc_feature 1..24: note = derived and/or modified sequence opt11 from anti-influenza_CDR
  source 1..24: mol_type = other RNA
ggccacaccttcatctcctacgcc

SEQ ID NO: 60338 - RNA, 24 nt, synthetic construct
  misc_feature 1..24: note = derived and/or modified sequence opt11 from anti-influenza_CDR
  source 1..24: mol_type = other RNA
atcgtccccatattcggcaccgtc

SEQ ID NO: 60339 - RNA, 24 nt, synthetic construct
  misc_feature 1..24: note = derived and/or modified sequence opt11 from anti-influenza_CDR
  source 1..24: mol_type = other RNA
ggcttcaccttccgcacatacgga

SEQ ID NO: 60340 - RNA, 24 nt, synthetic construct
  misc_feature 1..24: note = derived and/or modified sequence opt11 from anti-influenza_CDR
  source 1..24: mol_type = other RNA
atctcgtacgacggcacgaacaag

SEQ ID NO: 60341 - RNA, 24 nt, synthetic construct
  misc_feature 1..24: note = derived and/or modified sequence opt11 from anti-influenza_CDR
  source 1..24: mol_type = other RNA
ggcttcaccttctcctcctacggc

SEQ ID NO: 60342 - RNA, 24 nt, synthetic construct
  misc_feature 1..24: note = derived and/or modified sequence opt11 from anti-influenza_CDR
  source 1..24: mol_type = other RNA
atcagctacgacgaaatcaacaaa

SEQ ID NO: 60343 - RNA, 24 nt, synthetic construct
  misc_feature 1..24: note = derived and/or modified sequence opt11 from anti-influenza_CDR
  source 1..24: mol_type = other RNA
gggttctcgctctggacatcggga

SEQ ID NO: 60344 - RNA, 24 nt, synthetic construct
  misc_feature 1..24: note = derived and/or modified sequence opt11 from anti-influenza_CDR
  source 1..24: mol_type = other RNA
atgagctacgacgagaccaaaaaa

SEQ ID NO: 60345 - RNA, 24 nt, synthetic construct
  misc_feature 1..24: note = derived and/or modified sequence opt11 from anti-influenza_CDR
  source 1..24: mol_type = other RNA
ggcttcaccttctcccgctactcc

SEQ ID NO: 60346 - RNA, 24 nt, synthetic construct
  misc_feature 1..24: note = derived and/or modified sequence opt11 from anti-influenza_CDR
  source 1..24: mol_type = other RNA
atatccgacacctcccgcacaatc

SEQ ID NO: 60347 - RNA, 24 nt, synthetic construct
  misc_feature 1..24: note = derived and/or modified sequence opt11 from anti-influenza_CDR
  source 1..24: mol_type = other RNA
ggcttcaccttcaactcctacgcc

SEQ ID NO: 60348 - RNA, 24 nt, synthetic construct
  misc_feature 1..24: note = derived and/or modified sequence opt11 from anti-influenza_CDR
  source 1..24: mol_type = other RNA
ataagggggtcgggggagaatacg

SEQ ID NO: 60349 - RNA, 24 nt, synthetic construct
  misc_feature 1..24: note = derived and/or modified sequence opt11 from anti-influenza_CDR
  source 1..24: mol_type = other RNA
ggcttcaccttctcccgcttctcc

SEQ ID NO: 60350 - RNA, 24 nt, synthetic construct
  misc_feature 1..24: note = derived and/or modified sequence opt11 from anti-influenza_CDR
  source 1..24: mol_type = other RNA
atatccgacaccggccgcacaatc

SEQ ID NO: 60351 - RNA, 24 nt, synthetic construct
  misc_feature 1..24: note = derived and/or modified sequence opt11 from anti-influenza_CDR
  source 1..24: mol_type = other RNA
ggggactcgttcacgagctattgg

SEQ ID NO: 60352 - RNA, 24 nt, synthetic construct
  misc_feature 1..24: note = derived and/or modified sequence opt11 from anti-influenza_CDR
  source 1..24: mol_type = other RNA
atatacccacgcgactccgaaacc

SEQ ID NO: 60353 - RNA, 24 nt, synthetic construct
  misc_feature 1..24: note = derived and/or modified sequence opt11 from anti-influenza_CDR
  source 1..24: mol_type = other RNA
ggctacacattcaccgcctaccat

SEQ ID NO: 60354 - RNA, 24 nt, synthetic construct
  misc_feature 1..24: note = derived and/or modified sequence opt11 from anti-influenza_CDR
  source 1..24: mol_type = other RNA
ataaacccaaactccggcgccacc

SEQ ID NO: 60355 - RNA, 24 nt, synthetic construct
  misc_feature 1..24: note = derived and/or modified sequence opt11 from anti-influenza_CDR
  source 1..24: mol_type = other RNA
ggcttcaccttctccgactactgg

SEQ ID NO: 60356 - RNA, 24 nt, synthetic construct
  misc_feature 1..24: note = derived and/or modified sequence opt11 from anti-influenza_CDR
  source 1..24: mol_type = other RNA
atctcctccgacggctccaccacc

SEQ ID NO: 60357 - RNA, 24 nt, synthetic construct
  misc_feature 1..24: note = derived and/or modified sequence opt11 from anti-influenza_CDR
  source 1..24: mol_type = other RNA
gggttctcgttctcgaacgcgtgg

SEQ ID NO: 60358 - RNA, 24 nt, synthetic construct
  misc_feature 1..24: note = derived and/or modified sequence opt11 from anti-influenza_CDR
  source 1..24: mol_type = other RNA
gggctaacgttctcgaacgcgtgg

SEQ ID NO: 60359 - RNA, 24 nt, synthetic construct
  misc_feature 1..24: note = derived and/or modified sequence opt11 from anti-influenza_CDR
  source 1..24: mol_type = other RNA
gggttcacgttctcgaacgcgtgg

SEQ ID NO: 60360 - RNA, 24 nt, synthetic construct
  misc_feature 1..24: note = derived and/or modified sequence opt11 from anti-influenza_CDR
  source 1..24: mol_type = other RNA
ggcctatcattcctcaacgcctgg

SEQ ID NO: 60361 - RNA, 24 nt, synthetic construct
  misc_feature 1..24: note = derived and/or modified sequence opt11 from anti-influenza_CDR
  source 1..24: mol_type = other RNA
gggttctcgttcttgaacgcgtgg

SEQ ID NO: 60362 - RNA, 24 nt, synthetic construct
  misc_feature 1..24: note = derived and/or modified sequence opt11 from anti-influenza_CDR
  source 1..24: mol_type = other RNA
gggctaacgttcttgaacgcgtgg

SEQ ID NO: 60363 - RNA, 24 nt, synthetic construct
  misc_feature 1..24: note = derived and/or modified sequence opt11 from anti-influenza_CDR
  source 1..24: mol_type = other RNA
gggttcacgttcttgaacgcgtgg

SEQ ID NO: 60364 - RNA, 24 nt, synthetic construct
  misc_feature 1..24: note = derived and/or modified sequence opt11 from anti-influenza_CDR
  source 1..24: mol_type = other RNA
ggctacacattcaccgactactat

SEQ ID NO: 60365 - RNA, 24 nt, synthetic construct
  misc_feature 1..24: note = derived and/or modified sequence opt11 from anti-influenza_CDR
  source 1..24: mol_type = other RNA
gtgaacccgtactcgggcgggacc

SEQ ID NO: 60366 - RNA, 24 nt, synthetic construct
  misc_feature 1..24: note = derived and/or modified sequence opt11 from anti-influenza_CDR
  source 1..24: mol_type = other RNA
ggctacaccttcaccgactacaac

SEQ ID NO: 60367 - RNA, 24 nt, synthetic construct
  misc_feature 1..24: note = derived and/or modified sequence opt11 from anti-influenza_CDR
  source 1..24: mol_type = other RNA
atatacccaaacaacggcggcacc

SEQ ID NO: 60368 - RNA, 24 nt, synthetic construct
  misc_feature 1..24: note = derived and/or modified sequence opt11 from anti-influenza_CDR
  source 1..24: mol_type = other RNA
ggctacacattcaccggctacaac

SEQ ID NO: 60369 - RNA, 24 nt, synthetic construct
  misc_feature 1..24: note = derived and/or modified sequence opt11 from anti-influenza_CDR
  source 1..24: mol_type = other RNA
atatacccaaacaacggcgtcacc

SEQ ID NO: 60370 - RNA, 24 nt, synthetic construct
  misc_feature 1..24: note = derived and/or modified sequence opt11 from anti-influenza_CDR
  source 1..24: mol_type = other RNA
atggaaacggacacgctcctgctc

SEQ ID NO: 60371 - RNA, 27 nt, synthetic construct
  misc_feature 1..27: note = derived and/or modified sequence opt11 from anti-influenza_CDR
  source 1..27: mol_type = other RNA
gatggcgtgaccaataaagtgaactcg

SEQ ID NO: 60372 - RNA, 27 nt, synthetic construct
  misc_feature 1..27: note = derived and/or modified sequence opt11 from anti-influenza_CDR
  source 1..27: mol_type = other RNA
ggctcggacgtgggctcgagcaatcta

SEQ ID NO: 60373 - RNA, 27 nt, synthetic construct
  misc_feature 1..27: note = derived and/or modified sequence opt11 from anti-influenza_CDR
  source 1..27: mol_type = other RNA
atgcaaaacatcctcctccccctcacc

SEQ ID NO: 60374 - RNA, 27 nt, synthetic construct
  misc_feature 1..27: note = derived and/or modified sequence opt11 from anti-influenza_CDR
  source 1..27: mol_type = other RNA
atgcaatccctccaactccccctcacc

SEQ ID NO: 60375 - RNA, 27 nt, synthetic construct
  misc_feature 1..27: note = derived and/or modified sequence opt11 from anti-influenza_CDR
  source 1..27: mol_type = other RNA
caacaacactaccgcaccccccccacc

SEQ ID NO: 60376 - RNA, 27 nt, synthetic construct
  misc_feature 1..27: note = derived and/or modified sequence opt11 from anti-influenza_CDR
  source 1..27: mol_type = other RNA
caacaatacggcaactccccctacacc

SEQ ID NO: 60377 - RNA, 27 nt, synthetic construct
  misc_feature 1..27: note = derived and/or modified sequence opt11 from anti-influenza_CDR
  source 1..27: mol_type = other RNA
caacaatacggctcctccccctacacc

SEQ ID NO: 60378 - RNA, 27 nt, synthetic construct
  misc_feature 1..27: note = derived and/or modified sequence opt11 from anti-influenza_CDR
  source 1..27: mol_type = other RNA
caacaatacggcacctcaccccaaacc

SEQ ID NO: 60379 - RNA, 27 nt, synthetic construct
  misc_feature 1..27: note = derived and/or modified sequence opt11 from anti-influenza_CDR
  source 1..27: mol_type = other RNA
caacaatacggctacctacccctcacc

SEQ ID NO: 60380 - RNA, 27 nt, synthetic construct
  misc_feature 1..27: note = derived and/or modified sequence opt11 from anti-influenza_CDR
  source 1..27: mol_type = other RNA
caagcgtgggatagctcgaccgcggtc

SEQ ID NO: 60381 - RNA, 27 nt, synthetic construct
  misc_feature 1..27: note = derived and/or modified sequence opt11 from anti-influenza_CDR
  source 1..27: mol_type = other RNA
cagcactataacgcgtactggggcaca

SEQ ID NO: 60382 - RNA, 27 nt, synthetic construct
  misc_feature 1..27: note = derived and/or modified sequence opt11 from anti-influenza_CDR
  source 1..27: mol_type = other RNA
caacaaacctactcctccccccccacc

SEQ ID NO: 60383 - RNA, 27 nt, synthetic construct
  misc_feature 1..27: note = derived and/or modified sequence opt11 from anti-influenza_CDR
  source 1..27: mol_type = other RNA
caacaatactactccttcccctacacc

SEQ ID NO: 60384 - RNA, 27 nt, synthetic construct
  misc_feature 1..27: note = derived and/or modified sequence opt11 from anti-influenza_CDR
  source 1..27: mol_type = other RNA
atgcaagcactccagctcccgctcgcg

SEQ ID NO: 60385 - RNA, 27 nt, synthetic construct
  misc_feature 1..27: note = derived and/or modified sequence opt11 from anti-influenza_CDR
  source 1..27: mol_type = other RNA
caacaagccaactccttccccttcacc

SEQ ID NO: 60386 - RNA, 27 nt, synthetic construct
  misc_feature 1..27: note = derived and/or modified sequence opt11 from anti-influenza_CDR
  source 1..27: mol_type = other RNA
caacaactcaacggctaccccctcacc

SEQ ID NO: 60387 - RNA, 27 nt, synthetic construct
  misc_feature 1..27: note = derived and/or modified sequence opt11 from anti-influenza_CDR
  source 1..27: mol_type = other RNA
atgcaagccctccaaaccccactcacc

SEQ ID NO: 60388 - RNA, 27 nt, synthetic construct
  misc_feature 1..27: note = derived and/or modified sequence opt11 from anti-influenza_CDR
  source 1..27: mol_type = other RNA
caacaaaactacaactggcccctcacc

SEQ ID NO: 60389 - RNA, 27 nt, synthetic construct
  misc_feature 1..27: note = derived and/or modified sequence opt11 from anti-influenza_CDR
  source 1..27: mol_type = other RNA
caacaatacgacacctcatccggcctc

SEQ ID NO: 60390 - RNA, 27 nt, synthetic construct
  misc_feature 1..27: note = derived and/or modified sequence opt11 from anti-influenza_CDR
  source 1..27: mol_type = other RNA
caacaatacaactcctggccccgcacc

SEQ ID NO: 60391 - RNA, 27 nt, synthetic construct
  misc_feature 1..27: note = derived and/or modified sequence opt11 from anti-influenza_CDR
  source 1..27: mol_type = other RNA
gtcatatactcgcacgggcgcgcgtac

SEQ ID NO: 60392 - RNA, 27 nt, synthetic construct
  misc_feature 1..27: note = derived and/or modified sequence opt11 from anti-influenza_CDR
  source 1..27: mol_type = other RNA
caacaatacggcgactcccgctacacc

SEQ ID NO: 60393 - RNA, 27 nt, synthetic construct
  misc_feature 1..27: note = derived and/or modified sequence opt11 from anti-influenza_CDR
  source 1..27: mol_type = other RNA
ctccaacacaactcctacccctacacc

SEQ ID NO: 60394 - RNA, 27 nt, synthetic construct
  misc_feature 1..27: note = derived and/or modified sequence opt11 from anti-influenza_CDR
  source 1..27: mol_type = other RNA
cgcaaaatgacgaccgcattcgacagc

SEQ ID NO: 60395 - RNA, 27 nt, synthetic construct
  misc_feature 1..27: note = derived and/or modified sequence opt11 from anti-influenza_CDR
  source 1..27: mol_type = other RNA
cagcgcaatcactcgccctcatggaca

SEQ ID NO: 60396 - RNA, 27 nt, synthetic construct
  misc_feature 1..27: note = derived and/or modified sequence opt11 from anti-influenza_CDR
  source 1..27: mol_type = other RNA
caacaatcctacgacaacccccaaacc

SEQ ID NO: 60397 - RNA, 27 nt, synthetic construct
  misc_feature 1..27: note = derived and/or modified sequence opt11 from anti-influenza_CDR
  source 1..27: mol_type = other RNA
caacaatcccgccgcctcccctacacc

SEQ ID NO: 60398 - RNA, 27 nt, synthetic construct
  misc_feature 1..27: note = derived and/or modified sequence opt11 from anti-influenza_CDR
  source 1..27: mol_type = other RNA
cgcaagatgacgaccgcgatcgattac

SEQ ID NO: 60399 - RNA, 27 nt, synthetic construct
  misc_feature 1..27: note = derived and/or modified sequence opt11 from anti-influenza_CDR
  source 1..27: mol_type = other RNA
atccgctacaccggccaacaactcctc

SEQ ID NO: 60400 - RNA, 27 nt, synthetic construct
  misc_feature 1..27: note = derived and/or modified sequence opt11 from anti-influenza_CDR
  source 1..27: mol_type = other RNA
caacactacggcaccatatcccaaacc

SEQ ID NO: 60401 - RNA, 27 nt, synthetic construct
  misc_feature 1..27: note = derived and/or modified sequence opt11 from anti-influenza_CDR
  source 1..27: mol_type = other RNA
caacaatactccacctccccccccacc

SEQ ID NO: 60402 - RNA, 27 nt, synthetic construct
  misc_feature 1..27: note = derived and/or modified sequence opt11 from anti-influenza_CDR
  source 1..27: mol_type = other RNA
caacaatacggcaactcacccatcacc

SEQ ID NO: 60403 - RNA, 27 nt, synthetic construct
  misc_feature 1..27: note = derived and/or modified sequence opt11 from anti-influenza_CDR
  source 1..27: mol_type = other RNA
caacaatactactcccgcccctacacc

SEQ ID NO: 60404 - RNA, 27 nt, synthetic construct
  misc_feature 1..27: note = derived and/or modified sequence opt11 from anti-influenza_CDR
  source 1..27: mol_type = other RNA
caggtgtgggataattttggcggggtc

SEQ ID NO: 60405 - RNA, 27 nt, synthetic construct
  misc_feature 1..27: note = derived and/or modified sequence opt11 from anti-influenza_CDR
  source 1..27: mol_type = other RNA
caacaatcctactcctcccccctcacc

SEQ ID NO: 60406 - RNA, 27 nt, synthetic construct
  misc_feature 1..27: note = derived and/or modified sequence opt11 from anti-influenza_CDR
  source 1..27: mol_type = other RNA
caacaatacttcgccaccccccgcacc

SEQ ID NO: 60407 - RNA, 27 nt, synthetic construct
  misc_feature 1..27: note = derived and/or modified sequence opt11 from anti-influenza_CDR
  source 1..27: mol_type = other RNA
caacaatactacttctcccccctcacc

SEQ ID NO: 60408 - RNA, 27 nt, synthetic construct
  misc_feature 1..27: note = derived and/or modified sequence opt11 from anti-influenza_CDR
  source 1..27: mol_type = other RNA
caacacttcggcacctccgtcttcacc

SEQ ID NO: 60409 - RNA, 27 nt, synthetic construct
  misc_feature 1..27: note = derived and/or modified sequence opt11 from anti-influenza_CDR
  source 1..27: mol_type = other RNA
caacaatactacaacgcccccctcacc

SEQ ID NO: 60410 - RNA, 27 nt, synthetic construct
  misc_feature 1..27: note = derived and/or modified sequence opt11 from anti-influenza_CDR
  source 1..27: mol_type = other RNA
gtcctcttcacctcccccttcgacttc

SEQ ID NO: 60411 - RNA, 27 nt, synthetic construct
  misc_feature 1..27: note = derived and/or modified sequence opt11 from anti-influenza_CDR
  source 1..27: mol_type = other RNA
ttgctctcgtactcgggcgtgtgggtg

SEQ ID NO: 60412 - RNA, 27 nt, synthetic construct
  misc_feature 1..27: note = derived and/or modified sequence opt11 from anti-influenza_CDR
  source 1..27: mol_type = other RNA
tttctctcgtactcgggcgcgtgggtg

SEQ ID NO: 60413 - RNA, 27 nt, synthetic construct
  misc_feature 1..27: note = derived and/or modified sequence opt11 from anti-influenza_CDR
  source 1..27: mol_type = other RNA
caacaatccttctccaaatcctggacc

SEQ ID NO: 60414 - RNA, 27 nt, synthetic construct
  misc_feature 1..27: note = derived and/or modified sequence opt11 from anti-influenza_CDR
  source 1..27: mol_type = other RNA
gtccaatacgtccaattcccctggacc

SEQ ID NO: 60415 - RNA, 27 nt, synthetic construct
  misc_feature 1..27: note = derived and/or modified sequence opt11 from anti-influenza_CDR
  source 1..27: mol_type = other RNA
caacaatcctactccccccccctcacc

SEQ ID NO: 60416 - RNA, 27 nt, synthetic construct
  misc_feature 1..27: note = derived and/or modified sequence opt11 from anti-influenza_CDR
  source 1..27: mol_type = other RNA
ttcatctactacggcggcaacaccaaa

SEQ ID NO: 60417 - RNA, 27 nt, synthetic construct
  misc_feature 1..27: note = derived and/or modified sequence opt11 from anti-influenza_CDR
  source 1..27: mol_type = other RNA
gtgatctatagcgggggctcgacctat

SEQ ID NO: 60418 - RNA, 27 nt, synthetic construct
  misc_feature 1..27: note = derived and/or modified sequence opt11 from anti-influenza_CDR
  source 1..27: mol_type = other RNA
ttcatgttccattccggctccccccgc

SEQ ID NO: 60419 - RNA, 27 nt, synthetic construct
  misc_feature 1..27: note = derived and/or modified sequence opt11 from anti-influenza_CDR
  source 1..27: mol_type = other RNA
caacaaacctactccacccccatcacc

SEQ ID NO: 60420 - RNA, 27 nt, synthetic construct
  misc_feature 1..27: note = derived and/or modified sequence opt11 from anti-influenza_CDR
  source 1..27: mol_type = other RNA
ttcttctacaacggcggctccaccaaa

SEQ ID NO: 60421 - RNA, 27 nt, synthetic construct
  misc_feature 1..27: note = derived and/or modified sequence opt11 from anti-influenza_CDR
  source 1..27: mol_type = other RNA
caacaatcctacaacacccccctcatc

SEQ ID NO: 60422 - RNA, 27 nt, synthetic construct
  misc_feature 1..27: note = derived and/or modified sequence opt11 from anti-influenza_CDR
  source 1..27: mol_type = other RNA
cacatatacgattacgggcgcacgttc

SEQ ID NO: 60423 - RNA, 27 nt, synthetic construct
  misc_feature 1..27: note = derived and/or modified sequence opt11 from anti-influenza_CDR
  source 1..27: mol_type = other RNA
gtcttctactccgaaacccgcacctac

SEQ ID NO: 60424 - RNA, 27 nt, synthetic construct
  misc_feature 1..27: note = derived and/or modified sequence opt11 from anti-influenza_CDR
  source 1..27: mol_type = other RNA
caagtgtgggggagctcgagcgatcac

SEQ ID NO: 60425 - RNA, 27 nt, synthetic construct
  misc_feature 1..27: note = derived and/or modified sequence opt11 from anti-influenza_CDR
  source 1..27: mol_type = other RNA
tacgtgtacaatcgcgggagcacgaaa

SEQ ID NO: 60426 - RNA, 27 nt, synthetic construct
  misc_feature 1..27: note = derived and/or modified sequence opt11 from anti-influenza_CDR
  source 1..27: mol_type = other RNA
tacatatacaaccgcgggagcacgaaa

SEQ ID NO: 60427 - RNA, 27 nt, synthetic construct
  misc_feature 1..27: note = derived and/or modified sequence opt11 from anti-influenza_CDR
  source 1..27: mol_type = other RNA
caacaatcctacaacacccccatcacc

SEQ ID NO: 60428 - RNA, 27 nt, synthetic construct
  misc_feature 1..27: note = derived and/or modified sequence opt11 from anti-influenza_CDR
  source 1..27: mol_type = other RNA
caacaatactactcctccccccccacc

SEQ ID NO: 60429 - RNA, 27 nt, synthetic construct
  misc_feature 1..27: note = derived and/or modified sequence opt11 from anti-influenza_CDR
  source 1..27: mol_type = other RNA
tacctctactactccggctccaccaaa

SEQ ID NO: 60430 - RNA, 27 nt, synthetic construct
  misc_feature 1..27: note = derived and/or modified sequence opt11 from anti-influenza_CDR
  source 1..27: mol_type = other RNA
caacaatcctactccccccccatcacc

SEQ ID NO: 60431 - RNA, 27 nt, synthetic construct
  misc_feature 1..27: note = derived and/or modified sequence opt11 from anti-influenza_CDR
  source 1..27: mol_type = other RNA
tacgtgtacaatagcgggaacacgaaa

SEQ ID NO: 60432 - RNA, 27 nt, synthetic construct
  misc_feature 1..27: note = derived and/or modified sequence opt11 from anti-influenza_CDR
  source 1..27: mol_type = other RNA
caacaatcctacaacacccccctcacc

SEQ ID NO: 60433 - RNA, 27 nt, synthetic construct
  misc_feature 1..27: note = derived and/or modified sequence opt11 from anti-influenza_CDR
  source 1..27: mol_type = other RNA
cacatattcgactccggatccacatac

SEQ ID NO: 60434 - RNA, 27 nt, synthetic construct
  misc_feature 1..27: note = derived and/or modified sequence opt11 from anti-influenza_CDR
  source 1..27: mol_type = other RNA
gtcttctactcagccgaccgcacctca

SEQ ID NO: 60435 - RNA, 27 nt, synthetic construct
  misc_feature 1..27: note = derived and/or modified sequence opt11 from anti-influenza_CDR
  source 1..27: mol_type = other RNA
caacaatactactccacccccctcacc

SEQ ID NO: 60436 - RNA, 27 nt, synthetic construct
  misc_feature 1..27: note = derived and/or modified sequence opt11 from anti-influenza_CDR
  source 1..27: mol_type = other RNA
tacatctactactccggcaacacctac

SEQ ID NO: 60437 - RNA, 27 nt, synthetic construct
  misc_feature 1..27: note = derived and/or modified sequence opt11 from anti-influenza_CDR
  source 1..27: mol_type = other RNA
caacaatcctactccacccccctcacc

SEQ ID NO: 60438 - RNA, 27 nt, synthetic construct
  misc_feature 1..27: note = derived and/or modified sequence opt11 from anti-influenza_CDR
  source 1..27: mol_type = other RNA
caacaatacggctcctcctccctcacc

SEQ ID NO: 60439 - RNA, 27 nt, synthetic construct
  misc_feature 1..27: note = derived and/or modified sequence opt11 from anti-influenza_CDR
  source 1..27: mol_type = other RNA
tcctcctacacctcctcctccacctac

SEQ ID NO: 60440 - RNA, 27 nt, synthetic construct
  misc_feature 1..27: note = derived and/or modified sequence opt11 from anti-influenza_CDR
  source 1..27: mol_type = other RNA
caacgctacaactccgccccccccatc

SEQ ID NO: 60441 - RNA, 27 nt, synthetic construct
  misc_feature 1..27: note = derived and/or modified sequence opt11 from anti-influenza_CDR
  source 1..27: mol_type = other RNA
caacaatacggccgcacacccctaacc

SEQ ID NO: 60442 - RNA, 27 nt, synthetic construct
  misc_feature 1..27: note = derived and/or modified sequence opt11 from anti-influenza_CDR
  source 1..27: mol_type = other RNA
caacaatacggctcctcaccccgcacc

SEQ ID NO: 60443 - RNA, 27 nt, synthetic construct
  misc_feature 1..27: note = derived and/or modified sequence opt11 from anti-influenza_CDR
  source 1..27: mol_type = other RNA
caacaatacggctcctcccccctcacc

SEQ ID NO: 60444 - RNA, 27 nt, synthetic construct
  misc_feature 1..27: note = derived and/or modified sequence opt11 from anti-influenza_CDR
  source 1..27: mol_type = other RNA
caagtgtgggatagctcgagcgatcac

SEQ ID NO: 60445 - RNA, 27 nt, synthetic construct
  misc_feature 1..27: note = derived and/or modified sequence opt11 from anti-influenza_CDR
  source 1..27: mol_type = other RNA
aaggagtttagtgaggtggaggggagg

SEQ ID NO: 60446 - RNA, 27 nt, synthetic construct
  misc_feature 1..27: note = derived and/or modified sequence opt11 from anti-influenza_CDR
  source 1..27: mol_type = other RNA
aaggagttcaataacctggagaagagg

SEQ ID NO: 60447 - RNA, 27 nt, synthetic construct
  misc_feature 1..27: note = derived and/or modified sequence opt11 from anti-influenza_CDR
  source 1..27: mol_type = other RNA
caacaacactaccgcacccccccctcc

SEQ ID NO: 60448 - RNA, 27 nt, synthetic construct
  misc_feature 1..27: note = derived and/or modified sequence opt11 from anti-influenza_CDR
  source 1..27: mol_type = other RNA
atgcaagccacccactggccactcaca

SEQ ID NO: 60449 - RNA, 27 nt, synthetic construct
  misc_feature 1..27: note = derived and/or modified sequence opt11 from anti-influenza_CDR
  source 1..27: mol_type = other RNA
caacaatactactcctacccctacacc

SEQ ID NO: 60450 - RNA, 27 nt, synthetic construct
  misc_feature 1..27: note = derived and/or modified sequence opt11 from anti-influenza_CDR
  source 1..27: mol_type = other RNA
agctcggacgtgggcgggtataattac

SEQ ID NO: 60451 - RNA, 27 nt, synthetic construct
  misc_feature 1..27: note = derived and/or modified sequence opt11 from anti-influenza_CDR
  source 1..27: mol_type = other RNA
agctcggacgtgggcgattacaattac

SEQ ID NO: 60452 - RNA, 27 nt, synthetic construct
  misc_feature 1..27: note = derived and/or modified sequence opt11 from anti-influenza_CDR
  source 1..27: mol_type = other RNA
caacaatacaacaactggcccctctcc

SEQ ID NO: 60453 - RNA, 27 nt, synthetic construct
  misc_feature 1..27: note = derived and/or modified sequence opt11 from anti-influenza_CDR
  source 1..27: mol_type = other RNA
caacaatcctacaactacccccgcacc

SEQ ID NO: 60454 - RNA, 27 nt, synthetic construct
  misc_feature 1..27: note = derived and/or modified sequence opt11 from anti-influenza_CDR
  source 1..27: mol_type = other RNA
atgcaaggcctccagaccccatacaca

SEQ ID NO: 60455 - RNA, 27 nt, synthetic construct
  misc_feature 1..27: note = derived and/or modified sequence opt11 from anti-influenza_CDR
  source 1..27: mol_type = other RNA
caacaacactactccatccccctcacc

SEQ ID NO: 60456 - RNA, 27 nt, synthetic construct
  misc_feature 1..27: note = derived and/or modified sequence opt11 from anti-influenza_CDR
  source 1..27: mol_type = other RNA
ctccaacacaactcctacccctggacc

SEQ ID NO: 60457 - RNA, 27 nt, synthetic construct
  misc_feature 1..27: note = derived and/or modified sequence opt11 from anti-influenza_CDR
  source 1..27: mol_type = other RNA
caacaatacaacacctggcccctcacc

SEQ ID NO: 60458 - RNA, 27 nt, synthetic construct
  misc_feature 1..27: note = derived and/or modified sequence opt11 from anti-influenza_CDR
  source 1..27: mol_type = other RNA
caacaatacaactccttcccctaccgc

SEQ ID NO: 60459 - RNA, 27 nt, synthetic construct
  misc_feature 1..27: note = derived and/or modified sequence opt11 from anti-influenza_CDR
  source 1..27: mol_type = other RNA
caacaatcctactccgcccccttcacc

SEQ ID NO: 60460 - RNA, 27 nt, synthetic construct
  misc_feature 1..27: note = derived and/or modified sequence opt11 from anti-influenza_CDR
  source 1..27: mol_type = other RNA
caagcgtgggatagctcgaccgtggtc

SEQ ID NO: 60461 - RNA, 27 nt, synthetic construct
  misc_feature 1..27: note = derived and/or modified sequence opt11 from anti-influenza_CDR
  source 1..27: mol_type = other RNA
caagcgtgggatagcacgaccgtggtc

SEQ ID NO: 60462 - RNA, 27 nt, synthetic construct
  misc_feature 1..27: note = derived and/or modified sequence opt11 from anti-influenza_CDR
  source 1..27: mol_type = other RNA
ctccaatacggctcctccccccgcacc

SEQ ID NO: 60463 - RNA, 27 nt, synthetic construct
  misc_feature 1..27: note = derived and/or modified sequence opt11 from anti-influenza_CDR
  source 1..27: mol_type = other RNA
agctcggacgtgggcgggtatgattac

SEQ ID NO: 60464 - RNA, 27 nt, synthetic construct
  misc_feature 1..27: note = derived and/or modified sequence opt11 from anti-influenza_CDR
  source 1..27: mol_type = other RNA
caacaatacacctactggcccctcacc

SEQ ID NO: 60465 - RNA, 27 nt, synthetic construct
  misc_feature 1..27: note = derived and/or modified sequence opt11 from anti-influenza_CDR
  source 1..27: mol_type = other RNA
caacaatacgacaaatggccccccggc

SEQ ID NO: 60466 - RNA, 27 nt, synthetic construct
  misc_feature 1..27: note = derived and/or modified sequence opt11 from anti-influenza_CDR
  source 1..27: mol_type = other RNA
atgcaatccctccaaacctccatcacc

SEQ ID NO: 60467 - RNA, 27 nt, synthetic construct
  misc_feature 1..27: note = derived and/or modified sequence opt11 from anti-influenza_CDR
  source 1..27: mol_type = other RNA
agccagatcgagctcgcggtcttgctc

SEQ ID NO: 60468 - RNA, 27 nt, synthetic construct
  misc_feature 1..27: note = derived and/or modified sequence opt11 from anti-influenza_CDR
  source 1..27: mol_type = other RNA
atgcaagcactccagaccccatacaca

SEQ ID NO: 60469 - RNA, 27 nt, synthetic construct
  misc_feature 1..27: note = derived and/or modified sequence opt11 from anti-influenza_CDR
  source 1..27: mol_type = other RNA
caacaacgctcccactggccccccatc

SEQ ID NO: 60470 - RNA, 27 nt, synthetic construct
  misc_feature 1..27: note = derived and/or modified sequence opt11 from anti-influenza_CDR
  source 1..27: mol_type = other RNA
caacacttctggggcacccccctcacc

SEQ ID NO: 60471 - RNA, 27 nt, synthetic construct
  misc_feature 1..27: note = derived and/or modified sequence opt11 from anti-influenza_CDR
  source 1..27: mol_type = other RNA
caacaaaactacgaagacccctggacc

SEQ ID NO: 60472 - RNA, 27 nt, synthetic construct
  misc_feature 1..27: note = derived and/or modified sequence opt11 from anti-influenza_CDR
  source 1..27: mol_type = other RNA
caacaagccaactccttcccccccacc

SEQ ID NO: 60473 - RNA, 27 nt, synthetic construct
  misc_feature 1..27: note = derived and/or modified sequence opt11 from anti-influenza_CDR
  source 1..27: mol_type = other RNA
caacaacgcgaccactggcccccaatc

SEQ ID NO: 60474 - RNA, 27 nt, synthetic construct
  misc_feature 1..27: note = derived and/or modified sequence opt11 from anti-influenza_CDR
  source 1..27: mol_type = other RNA
atggactcccgcctcaacctcgtcttc

SEQ ID NO: 60475 - RNA, 27 nt, synthetic construct
  misc_feature 1..27: note = derived and/or modified sequence opt11 from anti-influenza_CDR
  source 1..27: mol_type = other RNA
atgaaattgcccgtgcgcttgctcgtg

SEQ ID NO: 60476 - RNA, 30 nt, synthetic construct
  misc_feature 1..30: note = derived and/or modified sequence opt11 from anti-influenza_CDR
  source 1..30: mol_type = other RNA
ggggatagtgtgacgaggggggggttttat

SEQ ID NO: 60477 - RNA, 30 nt, synthetic construct; identical to SEQ ID NO: 52835
  misc_feature 1..30: note = derived and/or modified sequence opt11 from anti-influenza_CDR
  source 1..30: mol_type = other RNA

SEQ ID NO: 60478 - RNA, 30 nt, synthetic construct; identical to SEQ ID NO: 52836
  misc_feature 1..30: note = derived and/or modified sequence opt11 from anti-influenza_CDR
  source 1..30: mol_type = other RNA

SEQ ID NO: 60479 - RNA, 30 nt, synthetic construct
  misc_feature 1..30: note = derived and/or modified sequence opt11 from anti-influenza_CDR
  source 1..30: mol_type = other RNA
cgcgcccaatccctctcctcctacctccac

SEQ ID NO: 60480 - RNA, 30 nt, synthetic construct; identical to SEQ ID NO: 22270
  misc_feature 1..30: note = derived and/or modified sequence opt11 from anti-influenza_CDR
  source 1..30: mol_type = other RNA

SEQ ID NO: 60481 - RNA, 30 nt, synthetic construct
  misc_feature 1..30: note = derived and/or modified sequence opt11 from anti-influenza_CDR
  source 1..30: mol_type = other RNA
caacgctacaactccgccccccccatcacc

SEQ ID NO: 60482 - RNA, 30 nt, synthetic construct
  misc_feature 1..30: note = derived and/or modified sequence opt11 from anti-influenza_CDR
  source 1..30: mol_type = other RNA
ggcggctccatatcctccggcacctactac

SEQ ID NO: 60483 - RNA, 30 nt, synthetic construct
  misc_feature 1..30: note = derived and/or modified sequence opt11 from anti-influenza_CDR
  source 1..30: mol_type = other RNA
caacagagctatagctcgctcatgttcacg

SEQ ID NO: 60484 - RNA, 30 nt, synthetic construct
  misc_feature 1..30: note = derived and/or modified sequence opt11 from anti-influenza_CDR
  source 1..30: mol_type = other RNA
ctcttgatctatggcgcgagcacgcgcgcg

SEQ ID NO: 60485 - RNA, 30 nt, synthetic construct
  misc_feature 1..30: note = derived and/or modified sequence opt11 from anti-influenza_CDR
  source 1..30: mol_type = other RNA
tgcgcgtacgggggcaagtacttggtcgtg

SEQ ID NO: 60486 - RNA, 30 nt, synthetic construct
  misc_feature 1..30: note = derived and/or modified sequence opt11 from anti-influenza_CDR
  source 1..30: mol_type = other RNA
agacccgacttctacggcgacttcgaatac

SEQ ID NO: 60487 - RNA, 30 nt, synthetic construct
  misc_feature 1..30: note = derived and/or modified sequence opt11 from anti-influenza_CDR
  source 1..30: mol_type = other RNA
caacactacggctactccccccgctacgcc

SEQ ID NO: 60488 - RNA, 30 nt, synthetic construct
  misc_feature 1..30: note = derived and/or modified sequence opt11 from anti-influenza_CDR
  source 1..30: mol_type = other RNA
caacagcgctcacactggcccccaatcaca

SEQ ID NO: 60489 - RNA, 30 nt, synthetic construct
  misc_feature 1..30: note = derived and/or modified sequence opt11 from anti-influenza_CDR
  source 1..30: mol_type = other RNA
agctcgtacgcgggctcgagcacgtgggtg

SEQ ID NO: 60490 - RNA, 30 nt, synthetic construct
  misc_feature 1..30: note = derived and/or modified sequence opt11 from anti-influenza_CDR
  source 1..30: mol_type = other RNA
ctactatactccggcggcgaccccgtcgcc

SEQ ID NO: 60491 - RNA, 30 nt, synthetic construct
  misc_feature 1..30: note = derived and/or modified sequence opt11 from anti-influenza_CDR
  source 1..30: mol_type = other RNA
caacaatacggcggctcaccccgctacacc

SEQ ID NO: 60492 - RNA, 30 nt, synthetic construct
  misc_feature 1..30: note = derived and/or modified sequence opt11 from anti-influenza_CDR
  source 1..30: mol_type = other RNA
aggtacgggagcgggtacgggttcgatagc

SEQ ID NO: 60493 - RNA, 30 nt, synthetic construct
  misc_feature 1..30: note = derived and/or modified sequence opt11 from anti-influenza_CDR
  source 1..30: mol_type = other RNA
tcctcatacgccggcaactacaaccacgtc

SEQ ID NO: 60494 - RNA, 30 nt, synthetic construct
  misc_feature 1..30: note = derived and/or modified sequence opt11 from anti-influenza_CDR
  source 1..30: mol_type = other RNA
caacaatacatcaactggcgccccctctcc

SEQ ID NO: 60495 - RNA, 30 nt, synthetic construct
  misc_feature 1..30: note = derived and/or modified sequence opt11 from anti-influenza_CDR
  source 1..30: mol_type = other RNA
ataggcgcgggatatgacgtgcactggtac

SEQ ID NO: 60496 - RNA, 30 nt, synthetic construct; identical to SEQ ID NO: 22286
  misc_feature 1..30: note = derived and/or modified sequence opt11 from anti-influenza_CDR
  source 1..30: mol_type = other RNA

SEQ ID NO: 60497 - RNA, 30 nt, synthetic construct
  misc_feature 1..30: note = derived and/or modified sequence opt11 from anti-influenza_CDR
  source 1..30: mol_type = other RNA
caatcctacgacaactccctctccggctcc

SEQ ID NO: 60498 - RNA, 30 nt, synthetic construct
  misc_feature 1..30: note = derived and/or modified sequence opt11 from anti-influenza_CDR
  source 1..30: mol_type = other RNA
ctcctcatctacgacgcctccaacctccaa

SEQ ID NO: 60499 - RNA, 30 nt, synthetic construct
  misc_feature 1..30: note = derived and/or modified sequence opt11 from anti-influenza_CDR
  source 1..30: mol_type = other RNA
ctcctcatccacgacgcctccaacctcgaa

SEQ ID NO: 60500 - RNA, 30 nt, synthetic construct
  misc_feature 1..30: note = derived and/or modified sequence opt11 from anti-influenza_CDR
  source 1..30: mol_type = other RNA
gtgcagaggttgagttatgggatggacgtg

SEQ ID NO: 60501 - RNA, 30 nt, synthetic construct
  misc_feature 1..30: note = derived and/or modified sequence opt11 from anti-influenza_CDR
  source 1..30: mol_type = other RNA
gtccagaaatcgtactacggcatggacgtg

SEQ ID NO: 60502 - RNA, 30 nt, synthetic construct; identical to SEQ ID NO: 22292
  misc_feature 1..30: note = derived and/or modified sequence opt11 from anti-influenza_CDR
  source 1..30: mol_type = other RNA

SEQ ID NO: 60503 - RNA, 30 nt, synthetic construct; identical to SEQ ID NO: 22293
  misc_feature 1..30: note = derived and/or modified sequence opt11 from anti-influenza_CDR
  source 1..30: mol_type = other RNA

SEQ ID NO: 60504 - RNA, 30 nt, synthetic construct
  misc_feature 1..30: note = derived and/or modified sequence opt11 from anti-influenza_CDR
  source 1..30: mol_type = other RNA
accaaacgctcccaacaaaccgtcatcccc

SEQ ID NO: 60505 - RNA, 30 nt, synthetic construct
  misc_feature 1..30: note = derived and/or modified sequence opt11 from anti-influenza_CDR
  source 1..30: mol_type = other RNA
acctcccgctcccaacaaaccgtcatcccc

SEQ ID NO: 60506 - RNA, 30 nt, synthetic construct; identical to SEQ ID NO: 22296
  misc_feature 1..30: note = derived and/or modified sequence opt11 from anti-influenza_CDR
  source 1..30: mol_type = other RNA

SEQ ID NO: 60507 - RNA, 30 nt, synthetic construct
  misc_feature 1..30: note = derived and/or modified sequence opt11 from anti-influenza_CDR
  source 1..30: mol_type = other RNA
cgcccgaaagtgcgcgatcaagagagcagg

SEQ ID NO: 60508 - RNA, 30 nt, synthetic construct
  misc_feature 1..30: note = derived and/or modified sequence opt11 from anti-influenza_CDR
  source 1..30: mol_type = other RNA
aggccgtgggtgaggggggtgagtagtagg

SEQ ID NO: 60509 - RNA, 30 nt, synthetic construct
  misc_feature 1..30: note = derived and/or modified sequence opt11 from anti-influenza_CDR
  source 1..30: mol_type = other RNA
aggccgtgggtgagggggctgagtagtagg

SEQ ID NO: 60510 - RNA, 30 nt, synthetic construct
  misc_feature 1..30: note = derived and/or modified sequence opt11 from anti-influenza_CDR
  source 1..30: mol_type = other RNA
aggccgaaagtgagagggcaggcgggcagg

SEQ ID NO: 60511 - RNA, 30 nt, synthetic construct
  misc_feature 1..30: note = derived and/or modified sequence opt11 from anti-influenza_CDR
  source 1..30: mol_type = other RNA
gccccagccgtcgccgcacaagcatccgca

SEQ ID NO: 60512 - RNA, 30 nt, synthetic construct
  misc_feature 1..30: note = derived and/or modified sequence opt11 from anti-influenza_CDR
  source 1..30: mol_type = other RNA
gtacaccaccccggaaccgacaacgaccaa

SEQ ID NO: 60513 - RNA, 30 nt, synthetic construct
  misc_feature 1..30: note = derived and/or modified sequence opt11 from anti-influenza_CDR
  source 1..30: mol_type = other RNA
ttcgggcaggggacgaaggtggagataaag

SEQ ID NO: 60514 - RNA, 30 nt, synthetic construct
  misc_feature 1..30: note = derived and/or modified sequence opt11 from anti-influenza_CDR
  source 1..30: mol_type = other RNA
ggcttcgcattccacaaccgcgccatgcac

SEQ ID NO: 60515 - RNA, 30 nt, synthetic construct; identical to SEQ ID NO: 22305
  misc_feature 1..30: note = derived and/or modified sequence opt11 from anti-influenza_CDR
  source 1..30: mol_type = other RNA

SEQ ID NO: 60516 - RNA, 30 nt, synthetic construct; identical to SEQ ID NO: 22306
  misc_feature 1..30: note = derived and/or modified sequence opt11 from anti-influenza_CDR
  source 1..30: mol_type = other RNA

SEQ ID NO: 60517 - RNA, 30 nt, synthetic construct; identical to SEQ ID NO: 22307
  misc_feature 1..30: note = derived and/or modified sequence opt11 from anti-influenza_CDR
  source 1..30: mol_type = other RNA

SEQ ID NO: 60518 - RNA, 30 nt, synthetic construct
  misc_feature 1..30: note = derived and/or modified sequence opt11 from anti-influenza_CDR
  source 1..30: mol_type = other RNA
ggctactcattcaacaactacggcatcaac

SEQ ID NO: 60519 - RNA, 30 nt, synthetic construct; identical to SEQ ID NO: 14667
  misc_feature 1..30: note = derived and/or modified sequence opt11 from anti-influenza_CDR
  source 1..30: mol_type = other RNA

SEQ ID NO: 60520 - RNA, 30 nt, synthetic construct; identical to SEQ ID NO: 22310
  misc_feature 1..30: note = derived and/or modified sequence opt11 from anti-influenza_CDR
  source 1..30: mol_type = other RNA

SEQ ID NO: 60521 - RNA, 30 nt, synthetic construct
  misc_feature 1..30: note = derived and/or modified sequence opt11 from anti-influenza_CDR
  source 1..30: mol_type = other RNA
aggggaaattacgggaacgggttcgcgtac

SEQ ID NO: 60522 - RNA, 30 nt, synthetic construct
  misc_feature 1..30: note = derived and/or modified sequence opt11 from anti-influenza_CDR
  source 1..30: mol_type = other RNA
caacaatacggctcctcccccgccctcacc

SEQ ID NO: 60523 - RNA, 30 nt, synthetic construct
  misc_feature 1..30: note = derived and/or modified sequence opt11 from anti-influenza_CDR
  source 1..30: mol_type = other RNA
caagaatacaacaacgacagcccactcaca

SEQ ID NO: 60524 - RNA, 30 nt, synthetic construct
  misc_feature 1..30: note = derived and/or modified sequence opt11 from anti-influenza_CDR
  source 1..30: mol_type = other RNA
atccgctccggcctcaaccgattcgaaacc

SEQ ID NO: 60525 - RNA, 30 nt, synthetic construct; identical to SEQ ID NO: 22315
  misc_feature 1..30: note = derived and/or modified sequence opt11 from anti-influenza_CDR
  source 1..30: mol_type = other RNA

SEQ ID NO: 60526 - RNA, 30 nt, synthetic construct
  misc_feature 1..30: note = derived and/or modified sequence opt11 from anti-influenza_CDR
  source 1..30: mol_type = other RNA
ggcgcgagcataagcacgggcgggaactat

SEQ ID NO: 60527 - RNA, 30 nt, synthetic construct
  misc_feature 1..30: note = derived and/or modified sequence opt11 from anti-influenza_CDR
  source 1..30: mol_type = other RNA
atcttctactccggcaccaccaaatacaac

SEQ ID NO: 60528 - RNA, 30 nt, synthetic construct
  misc_feature 1..30: note = derived and/or modified sequence opt11 from anti-influenza_CDR
  source 1..30: mol_type = other RNA
gcctcctacgccggcacatacatccaccta

SEQ ID NO: 60529 - RNA, 30 nt, synthetic construct; identical to SEQ ID NO: 52887
  misc_feature 1..30: note = derived and/or modified sequence opt11 from anti-influenza_CDR
  source 1..30: mol_type = other RNA

SEQ ID NO: 60530 - RNA, 30 nt, synthetic construct
  misc_feature 1..30: note = derived and/or modified sequence opt11 from anti-influenza_CDR
  source 1..30: mol_type = other RNA
caacaattcaacgactggcccttcctcacc

SEQ ID NO: 60531 - RNA, 30 nt, synthetic construct
  misc_feature 1..30: note = derived and/or modified sequence opt11 from anti-influenza_CDR
  source 1..30: mol_type = other RNA
caacaactcaccacctacccccccatcacc

SEQ ID NO: 60532 - RNA, 30 nt, synthetic construct
  misc_feature 1..30: note = derived and/or modified sequence opt11 from anti-influenza_CDR
  source 1..30: mol_type = other RNA
ggcgggagcataagcaatggcgggtaccat

SEQ ID NO: 60533 - RNA, 30 nt, synthetic construct
  misc_feature 1..30: note = derived and/or modified sequence opt11 from anti-influenza_CDR
  source 1..30: mol_type = other RNA
ggcgactccgtcatcaactccgcctactat

SEQ ID NO: 60534 - RNA, 30 nt, synthetic construct
  misc_feature 1..30: note = derived and/or modified sequence opt11 from anti-influenza_CDR
  source 1..30: mol_type = other RNA
caacaatacgacaactggctccccatcacc

SEQ ID NO: 60535 - RNA, 30 nt, synthetic construct
  misc_feature 1..30: note = derived and/or modified sequence opt11 from anti-influenza_CDR
  source 1..30: mol_type = other RNA
gcgggggattatagtggggggatatatgcg

SEQ ID NO: 60536 - RNA, 30 nt, synthetic construct
  misc_feature 1..30: note = derived and/or modified sequence opt11 from anti-influenza_CDR
  source 1..30: mol_type = other RNA
gcgggcgattactcgggctcgaactatgca

SEQ ID NO: 60537 - RNA, 30 nt, synthetic construct
  misc_feature 1..30: note = derived and/or modified sequence opt11 from anti-influenza_CDR
  source 1..30: mol_type = other RNA
gcgggcgattactcgggcgcgaactatgcc

SEQ ID NO: 60538 - RNA, 30 nt, synthetic construct
  misc_feature 1..30: note = derived and/or modified sequence opt11 from anti-influenza_CDR
  source 1..30: mol_type = other RNA
ggcttgagcttgtactcgaacgagatcaat

SEQ ID NO: 60539 - RNA, 30 nt, synthetic construct
  misc_feature 1..30: note = derived and/or modified sequence opt11 from anti-influenza_CDR
  source 1..30: mol_type = other RNA
gcctcatacgccggcaacaacatatacgta

SEQ ID NO: 60540 - RNA, 30 nt, synthetic construct
  misc_feature 1..30: note = derived and/or modified sequence opt11 from anti-influenza_CDR
  source 1..30: mol_type = other RNA
gcctcccaatccgtctccaccttcctcgcc

SEQ ID NO: 60541 - RNA, 30 nt, synthetic construct
  misc_feature 1..30: note = derived and/or modified sequence opt11 from anti-influenza_CDR
  source 1..30: mol_type = other RNA
ataaaatcgaacacggacgggggcacgaca

SEQ ID NO: 60542 - RNA, 30 nt, synthetic construct
  misc_feature 1..30: note = derived and/or modified sequence opt11 from anti-influenza_CDR
  source 1..30: mol_type = other RNA
gagagcgtggacatatacgggaactcgttc

SEQ ID NO: 60543 - RNA, 30 nt, synthetic construct
  misc_feature 1..30: note = derived and/or modified sequence opt11 from anti-influenza_CDR
  source 1..30: mol_type = other RNA
gagagcatagacatatacgggaactcgttc

SEQ ID NO: 60544 - RNA, 30 nt, synthetic construct
  misc_feature 1..30: note = derived and/or modified sequence opt11 from anti-influenza_CDR
  source 1..30: mol_type = other RNA
gcgggcgattactcgggcgtgaactatgcc

SEQ ID NO: 60545 - RNA, 33 nt, synthetic construct
  misc_feature 1..33: note = derived and/or modified sequence opt11 from anti-influenza_CDR
  source 1..33: mol_type = other RNA
gcagcctgggacgacagcctaaacggacaacta

SEQ ID NO: 60546 - RNA, 33 nt, synthetic construct
  misc_feature 1..33: note = derived and/or modified sequence opt11 from anti-influenza_CDR
  source 1..33: mol_type = other RNA
tgctcgtacgcgggctcgagctcgagcagggtc

SEQ ID NO: 60547 - RNA, 33 nt, synthetic construct
  misc_feature 1..33: note = derived and/or modified sequence opt11 from anti-influenza_CDR
  source 1..33: mol_type = other RNA
ctcgtcctcgccaccggcctccgcaactcaccc

SEQ ID NO: 60548 - RNA, 33 nt, synthetic construct
  misc_feature 1..33: note = derived and/or modified sequence opt11 from anti-influenza_CDR
  source 1..33: mol_type = other RNA
caatccctcctccactccgacggcaaaacctac

SEQ ID NO: 60549 - RNA, 33 nt, synthetic construct
  misc_feature 1..33: note = derived and/or modified sequence opt11 from anti-influenza_CDR
  source 1..33: mol_type = other RNA
cgcacctcccaatccctctcctcctacctccac

SEQ ID NO: 60550 - RNA, 33 nt, synthetic construct
  misc_feature 1..33: note = derived and/or modified sequence opt11 from anti-influenza_CDR
  source 1..33: mol_type = other RNA
cgcgcgagccagcgcttgaactcgtacttgcac

SEQ ID NO: 60551 - RNA, 33 nt, synthetic construct
  misc_feature 1..33: note = derived and/or modified sequence opt11 from anti-influenza_CDR
  source 1..33: mol_type = other RNA
cgcacctcccaatccctccgctcctacctccac

SEQ ID NO: 60552 - RNA, 33 nt, synthetic construct
  misc_feature 1..33: note = derived and/or modified sequence opt11 from anti-influenza_CDR
  source 1..33: mol_type = other RNA
cgcacctcccaatccctctcctcctacacccac

SEQ ID NO: 60553 - RNA, 33 nt, synthetic construct
  misc_feature 1..33: note = derived and/or modified sequence opt11 from anti-influenza_CDR
  source 1..33: mol_type = other RNA
cgcacaagccaaagcctaagctcatacgaccac

SEQ ID NO: 60554 - RNA, 33 nt, synthetic construct
  misc_feature 1..33: note = derived and/or modified sequence opt11 from anti-influenza_CDR
  source 1..33: mol_type = other RNA
caagtgtgggatagctcgagcgatcactatgtc

SEQ ID NO: 60555 - RNA, 33 nt, synthetic construct
  misc_feature 1..33: note = derived and/or modified sequence opt11 from anti-influenza_CDR
  source 1..33: mol_type = other RNA
caagtgtgggggagctcgagcgatcactatgtc

SEQ ID NO: 60556 - RNA, 33 nt, synthetic construct
  misc_feature 1..33: note = derived and/or modified sequence opt11 from anti-influenza_CDR
  source 1..33: mol_type = other RNA
gggacgtgggacagtagtttgagtgtggggatg

SEQ ID NO: 60557 - RNA, 33 nt, synthetic construct
  misc_feature 1..33: note = derived and/or modified sequence opt11 from anti-influenza_CDR
  source 1..33: mol_type = other RNA
caatccctcctccacggcaacggctacaactac

SEQ ID NO: 60558 - RNA, 33 nt, synthetic construct
  misc_feature 1..33: note = derived and/or modified sequence opt11 from anti-influenza_CDR
  source 1..33: mol_type = other RNA
agggcgagtcaggggataaggaatgacttgggg

SEQ ID NO: 60559 - RNA, 33 nt, synthetic construct
  misc_feature 1..33: note = derived and/or modified sequence opt11 from anti-influenza_CDR
  source 1..33: mol_type = other RNA
cgcgcaagccagaacatacgctcatacctgaac

SEQ ID NO: 60560 - RNA, 33 nt, synthetic construct
  misc_feature 1..33: note = derived and/or modified sequence opt11 from anti-influenza_CDR
  source 1..33: mol_type = other RNA
cgcgcaaaccaggacataggcatatacctgaac

SEQ ID NO: 60561 - RNA, 33 nt, synthetic construct
  misc_feature 1..33: note = derived and/or modified sequence opt11 from anti-influenza_CDR
  source 1..33: mol_type = other RNA
cgcgcctcccaatccgtctccaacaacctagcc

SEQ ID NO: 60562 - RNA, 33 nt, synthetic construct
  misc_feature 1..33: note = derived and/or modified sequence opt11 from anti-influenza_CDR
  source 1..33: mol_type = other RNA
caacaataccacaactggcccccctcctactcc

SEQ ID NO: 60563 - RNA, 33 nt, synthetic construct
  misc_feature 1..33: note = derived and/or modified sequence opt11 from anti-influenza_CDR
  source 1..33: mol_type = other RNA
cgcgccagccaaggcatactcaactgcctagcc

SEQ ID NO: 60564 - RNA, 33 nt, synthetic construct
  misc_feature 1..33: note = derived and/or modified sequence opt11 from anti-influenza_CDR
  source 1..33: mol_type = other RNA
agggcctcgcaatcgatcgcgagctggctagcg

SEQ ID NO: 60565 - RNA, 33 nt, synthetic construct
  misc_feature 1..33: note = derived and/or modified sequence opt11 from anti-influenza_CDR
  source 1..33: mol_type = other RNA
gccccacgcgtctacgaatactacttcgaccaa

SEQ ID NO: 60566 - RNA, 33 nt, synthetic construct
  misc_feature 1..33: note = derived and/or modified sequence opt11 from anti-influenza_CDR
  source 1..33: mol_type = other RNA
cgcgcctcccaatccgtctcctcatacctagcc

SEQ ID NO: 60567 - RNA, 33 nt, synthetic construct
  misc_feature 1..33: note = derived and/or modified sequence opt11 from anti-influenza_CDR
  source 1..33: mol_type = other RNA
agcggggacgcactcccgaaacagaacgcgtac

SEQ ID NO: 60568 - RNA, 33 nt, synthetic construct
  misc_feature 1..33: note = derived and/or modified sequence opt11 from anti-influenza_CDR
  source 1..33: mol_type = other RNA
cagagcgcggactcgagcgggacatcgtgggtg

SEQ ID NO: 60569 - RNA, 33 nt, synthetic construct
  misc_feature 1..33: note = derived and/or modified sequence opt11 from anti-influenza_CDR
  source 1..33: mol_type = other RNA
ggcgggagcaatatagggggcaagagcgtgcac

SEQ ID NO: 60570 - RNA, 33 nt, synthetic construct
  misc_feature 1..33: note = derived and/or modified sequence opt11 from anti-influenza_CDR
  source 1..33: mol_type = other RNA
caacactacggctcctccccccgatacgccttc

SEQ ID NO: 60571 - RNA, 33 nt, synthetic construct
  misc_feature 1..33: note = derived and/or modified sequence opt11 from anti-influenza_CDR
  source 1..33: mol_type = other RNA
cgcgcgagccagagcataagctcatacttgaac

SEQ ID NO: 60572 - RNA, 33 nt, synthetic construct
  misc_feature 1..33: note = derived and/or modified sequence opt11 from anti-influenza_CDR
  source 1..33: mol_type = other RNA
ggcgggaacgcgatcgggagcaagaaagtgcac

SEQ ID NO: 60573 - RNA, 33 nt, synthetic construct
  misc_feature 1..33: note = derived and/or modified sequence opt11 from anti-influenza_CDR
  source 1..33: mol_type = other RNA
caagtgtgggatttcacgatcgatcacgtggtc

SEQ ID NO: 60574 - RNA, 33 nt, synthetic construct
  misc_feature 1..33: note = derived and/or modified sequence opt11 from anti-influenza_CDR
  source 1..33: mol_type = other RNA
gcgacctgggacgggagcttgagcgcgtgggtg

SEQ ID NO: 60575 - RNA, 33 nt, synthetic construct
  misc_feature 1..33: note = derived and/or modified sequence opt11 from anti-influenza_CDR
  source 1..33: mol_type = other RNA
cgcgcgagccagagcgtgggcaattacttggcc

SEQ ID NO: 60576 - RNA, 33 nt, synthetic construct
  misc_feature 1..33: note = derived and/or modified sequence opt11 from anti-influenza_CDR
  source 1..33: mol_type = other RNA
caacaacgctccaaatggccccccatgtactcc

SEQ ID NO: 60577 - RNA, 33 nt, synthetic construct
  misc_feature 1..33: note = derived and/or modified sequence opt11 from anti-influenza_CDR
  source 1..33: mol_type = other RNA
gacgtatccaccacctggtcctggttcgcaccc

SEQ ID NO: 60578 - RNA, 33 nt, synthetic construct
  misc_feature 1..33: note = derived and/or modified sequence opt11 from anti-influenza_CDR
  source 1..33: mol_type = other RNA
cgcgccagccagaacataaaaagatacttcaac

SEQ ID NO: 60579 - RNA, 33 nt, synthetic construct
  misc_feature 1..33: note = derived and/or modified sequence opt11 from anti-influenza_CDR
  source 1..33: mol_type = other RNA
cgcgcatcccaatccgtcggcaactccctagcc

SEQ ID NO: 60580 - RNA, 33 nt, synthetic construct
  misc_feature 1..33: note = derived and/or modified sequence opt11 from anti-influenza_CDR
  source 1..33: mol_type = other RNA
ggcgagagcacgctctcgtactatgccgtgagc

SEQ ID NO: 60581 - RNA, 33 nt, synthetic construct
  misc_feature 1..33: note = derived and/or modified sequence opt11 from anti-influenza_CDR
  source 1..33: mol_type = other RNA
cgcgccagccaaaacatatacaaatacctaaac

SEQ ID NO: 60582 - RNA, 33 nt, synthetic construct
  misc_feature 1..33: note = derived and/or modified sequence opt11 from anti-influenza_CDR
  source 1..33: mol_type = other RNA
gcgagctgtagcgggggctattgcatactcgat

SEQ ID NO: 60583 - RNA, 33 nt, synthetic construct
  misc_feature 1..33: note = derived and/or modified sequence opt11 from anti-influenza_CDR
  source 1..33: mol_type = other RNA
cgcacctcccaatccatctcctcctacctcaac

SEQ ID NO: 60584 - RNA, 33 nt, synthetic construct
  misc_feature 1..33: note = derived and/or modified sequence opt11 from anti-influenza_CDR
  source 1..33: mol_type = other RNA
cgcgcgagccagagcataggcgcgtacgtgaac

SEQ ID NO: 60585 - RNA, 33 nt, synthetic construct
  misc_feature 1..33: note = derived and/or modified sequence opt11 from anti-influenza_CDR
  source 1..33: mol_type = other RNA
cgcgcgagccagagcataagcacatacttgaac

SEQ ID NO: 60586 - RNA, 33 nt, synthetic construct
  misc_feature 1..33: note = derived and/or modified sequence opt11 from anti-influenza_CDR
  source 1..33: mol_type = other RNA
cgcgcaagccagagcatagacaaattcctgaac

SEQ ID NO: 60587 - RNA, 33 nt, synthetic construct
  misc_feature 1..33: note = derived and/or modified sequence opt11 from anti-influenza_CDR
  source 1..33: mol_type = other RNA
ggcgggcacaatatcgggagcaatagcgtgcac

SEQ ID NO: 60588 - RNA, 33 nt, synthetic construct
  misc_feature 1..33: note = derived and/or modified sequence opt11 from anti-influenza_CDR
  source 1..33: mol_type = other RNA
cgcgcctcccaatccatatccacatacctacac

SEQ ID NO: 60589 - RNA, 33 nt, synthetic construct
  misc_feature 1..33: note = derived and/or modified sequence opt11 from anti-influenza_CDR
  source 1..33: mol_type = other RNA
cacgtgggcgggcacacgtacgggatagattac

SEQ ID NO: 60590 - RNA, 33 nt, synthetic construct
  misc_feature 1..33: note = derived and/or modified sequence opt11 from anti-influenza_CDR
  source 1..33: mol_type = other RNA
cgcgcctcccaatccatatccaactacctaaac

SEQ ID NO: 60591 - RNA, 33 nt, synthetic construct
  misc_feature 1..33: note = derived and/or modified sequence opt11 from anti-influenza_CDR
  source 1..33: mol_type = other RNA
cacgacgacgcctcccacggctactccatatcc

SEQ ID NO: 60592 - RNA, 33 nt, synthetic construct
  misc_feature 1..33: note = derived and/or modified sequence opt11 from anti-influenza_CDR
  source 1..33: mol_type = other RNA
cgcgcctcccaaaccatatccacatacctaaac

SEQ ID NO: 60593 - RNA, 33 nt, synthetic construct
  misc_feature 1..33: note = derived and/or modified sequence opt11 from anti-influenza_CDR
  source 1..33: mol_type = other RNA
cgcgcaagccagagcataagcagatacctgaac

SEQ ID NO: 60594 - RNA, 33 nt, synthetic construct
  misc_feature 1..33: note = derived and/or modified sequence opt11 from anti-influenza_CDR
  source 1..33: mol_type = other RNA
gggacctgggactcgagcttgagcgcgtacgtg

SEQ ID NO: 60595 - RNA, 33 nt, synthetic construct
  misc_feature 1..33: note = derived and/or modified sequence opt11 from anti-influenza_CDR
  source 1..33: mol_type = other RNA
tcctcaaactactacgactccgtctacgactac

SEQ ID NO: 60596 - RNA, 33 nt, synthetic construct
  misc_feature 1..33: note = derived and/or modified sequence opt11 from anti-influenza_CDR
  source 1..33: mol_type = other RNA
gcagcctgggacgacatcctaaacgtaccagta

SEQ ID NO: 60597 - RNA, 33 nt, synthetic construct
  misc_feature 1..33: note = derived and/or modified sequence opt11 from anti-influenza_CDR
  source 1..33: mol_type = other RNA
gtggcctgggatgatagtgtggacgggtatgtg

SEQ ID NO: 60598 - RNA, 33 nt, synthetic construct
  misc_feature 1..33: note = derived and/or modified sequence opt11 from anti-influenza_CDR
  source 1..33: mol_type = other RNA
gggcccaagtactatagcgagtacatggacgtg

SEQ ID NO: 60599 - RNA, 33 nt, synthetic construct
  misc_feature 1..33: note = derived and/or modified sequence opt11 from anti-influenza_CDR
  source 1..33: mol_type = other RNA
cgcgcgagccagggcataagctcatacttggcc

SEQ ID NO: 60600 - RNA, 33 nt, synthetic construct
  misc_feature 1..33: note = derived and/or modified sequence opt11 from anti-influenza_CDR
  source 1..33: mol_type = other RNA
tcatccggctactaccccgaatacttccaagac

SEQ ID NO: 60601 - RNA, 33 nt, synthetic construct
  misc_feature 1..33: note = derived and/or modified sequence opt11 from anti-influenza_CDR
  source 1..33: mol_type = other RNA
agcgggcacaagctcggggacaagtacgtgagc

SEQ ID NO: 60602 - RNA, 33 nt, synthetic construct
  misc_feature 1..33: note = derived and/or modified sequence opt11 from anti-influenza_CDR
  source 1..33: mol_type = other RNA
tccaccggctactaccccgcctacctacaccac

SEQ ID NO: 60603 - RNA, 33 nt, synthetic construct
  misc_feature 1..33: note = derived and/or modified sequence opt11 from anti-influenza_CDR
  source 1..33: mol_type = other RNA
cgcgcgagccagcgcgtgagctcatacttggcc

SEQ ID NO: 60604 - RNA, 33 nt, synthetic construct; identical to SEQ ID NO: 59497
  misc_feature 1..33: note = derived and/or modified sequence opt11 from anti-influenza_CDR
  source 1..33: mol_type = other RNA

SEQ ID NO: 60605 - RNA, 33 nt, synthetic construct
  misc_feature 1..33: note = derived and/or modified sequence opt11 from anti-influenza_CDR
  source 1..33: mol_type = other RNA
caagtgtgggatagctcgagcgatcacgcggtc

SEQ ID NO: 60606 - RNA, 33 nt, synthetic construct
  misc_feature 1..33: note = derived and/or modified sequence opt11 from anti-influenza_CDR
  source 1..33: mol_type = other RNA
gcgacctgggacgataacttgagcgggcccgtg

SEQ ID NO: 60607 - RNA, 33 nt, synthetic construct
  misc_feature 1..33: note = derived and/or modified sequence opt11 from anti-influenza_CDR
  source 1..33: mol_type = other RNA
tcctccggctactaccccgcctacctaccccac

SEQ ID NO: 60608 - RNA, 33 nt, synthetic construct
  misc_feature 1..33: note = derived and/or modified sequence opt11 from anti-influenza_CDR
  source 1..33: mol_type = other RNA
ggcgggaacaatatagggagcaagggagtgcac

SEQ ID NO: 60609 - RNA, 33 nt, synthetic construct
  misc_feature 1..33: note = derived and/or modified sequence opt11 from anti-influenza_CDR
  source 1..33: mol_type = other RNA
caagtgtgggatagctcgagcgatcacgtggtc

SEQ ID NO: 60610 - RNA, 33 nt, synthetic construct
  misc_feature 1..33: note = derived and/or modified sequence opt11 from anti-influenza_CDR
  source 1..33: mol_type = other RNA
ggcaattactattacgagagctcgctcgactac

SEQ ID NO: 60611 - RNA, 33 nt, synthetic construct; identical to SEQ ID NO: 22401
  misc_feature 1..33: note = derived and/or modified sequence opt11 from anti-influenza_CDR
  source 1..33: mol_type = other RNA

SEQ ID NO: 60612 - RNA, 33 nt, synthetic construct
  misc_feature 1..33: note = derived and/or modified sequence opt11 from anti-influenza_CDR
  source 1..33: mol_type = other RNA
cgcgcctcccaaggcatatccacatacctagcc

SEQ ID NO: 60613 - RNA, 33 nt, synthetic construct
  misc_feature 1..33: note = derived and/or modified sequence opt11 from anti-influenza_CDR
  source 1..33: mol_type = other RNA
gggcccacgtactattactcgtacatggacgtg

SEQ ID NO: 60614 - RNA, 33 nt, synthetic construct
  misc_feature 1..33: note = derived and/or modified sequence opt11 from anti-influenza_CDR
  source 1..33: mol_type = other RNA
ggcgggaacaatatcgggcgaaatagcgtgcac

SEQ ID NO: 60615 - RNA, 33 nt, synthetic construct
  misc_feature 1..33: note = derived and/or modified sequence opt11 from anti-influenza_CDR
  source 1..33: mol_type = other RNA
caagtctggcactcctcctccgaccactacgtc

SEQ ID NO: 60616 - RNA, 33 nt, synthetic construct
  misc_feature 1..33: note = derived and/or modified sequence opt11 from anti-influenza_CDR
  source 1..33: mol_type = other RNA
tcctccggctactacccccaatacttccaagac

SEQ ID NO: 60617 - RNA, 33 nt, synthetic construct
  misc_feature 1..33: note = derived and/or modified sequence opt11 from anti-influenza_CDR
  source 1..33: mol_type = other RNA
cgcgcgagccagagcgtgagcagatacttggcc

SEQ ID NO: 60618 - RNA, 33 nt, synthetic construct
  misc_feature 1..33: note = derived and/or modified sequence opt11 from anti-influenza_CDR
  source 1..33: mol_type = other RNA
tgggggcaggggacgacgttgacggtaagtagt

SEQ ID NO: 60619 - RNA, 33 nt, synthetic construct
  misc_feature 1..33: note = derived and/or modified sequence opt11 from anti-influenza_CDR
  source 1..33: mol_type = other RNA
cgcgcctcccaatccgtcgactcaaacctagcc

SEQ ID NO: 60620 - RNA, 33 nt, synthetic construct
  misc_feature 1..33: note = derived and/or modified sequence opt11 from anti-influenza_CDR
  source 1..33: mol_type = other RNA
cgcgcctcccaatccgtctcccacaacctagcc

SEQ ID NO: 60621 - RNA, 33 nt, synthetic construct
  misc_feature 1..33: note = derived and/or modified sequence opt11 from anti-influenza_CDR
  source 1..33: mol_type = other RNA
cgcgcctcccaatccgtctcctcaaacctagcc

SEQ ID NO: 60622 - RNA, 33 nt, synthetic construct
  misc_feature 1..33: note = derived and/or modified sequence opt11 from anti-influenza_CDR
  source 1..33: mol_type = other RNA
cgcgcctcccaatccgtcgaccacaacctagcc

SEQ ID NO: 60623 - RNA, 33 nt, synthetic construct
  misc_feature 1..33: note = derived and/or modified sequence opt11 from anti-influenza_CDR
  source 1..33: mol_type = other RNA
caacactacaccaactggcccccccgcctcacc

SEQ ID NO: 60624 - RNA, 33 nt, synthetic construct
  misc_feature 1..33: note = derived and/or modified sequence opt11 from anti-influenza_CDR
  source 1..33: mol_type = other RNA
caacactacaccaactaccccccccgcctcacc

SEQ ID NO: 60625 - RNA, 33 nt, synthetic construct
  misc_feature 1..33: note = derived and/or modified sequence opt11 from anti-influenza_CDR
  source 1..33: mol_type = other RNA
caacactacaccaacttccccccccgcctcacc

SEQ ID NO: 60626 - RNA, 33 nt, synthetic construct
  misc_feature 1..33: note = derived and/or modified sequence opt11 from anti-influenza_CDR
  source 1..33: mol_type = other RNA
cgcgcctcccaagtcatctcccacaacctcgcc

SEQ ID NO: 60627 - RNA, 33 nt, synthetic construct
  misc_feature 1..33: note = derived and/or modified sequence opt11 from anti-influenza_CDR
  source 1..33: mol_type = other RNA
caacactactccaactggcccccccgcctcacc

SEQ ID NO: 60628 - RNA, 33 nt, synthetic construct
  misc_feature 1..33: note = derived and/or modified sequence opt11 from anti-influenza_CDR
  source 1..33: mol_type = other RNA
caacactactccaacttccccccccgcctcacc

SEQ ID NO: 60629 - RNA, 33 nt, synthetic construct
  misc_feature 1..33: note = derived and/or modified sequence opt11 from anti-influenza_CDR
  source 1..33: mol_type = other RNA
caacactactccaactaccccccccgcctcacc

SEQ ID NO: 60630 - RNA, 33 nt, synthetic construct
  misc_feature 1..33: note = derived and/or modified sequence opt11 from anti-influenza_CDR
  source 1..33: mol_type = other RNA
cgcgcctcccaatccgtcgccaacaacctagcc

SEQ ID NO: 60631 - RNA, 33 nt, synthetic construct
  misc_feature 1..33: note = derived and/or modified sequence opt11 from anti-influenza_CDR
  source 1..33: mol_type = other RNA
caacaatacaacaactggccccccatgtacacc

SEQ ID NO: 60632 - RNA, 33 nt, synthetic construct
  misc_feature 1..33: note = derived and/or modified sequence opt11 from anti-influenza_CDR
  source 1..33: mol_type = other RNA
agggcaagtcaatcgatagggaactggctagcg

SEQ ID NO: 60633 - RNA, 33 nt, synthetic construct
  misc_feature 1..33: note = derived and/or modified sequence opt11 from anti-influenza_CDR
  source 1..33: mol_type = other RNA
caacgctacacctccaactcccaaggcttcacc

SEQ ID NO: 60634 - RNA, 33 nt, synthetic construct
  misc_feature 1..33: note = derived and/or modified sequence opt11 from anti-influenza_CDR
  source 1..33: mol_type = other RNA
gcagcctgggacgacacactaaacggaccagta

SEQ ID NO: 60635 - RNA, 33 nt, synthetic construct
  misc_feature 1..33: note = derived and/or modified sequence opt11 from anti-influenza_CDR
  source 1..33: mol_type = other RNA
aaagcgagccagaacgtgggctcaaacgtggcc

SEQ ID NO: 60636 - RNA, 33 nt, synthetic construct
  misc_feature 1..33: note = derived and/or modified sequence opt11 from anti-influenza_CDR
  source 1..33: mol_type = other RNA
caggtgtgggatatgagtagtgataggagggtg

SEQ ID NO: 60637 - RNA, 33 nt, synthetic construct
  misc_feature 1..33: note = derived and/or modified sequence opt11 from anti-influenza_CDR
  source 1..33: mol_type = other RNA
caatccctcctccactccaacggctacaactac

SEQ ID NO: 60638 - RNA, 33 nt, synthetic construct
  misc_feature 1..33: note = derived and/or modified sequence opt11 from anti-influenza_CDR
  source 1..33: mol_type = other RNA
acctacctcgtcggcgcagtcggattccagcac

SEQ ID NO: 60639 - RNA, 33 nt, synthetic construct; identical to SEQ ID NO: 59550
  misc_feature 1..33: note = derived and/or modified sequence opt11 from anti-influenza_CDR
  source 1..33: mol_type = other RNA

SEQ ID NO: 60640 - RNA, 33 nt, synthetic construct
  misc_feature 1..33: note = derived and/or modified sequence opt11 from anti-influenza_CDR
  source 1..33: mol_type = other RNA
caatccctcctcgactccaacggctacaactac

SEQ ID NO: 60641 - RNA, 33 nt, synthetic construct
  misc_feature 1..33: note = derived and/or modified sequence opt11 from anti-influenza_CDR
  source 1..33: mol_type = other RNA
atgcaagccctccaaaccccacccatgtacaca

SEQ ID NO: 60642 - RNA, 33 nt, synthetic construct
  misc_feature 1..33: note = derived and/or modified sequence opt11 from anti-influenza_CDR
  source 1..33: mol_type = other RNA
caatccctcctccactccaacggctacaaccac

SEQ ID NO: 60643 - RNA, 33 nt, synthetic construct
  misc_feature 1..33: note = derived and/or modified sequence opt11 from anti-influenza_CDR
  source 1..33: mol_type = other RNA
caagtgtgggatatcacgagcgatctcgtggtc

SEQ ID NO: 60644 - RNA, 33 nt, synthetic construct
  misc_feature 1..33: note = derived and/or modified sequence opt11 from anti-influenza_CDR
  source 1..33: mol_type = other RNA
cgagcaagccaggacataagcacatggctggcc

SEQ ID NO: 60645 - RNA, 33 nt, synthetic construct
  misc_feature 1..33: note = derived and/or modified sequence opt11 from anti-influenza_CDR
  source 1..33: mol_type = other RNA
cgcgcctcccgctccatcaccaccttcctagcc

SEQ ID NO: 60646 - RNA, 33 nt, synthetic construct
  misc_feature 1..33: note = derived and/or modified sequence opt11 from anti-influenza_CDR
  source 1..33: mol_type = other RNA
ggctggggcgcggtcacgagcccgttcgatttc

SEQ ID NO: 60647 - RNA, 33 nt, synthetic construct
  misc_feature 1..33: note = derived and/or modified sequence opt11 from anti-influenza_CDR
  source 1..33: mol_type = other RNA
cgcgcgagccagagcgtgagctcgagctatctc

SEQ ID NO: 60648 - RNA, 36 nt, synthetic construct
  misc_feature 1..36: note = derived and/or modified sequence opt11 from anti-influenza_CDR
  source 1..36: mol_type = other RNA
caatccgtcctctactcctccaacaacaaaaactac

SEQ ID NO: 60649 - RNA, 36 nt, synthetic construct
  misc_feature 1..36: note = derived and/or modified sequence opt11 from anti-influenza_CDR
  source 1..36: mol_type = other RNA
gcagcgtgggatgactcgctatcgggatcgtgggtg

SEQ ID NO: 60650 - RNA, 36 nt, synthetic construct
  misc_feature 1..36: note = derived and/or modified sequence opt11 from anti-influenza_CDR
  source 1..36: mol_type = other RNA
gtgttctatagcgcggacaggacatcgtacgcggac

SEQ ID NO: 60651 - RNA, 36 nt, synthetic construct
  misc_feature 1..36: note = derived and/or modified sequence opt11 from anti-influenza_CDR
  source 1..36: mol_type = other RNA
cgcgtgggccagagcgtgagcgggagccatctcgcg

SEQ ID NO: 60652 - RNA, 36 nt, synthetic construct
  misc_feature 1..36: note = derived and/or modified sequence opt11 from anti-influenza_CDR
  source 1..36: mol_type = other RNA
accctctcctccgcctactccaactacaaagtcgac

SEQ ID NO: 60653 - RNA, 36 nt, synthetic construct
  misc_feature 1..36: note = derived and/or modified sequence opt11 from anti-influenza_CDR
  source 1..36: mol_type = other RNA
gtggggacgggggggatagtggggagtaagggggat

SEQ ID NO: 60654 - RNA, 36 nt, synthetic construct
  misc_feature 1..36: note = derived and/or modified sequence opt11 from anti-influenza_CDR
  source 1..36: mol_type = other RNA
cgctactcccgctcatcccccggcaccttcgaatcc

SEQ ID NO: 60655 - RNA, 36 nt, synthetic construct
  misc_feature 1..36: note = derived and/or modified sequence opt11 from anti-influenza_CDR
  source 1..36: mol_type = other RNA
caatcgtacgatagctcgctctcgggctttcacgtg

SEQ ID NO: 60656 - RNA, 36 nt, synthetic construct
  misc_feature 1..36: note = derived and/or modified sequence opt11 from anti-influenza_CDR
  source 1..36: mol_type = other RNA
cgcgcaagccagagcgtgagctcgagccagctcgca

SEQ ID NO: 60657 - RNA, 36 nt, synthetic construct
  misc_feature 1..36: note = derived and/or modified sequence opt11 from anti-influenza_CDR
  source 1..36: mol_type = other RNA
cgcgcgagccagttcgtgagcacgcgctcgctcgcg

SEQ ID NO: 60658 - RNA, 36 nt, synthetic construct
  misc_feature 1..36: note = derived and/or modified sequence opt11 from anti-influenza_CDR
  source 1..36: mol_type = other RNA
gcgacctgggacgacagcttgaacgggttctatgta

SEQ ID NO: 60659 - RNA, 36 nt, synthetic construct
  misc_feature 1..36: note = derived and/or modified sequence opt11 from anti-influenza_CDR
  source 1..36: mol_type = other RNA
cgcgcgagccatttcgtgaactatcgctcgctcgcg

SEQ ID NO: 60660 - RNA, 36 nt, synthetic construct
  misc_feature 1..36: note = derived and/or modified sequence opt11 from anti-influenza_CDR
  source 1..36: mol_type = other RNA
cgcgcgagccatttcgtgatcgggcgcgcggtcgcg

SEQ ID NO: 60661 - RNA, 36 nt, synthetic construct
  misc_feature 1..36: note = derived and/or modified sequence opt11 from anti-influenza_CDR
  source 1..36: mol_type = other RNA
agaatataccacggcggcaacagcggcttcgacttc

SEQ ID NO: 60662 - RNA, 36 nt, synthetic construct
  misc_feature 1..36: note = derived and/or modified sequence opt11 from anti-influenza_CDR
  source 1..36: mol_type = other RNA
accctctcctccggcttcgacaactaccaagtcgcc

SEQ ID NO: 60663 - RNA, 36 nt, synthetic construct
  misc_feature 1..36: note = derived and/or modified sequence opt11 from anti-influenza_CDR
  source 1..36: mol_type = other RNA
gtggggaatggggggaatgtggcgagtaagggggat

SEQ ID NO: 60664 - RNA, 36 nt, synthetic construct
  misc_feature 1..36: note = derived and/or modified sequence opt11 from anti-influenza_CDR
  source 1..36: mol_type = other RNA
gtgaggggggggagtacggtggcgtattttggggtg

SEQ ID NO: 60665 - RNA, 36 nt, synthetic construct
  misc_feature 1..36: note = derived and/or modified sequence opt11 from anti-influenza_CDR
  source 1..36: mol_type = other RNA
tgtctatcgagaatgcgcgggtacgggctcgatgtc

SEQ ID NO: 60666 - RNA, 36 nt, synthetic construct
  misc_feature 1..36: note = derived and/or modified sequence opt11 from anti-influenza_CDR
  source 1..36: mol_type = other RNA
gtcgggcaaatggacaagtactacgccatggacgtg

SEQ ID NO: 60667 - RNA, 36 nt, synthetic construct
  misc_feature 1..36: note = derived and/or modified sequence opt11 from anti-influenza_CDR
  source 1..36: mol_type = other RNA
ggcgtgaccaacaaagtgaactcgatcatagacaag

SEQ ID NO: 60668 - RNA, 36 nt, synthetic construct
  misc_feature 1..36: note = derived and/or modified sequence opt11 from anti-influenza_CDR
  source 1..36: mol_type = other RNA
ggggtgacgaacaaggtgaacaggataatagacaag

SEQ ID NO: 60669 - RNA, 36 nt, synthetic construct
  misc_feature 1..36: note = derived and/or modified sequence opt11 from anti-influenza_CDR
  source 1..36: mol_type = other RNA
ggggtcacgaacaaggaaaacagcataatcgacaaa

SEQ ID NO: 60670 - RNA, 36 nt, synthetic construct; identical to SEQ ID NO: 22460
  misc_feature 1..36: note = derived and/or modified sequence opt11 from anti-influenza_CDR
  source 1..36: mol_type = other RNA

SEQ ID NO: 60671 - RNA, 36 nt, synthetic construct
  misc_feature 1..36: note = derived and/or modified sequence opt11 from anti-influenza_CDR
  source 1..36: mol_type = other RNA
aaaatcacctccaaagtcaacaacatcgtcgacaaa

SEQ ID NO: 60672 - RNA, 36 nt, synthetic construct
  misc_feature 1..36: note = derived and/or modified sequence opt11 from anti-influenza_CDR
  source 1..36: mol_type = other RNA
gggatcacgaacaaggtcaacagcataatcgacaaa

SEQ ID NO: 60673 - RNA, 36 nt, synthetic construct
  misc_feature 1..36: note = derived and/or modified sequence opt11 from anti-influenza_CDR
  source 1..36: mol_type = other RNA
aacgggcgctcgagcacgagctggggcatagacgtg

SEQ ID NO: 60674 - RNA, 36 nt, synthetic construct
  misc_feature 1..36: note = derived and/or modified sequence opt11 from anti-influenza_CDR
  source 1..36: mol_type = other RNA
gggatcacgaacaaggaaaatagcgtgatcgagaaa

SEQ ID NO: 60675 - RNA, 36 nt, synthetic construct
  misc_feature 1..36: note = derived and/or modified sequence opt11 from anti-influenza_CDR
  source 1..36: mol_type = other RNA
cccttgggctcgcgctattactatggcatggacgtg

SEQ ID NO: 60676 - RNA, 36 nt, synthetic construct
  misc_feature 1..36: note = derived and/or modified sequence opt11 from anti-influenza_CDR
  source 1..36: mol_type = other RNA
gggatcacgaacaaggtcaatagcgtgatcgagaaa

SEQ ID NO: 60677 - RNA, 36 nt, synthetic construct
  misc_feature 1..36: note = derived and/or modified sequence opt11 from anti-influenza_CDR
  source 1..36: mol_type = other RNA
ggcgtcaccaacaaagtcaactcaatcatcaacaaa

SEQ ID NO: 60678 - RNA, 36 nt, synthetic construct
  misc_feature 1..36: note = derived and/or modified sequence opt11 from anti-influenza_CDR
  source 1..36: mol_type = other RNA
cacatgggctatcaagtgcgcgagaccatggacgtg

SEQ ID NO: 60679 - RNA, 36 nt, synthetic construct
  misc_feature 1..36: note = derived and/or modified sequence opt11 from anti-influenza_CDR
  source 1..36: mol_type = other RNA
gcgacctgggacaggcgcccgaccgcgtacgtggta

SEQ ID NO: 60680 - RNA, 36 nt, synthetic construct
  misc_feature 1..36: note = derived and/or modified sequence opt11 from anti-influenza_CDR
  source 1..36: mol_type = other RNA
gaggggaagtgggggccgcaggcggcgttcgatata

SEQ ID NO: 60681 - RNA, 36 nt, synthetic construct
  misc_feature 1..36: note = derived and/or modified sequence opt11 from anti-influenza_CDR
  source 1..36: mol_type = other RNA
ggcgataaagggatctattactactacatggacgtg

SEQ ID NO: 60682 - RNA, 36 nt, synthetic construct; identical to SEQ ID NO: 22472
  misc_feature 1..36: note = derived and/or modified sequence opt11 from anti-influenza_CDR
  source 1..36: mol_type = other RNA

SEQ ID NO: 60683 - RNA, 36 nt, synthetic construct
  misc_feature 1..36: note = derived and/or modified sequence opt11 from anti-influenza_CDR
  source 1..36: mol_type = other RNA
cgcgcgagccagagcgtgagctcgagctatctcgcg

SEQ ID NO: 60684 - RNA, 36 nt, synthetic construct; identical to SEQ ID NO: 22474
  misc_feature 1..36: note = derived and/or modified sequence opt11 from anti-influenza_CDR
  source 1..36: mol_type = other RNA

SEQ ID NO: 60685 - RNA, 36 nt, synthetic construct
  misc_feature 1..36: note = derived and/or modified sequence opt11 from anti-influenza_CDR
  source 1..36: mol_type = other RNA
cgcgcgagccagagcgtgagctcgaactatctcggg

SEQ ID NO: 60686 - RNA, 36 nt, synthetic construct
  misc_feature 1..36: note = derived and/or modified sequence opt11 from anti-influenza_CDR
  source 1..36: mol_type = other RNA
gggagcacgtacgatttctcgagcgggctcgattac

SEQ ID NO: 60687 - RNA, 36 nt, synthetic construct
  misc_feature 1..36: note = derived and/or modified sequence opt11 from anti-influenza_CDR
  source 1..36: mol_type = other RNA
ggcgtacaccaccccggaaccgacaacgaccaaata

SEQ ID NO: 60688 - RNA, 36 nt, synthetic construct
  misc_feature 1..36: note = derived and/or modified sequence opt11 from anti-influenza_CDR
  source 1..36: mol_type = other RNA
ggcgtccaccacccctcaaccgactccgaccaaaca

SEQ ID NO: 60689 - RNA, 36 nt, synthetic construct
  misc_feature 1..36: note = derived and/or modified sequence opt11 from anti-influenza_CDR
  source 1..36: mol_type = other RNA
ggcgtccaccacccctcaaacgaaaccgaacaaaga

SEQ ID NO: 60690 - RNA, 36 nt, synthetic construct
  misc_feature 1..36: note = derived and/or modified sequence opt11 from anti-influenza_CDR
  source 1..36: mol_type = other RNA
caatccatcaccttcgactacaaaaactacctcgcc

SEQ ID NO: 60691 - RNA, 36 nt, synthetic construct
  misc_feature 1..36: note = derived and/or modified sequence opt11 from anti-influenza_CDR
  source 1..36: mol_type = other RNA
ggggggttgatagggacggggagttattattggggg

SEQ ID NO: 60692 - RNA, 36 nt, synthetic construct
  misc_feature 1..36: note = derived and/or modified sequence opt11 from anti-influenza_CDR
  source 1..36: mol_type = other RNA
gcgcgctataactggggcatacgctatttcgacttc

SEQ ID NO: 60693 - RNA, 36 nt, synthetic construct
  misc_feature 1..36: note = derived and/or modified sequence opt11 from anti-influenza_CDR
  source 1..36: mol_type = other RNA
caatccgtcctctccaactccaaaaacctcaactac

SEQ ID NO: 60694 - RNA, 36 nt, synthetic construct
  misc_feature 1..36: note = derived and/or modified sequence opt11 from anti-influenza_CDR
  source 1..36: mol_type = other RNA
tgtcaggtctgggagacgagtgaggacttgtgggtg

SEQ ID NO: 60695 - RNA, 39 nt, synthetic construct
  misc_feature 1..39: note = derived and/or modified sequence opt11 from anti-influenza_CDR
  source 1..39: mol_type = other RNA
gccagaggcggccgatactacgtcgactacttcgactac

SEQ ID NO: 60696 - RNA, 39 nt, synthetic construct
  misc_feature 1..39: note = derived and/or modified sequence opt11 from anti-influenza_CDR
  source 1..39: mol_type = other RNA
gcccgctccggcgacggctacaactactacttcccccta

SEQ ID NO: 60697 - RNA, 39 nt, synthetic construct
  misc_feature 1..39: note = derived and/or modified sequence opt11 from anti-influenza_CDR
  source 1..39: mol_type = other RNA
gcgcgcgggtgcgggtacaattgctattactttgacggg

SEQ ID NO: 60698 - RNA, 39 nt, synthetic construct; identical to SEQ ID NO: 22488
  misc_feature 1..39: note = derived and/or modified sequence opt11 from anti-influenza_CDR
  source 1..39: mol_type = other RNA

SEQ ID NO: 60699 - RNA, 39 nt, synthetic construct; identical to SEQ ID NO: 22489
  misc_feature 1..39: note = derived and/or modified sequence opt11 from anti-influenza_CDR
  source 1..39: mol_type = other RNA

SEQ ID NO: 60700 - RNA, 39 nt, synthetic construct
  misc_feature 1..39: note = derived and/or modified sequence opt11 from anti-influenza_CDR
  source 1..39: mol_type = other RNA
agcgggagcgatagcaatatcggggactatttcgtgtgc

SEQ ID NO: 60701 - RNA, 39 nt, synthetic construct
  misc_feature 1..39: note = derived and/or modified sequence opt11 from anti-influenza_CDR
  source 1..39: mol_type = other RNA
gcgaggatggtggtggtgacgggggatgggtttgatgtg

SEQ ID NO: 60702 - RNA, 39 nt, synthetic construct
  misc_feature 1..39: note = derived and/or modified sequence opt11 from anti-influenza_CDR
  source 1..39: mol_type = other RNA
tggctatcgataataaacgcgggcgggggcgatatagat

SEQ ID NO: 60703 - RNA, 39 nt, synthetic construct
  misc_feature 1..39: note = derived and/or modified sequence opt11 from anti-influenza_CDR
  source 1..39: mol_type = other RNA
gcggcctcgagcttgcaatcgggcgtgccctcgcgcttt

SEQ ID NO: 60704 - RNA, 39 nt, synthetic construct
  misc_feature 1..39: note = derived and/or modified sequence opt11 from anti-influenza_CDR
  source 1..39: mol_type = other RNA
cacgacgccaaattctccggctcctactacgtcgcctcc

SEQ ID NO: 60705 - RNA, 39 nt, synthetic construct
  misc_feature 1..39: note = derived and/or modified sequence opt11 from anti-influenza_CDR
  source 1..39: mol_type = other RNA
cacgacgtcaaattctccggctcctactacgtcgcctcc

SEQ ID NO: 60706 - RNA, 39 nt, synthetic construct
  misc_feature 1..39: note = derived and/or modified sequence opt11 from anti-influenza_CDR
  source 1..39: mol_type = other RNA
acagggagcgagagcacgaccgggtacgggatggatgtc

SEQ ID NO: 60707 - RNA, 39 nt, synthetic construct
  misc_feature 1..39: note = derived and/or modified sequence opt11 from anti-influenza_CDR
  source 1..39: mol_type = other RNA
gcagcgagcacgagcgtgctcgggtacgggatggatgta

SEQ ID NO: 60708 - RNA, 39 nt, synthetic construct
  misc_feature 1..39: note = derived and/or modified sequence opt11 from anti-influenza_CDR
  source 1..39: mol_type = other RNA
tccggctcaaccttcaacatcggctccaacgccgtcgac

SEQ ID NO: 60709 - RNA, 39 nt, synthetic construct
  misc_feature 1..39: note = derived and/or modified sequence opt11 from anti-influenza_CDR
  source 1..39: mol_type = other RNA
tccggctcccgctcaaacgtcggcgacaactccgtctac

SEQ ID NO: 60710 - RNA, 39 nt, synthetic construct
  misc_feature 1..39: note = derived and/or modified sequence opt11 from anti-influenza_CDR
  source 1..39: mol_type = other RNA
agcgggagctcgagcaatatcgggaacgattacgtgagc

SEQ ID NO: 60711 - RNA, 39 nt, synthetic construct
  misc_feature 1..39: note = derived and/or modified sequence opt11 from anti-influenza_CDR
  source 1..39: mol_type = other RNA
gggggggggagttatggggcgtatgaggggtttgattat

SEQ ID NO: 60712 - RNA, 39 nt, synthetic construct
  misc_feature 1..39: note = derived and/or modified sequence opt11 from anti-influenza_CDR
  source 1..39: mol_type = other RNA
agcgggagctcgagcaatatcgggagcaattacgtgtac

SEQ ID NO: 60713 - RNA, 39 nt, synthetic construct
  misc_feature 1..39: note = derived and/or modified sequence opt11 from anti-influenza_CDR
  source 1..39: mol_type = other RNA
gcccgccgccaacaactctacaaaggctactaccaccac

SEQ ID NO: 60714 - RNA, 39 nt, synthetic construct
  misc_feature 1..39: note = derived and/or modified sequence opt11 from anti-influenza_CDR
  source 1..39: mol_type = other RNA
agcgggagcacgagcaatatcgggtacaatcccgtgagc

SEQ ID NO: 60715 - RNA, 39 nt, synthetic construct; identical to SEQ ID NO: 22505
  misc_feature 1..39: note = derived and/or modified sequence opt11 from anti-influenza_CDR
  source 1..39: mol_type = other RNA

SEQ ID NO: 60716 - RNA, 39 nt, synthetic construct; identical to SEQ ID NO: 22506
  misc_feature 1..39: note = derived and/or modified sequence opt11 from anti-influenza_CDR
  source 1..39: mol_type = other RNA

SEQ ID NO: 60717 - RNA, 39 nt, synthetic construct
  misc_feature 1..39: note = derived and/or modified sequence opt11 from anti-influenza_CDR
  source 1..39: mol_type = other RNA
gcaaaaccgctcaggggctcgtacaggtacttcgacctg

SEQ ID NO: 60718 - RNA, 39 nt, synthetic construct
  misc_feature 1..39: note = derived and/or modified sequence opt11 from anti-influenza_CDR
  source 1..39: mol_type = other RNA
ccgatctgggtcaagaccccgctcaagctagcgaacgga

SEQ ID NO: 60719 - RNA, 39 nt, synthetic construct
  misc_feature 1..39: note = derived and/or modified sequence opt11 from anti-influenza_CDR
  source 1..39: mol_type = other RNA
caagcctcccaatccgtctacaacaaaaacaacctagcc

SEQ ID NO: 60720 - RNA, 39 nt, synthetic construct
  misc_feature 1..39: note = derived and/or modified sequence opt11 from anti-influenza_CDR
  source 1..39: mol_type = other RNA
caatcctccgaatccgtctacaaaaacaacaacctcgcc

SEQ ID NO: 60721 - RNA, 39 nt, synthetic construct
  misc_feature 1..39: note = derived and/or modified sequence opt11 from anti-influenza_CDR
  source 1..39: mol_type = other RNA
caatcctcccaatccgtcgactccaacaaccaactctcc

SEQ ID NO: 60722 - RNA, 39 nt, synthetic construct
  misc_feature 1..39: note = derived and/or modified sequence opt11 from anti-influenza_CDR
  source 1..39: mol_type = other RNA
caatcctcccaatccgtcgacaacaacaaagacctcgcc

SEQ ID NO: 60723 - RNA, 39 nt, synthetic construct
  misc_feature 1..39: note = derived and/or modified sequence opt11 from anti-influenza_CDR
  source 1..39: mol_type = other RNA
caatcctcccaatccgtctacaacaacaaccgcctctcc

SEQ ID NO: 60724 - RNA, 39 nt, synthetic construct
  misc_feature 1..39: note = derived and/or modified sequence opt11 from anti-influenza_CDR
  source 1..39: mol_type = other RNA
caatcctcccaatccgtctacaaaaacaacaacctcgcc

SEQ ID NO: 60725 - RNA, 39 nt, synthetic construct
  misc_feature 1..39: note = derived and/or modified sequence opt11 from anti-influenza_CDR
  source 1..39: mol_type = other RNA
gggggggggtttgggtggagtcagacgtattttgggtat

SEQ ID NO: 60726 - RNA, 42 nt, synthetic construct
  misc_feature 1..42: note = derived and/or modified sequence opt11 from anti-influenza_CDR
  source 1..42: mol_type = other RNA
tggctcgggcgcacgtactaccgctcgaaatggtacaatgac

SEQ ID NO: 60727 - RNA, 42 nt, synthetic construct
  misc_feature 1..42: note = derived and/or modified sequence opt11 from anti-influenza_CDR
  source 1..42: mol_type = other RNA
ggggggttggtgggggggtatgatgagtatttttttgattat

SEQ ID NO: 60728 - RNA, 42 nt, synthetic construct
  misc_feature 1..42: note = derived and/or modified sequence opt11 from anti-influenza_CDR
  source 1..42: mol_type = other RNA
caccccaaatacttctacggctccggctcctaccccgacttc

SEQ ID NO: 60729 - RNA, 42 nt, synthetic construct
  misc_feature 1..42: note = derived and/or modified sequence opt11 from anti-influenza_CDR
  source 1..42: mol_type = other RNA
acgggctcgagctcggacgtgggcgcgagcaatagcgtgagc

SEQ ID NO: 60730 - RNA, 42 nt, synthetic construct; identical to SEQ ID NO: 22520
  misc_feature 1..42: note = derived and/or modified sequence opt11 from anti-influenza_CDR
  source 1..42: mol_type = other RNA

SEQ ID NO: 60731 - RNA, 42 nt, synthetic construct; identical to SEQ ID NO: 22521
  misc_feature 1..42: note = derived and/or modified sequence opt11 from anti-influenza_CDR
  source 1..42: mol_type = other RNA

SEQ ID NO: 60732 - RNA, 42 nt, synthetic construct
  misc_feature 1..42: note = derived and/or modified sequence opt11 from anti-influenza_CDR
  source 1..42: mol_type = other RNA
gagttcgagacctcgggctatttccatggctcgttcgattac

SEQ ID NO: 60733 - RNA, 42 nt, synthetic construct; identical to SEQ ID NO: 22523
  misc_feature 1..42: note = derived and/or modified sequence opt11 from anti-influenza_CDR
  source 1..42: mol_type = other RNA

SEQ ID NO: 60734 - RNA, 42 nt, synthetic construct
  misc_feature 1..42: note = derived and/or modified sequence opt11 from anti-influenza_CDR
  source 1..42: mol_type = other RNA
acgggcgggagctcggacataggcgcgagcaatagcgtgagc

SEQ ID NO: 60735 - RNA, 42 nt, synthetic construct
  misc_feature 1..42: note = derived and/or modified sequence opt11 from anti-influenza_CDR
  source 1..42: mol_type = other RNA
acgggctcgagctcggacgtgggcgggtacgattacgtgagc

SEQ ID NO: 60736 - RNA, 42 nt, synthetic construct
  misc_feature 1..42: note = derived and/or modified sequence opt11 from anti-influenza_CDR
  source 1..42: mol_type = other RNA
ggctcgagcacgggagcggtcacgagagggcactatccctat

SEQ ID NO: 60737 - RNA, 42 nt, synthetic construct; identical to SEQ ID NO: 22527
  misc_feature 1..42: note = derived and/or modified sequence opt11 from anti-influenza_CDR
  source 1..42: mol_type = other RNA

SEQ ID NO: 60738 - RNA, 42 nt, synthetic construct
  misc_feature 1..42: note = derived and/or modified sequence opt11 from anti-influenza_CDR
  source 1..42: mol_type = other RNA
cactacggcgactcagaagccataaacgacgccttcgacatc

SEQ ID NO: 60739 - RNA, 42 nt, synthetic construct
  misc_feature 1..42: note = derived and/or modified sequence opt11 from anti-influenza_CDR
  source 1..42: mol_type = other RNA
acgggctcgagctcgaacataggcgcgggctatgacgtgcac

SEQ ID NO: 60740 - RNA, 42 nt, synthetic construct; identical to SEQ ID NO: 22530
  misc_feature 1..42: note = derived and/or modified sequence opt11 from anti-influenza_CDR
  source 1..42: mol_type = other RNA

SEQ ID NO: 60741 - RNA, 42 nt, synthetic construct
  misc_feature 1..42: note = derived and/or modified sequence opt11 from anti-influenza_CDR
  source 1..42: mol_type = other RNA
acgggcacgagctcggacgtgggcgggtacaattacgtgagc

SEQ ID NO: 60742 - RNA, 42 nt, synthetic construct
  misc_feature 1..42: note = derived and/or modified sequence opt11 from anti-influenza_CDR
  source 1..42: mol_type = other RNA
acgggcacgagctcggacgtgggcgcgtacaattacgtgagc

SEQ ID NO: 60743 - RNA, 42 nt, synthetic construct
  misc_feature 1..42: note = derived and/or modified sequence opt11 from anti-influenza_CDR
  source 1..42: mol_type = other RNA
gcggagaggccgaaggtgagggggcaggcggggaggatgaat

SEQ ID NO: 60744 - RNA, 42 nt, synthetic construct
  misc_feature 1..42: note = derived and/or modified sequence opt11 from anti-influenza_CDR
  source 1..42: mol_type = other RNA
gggagtaggccgtgggtgaggggggtgagtagtaggataagt

SEQ ID NO: 60745 - RNA, 42 nt, synthetic construct
  misc_feature 1..42: note = derived and/or modified sequence opt11 from anti-influenza_CDR
  source 1..42: mol_type = other RNA
atctggggagtggcagcgcccgggacagcggcagcgcaaata

SEQ ID NO: 60746 - RNA, 42 nt, synthetic construct
  misc_feature 1..42: note = derived and/or modified sequence opt11 from anti-influenza_CDR
  source 1..42: mol_type = other RNA
tgggtgaggcagccgccggggaaggggttggagtgggtggcg

SEQ ID NO: 60747 - RNA, 42 nt, synthetic construct
  misc_feature 1..42: note = derived and/or modified sequence opt11 from anti-influenza_CDR
  source 1..42: mol_type = other RNA
gcgagggggccggagggggtgtgggggaggagtatagatagt

SEQ ID NO: 60748 - RNA, 42 nt, synthetic construct
  misc_feature 1..42: note = derived and/or modified sequence opt11 from anti-influenza_CDR
  source 1..42: mol_type = other RNA
gcgcgcgatcccgataccccgttcgtgcgcgcattcgatagc

SEQ ID NO: 60749 - RNA, 42 nt, synthetic construct; identical to SEQ ID NO: 22539
  misc_feature 1..42: note = derived and/or modified sequence opt11 from anti-influenza_CDR
  source 1..42: mol_type = other RNA

SEQ ID NO: 60750 - RNA, 42 nt, synthetic construct
  misc_feature 1..42: note = derived and/or modified sequence opt11 from anti-influenza_CDR
  source 1..42: mol_type = other RNA
tgggactggaactttgacctgtacctgggctggttcgacccc

SEQ ID NO: 60751 - RNA, 42 nt, synthetic construct; identical to SEQ ID NO: 22541
  misc_feature 1..42: note = derived and/or modified sequence opt11 from anti-influenza_CDR
  source 1..42: mol_type = other RNA

SEQ ID NO: 60752 - RNA, 42 nt, synthetic construct
  misc_feature 1..42: note = derived and/or modified sequence opt11 from anti-influenza_CDR
  source 1..42: mol_type = other RNA
gggccagggtactcgggctatcactatggctggttcgataca

SEQ ID NO: 60753 - RNA, 42 nt, synthetic construct
  misc_feature 1..42: note = derived and/or modified sequence opt11 from anti-influenza_CDR
  source 1..42: mol_type = other RNA
gcgcgctgggactatggcgtgtacgagggctatatcgattac

SEQ ID NO: 60754 - RNA, 45 nt, synthetic construct
  misc_feature 1..45: note = derived and/or modified sequence opt11 from anti-influenza_CDR
  source 1..45: mol_type = other RNA
gcccgcgccggcacaaccctaaccagattcaactggttcgaccca

SEQ ID NO: 60755 - RNA, 45 nt, synthetic construct
  misc_feature 1..45: note = derived and/or modified sequence opt11 from anti-influenza_CDR
  source 1..45: mol_type = other RNA
gcgcgcgcgggcacgaccgtgaccaggttcaattggtttgacccg

SEQ ID NO: 60756 - RNA, 45 nt, synthetic construct
  misc_feature 1..45: note = derived and/or modified sequence opt11 from anti-influenza_CDR
  source 1..45: mol_type = other RNA
gcgcgcgggcaaaggtactattacgatcgcgatggcatggacgtg

SEQ ID NO: 60757 - RNA, 45 nt, synthetic construct
  misc_feature 1..45: note = derived and/or modified sequence opt11 from anti-influenza_CDR
  source 1..45: mol_type = other RNA
gcccgctcaggcggctacctaccccaaaacaactggatagaccca

SEQ ID NO: 60758 - RNA, 45 nt, synthetic construct
  misc_feature 1..45: note = derived and/or modified sequence opt11 from anti-influenza_CDR
  source 1..45: mol_type = other RNA
atggagaacgagcgcacgctcgatttccatgactcgaacgtgaaa

SEQ ID NO: 60759 - RNA, 45 nt, synthetic construct
  misc_feature 1..45: note = derived and/or modified sequence opt11 from anti-influenza_CDR
  source 1..45: mol_type = other RNA
ggggccgatcacgggagcgggagcaatttcgtgagcccgtacgtg

SEQ ID NO: 60760 - RNA, 45 nt, synthetic construct
  misc_feature 1..45: note = derived and/or modified sequence opt11 from anti-influenza_CDR
  source 1..45: mol_type = other RNA
gacacgagatcgagcctggacaattaccagtacgggatggacgtc

SEQ ID NO: 60761 - RNA, 45 nt, synthetic construct
  misc_feature 1..45: note = derived and/or modified sequence opt11 from anti-influenza_CDR
  source 1..45: mol_type = other RNA
gaggactatgacatactgacgggagcgggaccgggaatggaagtg

SEQ ID NO: 60762 - RNA, 45 nt, synthetic construct
  misc_feature 1..45: note = derived and/or modified sequence opt11 from anti-influenza_CDR
  source 1..45: mol_type = other RNA
cacccatacgacgtcctaaccggctccggcgactggttcgacccc

SEQ ID NO: 60763 - RNA, 45 nt, synthetic construct
  misc_feature 1..45: note = derived and/or modified sequence opt11 from anti-influenza_CDR
  source 1..45: mol_type = other RNA
ggggccgatcacgggagcgggaacaatttcgtgagcccgtacgtg

SEQ ID NO: 60764 - RNA, 45 nt, synthetic construct
  misc_feature 1..45: note = derived and/or modified sequence opt11 from anti-influenza_CDR
  source 1..45: mol_type = other RNA
gtgatatatagcgggggctcgacctattacgcggactcggtcaag

SEQ ID NO: 60765 - RNA, 45 nt, synthetic construct
  misc_feature 1..45: note = derived and/or modified sequence opt11 from anti-influenza_CDR
  source 1..45: mol_type = other RNA
tggtaccaacaaaaacccggcaaagcccccaaactcctcatctac

SEQ ID NO: 60766 - RNA, 45 nt, synthetic construct
  misc_feature 1..45: note = derived and/or modified sequence opt11 from anti-influenza_CDR
  source 1..45: mol_type = other RNA
gacccctacaacgacggcaccaaatacaacgaaaaattcgaagga

SEQ ID NO: 60767 - RNA, 45 nt, synthetic construct
  misc_feature 1..45: note = derived and/or modified sequence opt11 from anti-influenza_CDR
  source 1..45: mol_type = other RNA
gcacgagcacacacggccctgaccagattcagatggctggacccg

SEQ ID NO: 60768 - RNA, 45 nt, synthetic construct; identical to SEQ ID NO: 22558
  misc_feature 1..45: note = derived and/or modified sequence opt11 from anti-influenza_CDR
  source 1..45: mol_type = other RNA

SEQ ID NO: 60769 - RNA, 45 nt, synthetic construct
  misc_feature 1..45: note = derived and/or modified sequence opt11 from anti-influenza_CDR
  source 1..45: mol_type = other RNA
gcccgagtcgccaccccctactactacgaatccggcttcgactac

SEQ ID NO: 60770 - RNA, 45 nt, synthetic construct
  misc_feature 1..45: note = derived and/or modified sequence opt11 from anti-influenza_CDR
  source 1..45: mol_type = other RNA
gcgaggagggggggggggtggcagtattattatgggatggatgtg

SEQ ID NO: 60771 - RNA, 48 nt, synthetic construct
  misc_feature 1..48: note = derived and/or modified sequence opt11 from anti-influenza_CDR
  source 1..48: mol_type = other RNA
tccggccacatcacagtcttcggcgtcaacgtcgacgccttcgacatg

SEQ ID NO: 60772 - RNA, 48 nt, synthetic construct
  misc_feature 1..48: note = derived and/or modified sequence opt11 from anti-influenza_CDR
  source 1..48: mol_type = other RNA
ggcggccacataacagtcttcggcctaaacatagacgcctacgacata

SEQ ID NO: 60773 - RNA, 48 nt, synthetic construct
  misc_feature 1..48: note = derived and/or modified sequence opt11 from anti-influenza_CDR
  source 1..48: mol_type = other RNA
ggcggccacataacagaattcggcctaaacatagacgcctacgacata

SEQ ID NO: 60774 - RNA, 48 nt, synthetic construct
  misc_feature 1..48: note = derived and/or modified sequence opt11 from anti-influenza_CDR
  source 1..48: mol_type = other RNA
gggggccatataacggtcttcggcgtgaacatagacgcgttcgatata

SEQ ID NO: 60775 - RNA, 48 nt, synthetic construct
  misc_feature 1..48: note = derived and/or modified sequence opt11 from anti-influenza_CDR
  source 1..48: mol_type = other RNA
ggcggacacataacagtcttcggcgtcaacatagacgccttcgacgta

SEQ ID NO: 60776 - RNA, 48 nt, synthetic construct
  misc_feature 1..48: note = derived and/or modified sequence opt11 from anti-influenza_CDR
  source 1..48: mol_type = other RNA
gcgcgcgatggctggggccagcaattggtcccgtactatttcgattac

SEQ ID NO: 60777 - RNA, 48 nt, synthetic construct; identical to SEQ ID NO: 22567
  misc_feature 1..48: note = derived and/or modified sequence opt11 from anti-influenza_CDR
  source 1..48: mol_type = other RNA

SEQ ID NO: 60778 - RNA, 48 nt, synthetic construct
  misc_feature 1..48: note = derived and/or modified sequence opt11 from anti-influenza_CDR
  source 1..48: mol_type = other RNA
gcgagggcgggagtgaaaatattcgggctgatagtaggggcattggac

SEQ ID NO: 60779 - RNA, 48 nt, synthetic construct
  misc_feature 1..48: note = derived and/or modified sequence opt11 from anti-influenza_CDR
  source 1..48: mol_type = other RNA
gcacgcgacggcgcaggctcatactaccccctaaactggttcgacccc

SEQ ID NO: 60780 - RNA, 48 nt, synthetic construct
  misc_feature 1..48: note = derived and/or modified sequence opt11 from anti-influenza_CDR
  source 1..48: mol_type = other RNA
gtcatatactcgcacgggcgcgcgtactatagcgcgagcgtgaacggg

SEQ ID NO: 60781 - RNA, 48 nt, synthetic construct; identical to SEQ ID NO: 22571
  misc_feature 1..48: note = derived and/or modified sequence opt11 from anti-influenza_CDR
  source 1..48: mol_type = other RNA

SEQ ID NO: 60782 - RNA, 48 nt, synthetic construct
  misc_feature 1..48: note = derived and/or modified sequence opt11 from anti-influenza_CDR
  source 1..48: mol_type = other RNA
tacatctcctacaacggccgccccaaatacaacccctccctcacctcc

SEQ ID NO: 60783 - RNA, 48 nt, synthetic construct
  misc_feature 1..48: note = derived and/or modified sequence opt11 from anti-influenza_CDR
  source 1..48: mol_type = other RNA
gagaccaggttcggggaattgctctcgccctatgacgcgttcgagatc

SEQ ID NO: 60784 - RNA, 48 nt, synthetic construct
  misc_feature 1..48: note = derived and/or modified sequence opt11 from anti-influenza_CDR
  source 1..48: mol_type = other RNA
ctcatatactgggacgacgacaagcgctacagcccgagcctgaaaaga

SEQ ID NO: 60785 - RNA, 48 nt, synthetic construct
  misc_feature 1..48: note = derived and/or modified sequence opt11 from anti-influenza_CDR
  source 1..48: mol_type = other RNA
tacatctactacatcggcaacaccgactaccgcccctccctcaaatcc

SEQ ID NO: 60786 - RNA, 48 nt, synthetic construct
  misc_feature 1..48: note = derived and/or modified sequence opt11 from anti-influenza_CDR
  source 1..48: mol_type = other RNA
gaaatctcccacggcggctccaccaactacaacccctccctcaaatcc

SEQ ID NO: 60787 - RNA, 48 nt, synthetic construct
  misc_feature 1..48: note = derived and/or modified sequence opt11 from anti-influenza_CDR
  source 1..48: mol_type = other RNA
gaaatcaaccactccggccgcaccaactacaacccctccctcaaatcc

SEQ ID NO: 60788 - RNA, 48 nt, synthetic construct
  misc_feature 1..48: note = derived and/or modified sequence opt11 from anti-influenza_CDR
  source 1..48: mol_type = other RNA
ctcatctcctgggacgacgaaaaacactactccccctccctccaatcc

SEQ ID NO: 60789 - RNA, 48 nt, synthetic construct
  misc_feature 1..48: note = derived and/or modified sequence opt11 from anti-influenza_CDR
  source 1..48: mol_type = other RNA
gagggcgtgtactttgactcgggcacgtacaggggctatttcgattac

SEQ ID NO: 60790 - RNA, 48 nt, synthetic construct
  misc_feature 1..48: note = derived and/or modified sequence opt11 from anti-influenza_CDR
  source 1..48: mol_type = other RNA
tacatctaccactccggctccaccaactacaacccctccctcaaatcc

SEQ ID NO: 60791 - RNA, 48 nt, synthetic construct
  misc_feature 1..48: note = derived and/or modified sequence opt11 from anti-influenza_CDR
  source 1..48: mol_type = other RNA
tacatctactaccgcggctccaccttctacaacccctccctcaaatcc

SEQ ID NO: 60792 - RNA, 48 nt, synthetic construct
  misc_feature 1..48: note = derived and/or modified sequence opt11 from anti-influenza_CDR
  source 1..48: mol_type = other RNA
tacatctcctactccggctccaccaaatacaacccctccctccgctcc

SEQ ID NO: 60793 - RNA, 48 nt, synthetic construct
  misc_feature 1..48: note = derived and/or modified sequence opt11 from anti-influenza_CDR
  source 1..48: mol_type = other RNA
gaaatcaaacactccggccgcaccaactacaacccctccctcgaatcc

SEQ ID NO: 60794 - RNA, 48 nt, synthetic construct
  misc_feature 1..48: note = derived and/or modified sequence opt11 from anti-influenza_CDR
  source 1..48: mol_type = other RNA
gaaatcaaccactccggcggcaccaactacaacccctccctcaaacgc

SEQ ID NO: 60795 - RNA, 48 nt, synthetic construct
  misc_feature 1..48: note = derived and/or modified sequence opt11 from anti-influenza_CDR
  source 1..48: mol_type = other RNA
ttcatgtactactccgcctccacctactacaacccctccctcaaatcc

SEQ ID NO: 60796 - RNA, 48 nt, synthetic construct
  misc_feature 1..48: note = derived and/or modified sequence opt11 from anti-influenza_CDR
  source 1..48: mol_type = other RNA
tacgtctactactccggctccaccacctacaacccctccctcaaatcc

SEQ ID NO: 60797 - RNA, 48 nt, synthetic construct; identical to SEQ ID NO: 22587
  misc_feature 1..48: note = derived and/or modified sequence opt11 from anti-influenza_CDR
  source 1..48: mol_type = other RNA

SEQ ID NO: 60798 - RNA, 48 nt, synthetic construct
  misc_feature 1..48: note = derived and/or modified sequence opt11 from anti-influenza_CDR
  source 1..48: mol_type = other RNA
ttcatctactacggcggcaacaccaaatacaacccctccctcaaatcc

SEQ ID NO: 60799 - RNA, 48 nt, synthetic construct
  misc_feature 1..48: note = derived and/or modified sequence opt11 from anti-influenza_CDR
  source 1..48: mol_type = other RNA
ttcatgttccactccggctccccccgctacaaccccaccctcaaatcc

SEQ ID NO: 60800 - RNA, 48 nt, synthetic construct
  misc_feature 1..48: note = derived and/or modified sequence opt11 from anti-influenza_CDR
  source 1..48: mol_type = other RNA
ttcttctacaacggcggctccaccaaatacaacccctccctcaaatcc

SEQ ID NO: 60801 - RNA, 48 nt, synthetic construct
  misc_feature 1..48: note = derived and/or modified sequence opt11 from anti-influenza_CDR
  source 1..48: mol_type = other RNA
cacatctacgactacggccgcaccttctacaactcctccctccaatcc

SEQ ID NO: 60802 - RNA, 48 nt, synthetic construct
  misc_feature 1..48: note = derived and/or modified sequence opt11 from anti-influenza_CDR
  source 1..48: mol_type = other RNA
gtcttctactccgaaacccgcacctactacgccgactccgtcaaaggc

SEQ ID NO: 60803 - RNA, 48 nt, synthetic construct
  misc_feature 1..48: note = derived and/or modified sequence opt11 from anti-influenza_CDR
  source 1..48: mol_type = other RNA
tacgtctacaaccgcggctccaccaaatactccccctccctcaaatcc

SEQ ID NO: 60804 - RNA, 48 nt, synthetic construct
  misc_feature 1..48: note = derived and/or modified sequence opt11 from anti-influenza_CDR
  source 1..48: mol_type = other RNA
tacatctacaaccgcggctccaccaaatacaccccctccctcaaatcc

SEQ ID NO: 60805 - RNA, 48 nt, synthetic construct
  misc_feature 1..48: note = derived and/or modified sequence opt11 from anti-influenza_CDR
  source 1..48: mol_type = other RNA
tacctctactactccggctccaccaaatacaacccctccctcaaatcc

SEQ ID NO: 60806 - RNA, 48 nt, synthetic construct
  misc_feature 1..48: note = derived and/or modified sequence opt11 from anti-influenza_CDR
  source 1..48: mol_type = other RNA
tacgtctacaactccggcaacaccaaatacaacccctccctcaaatcc

SEQ ID NO: 60807 - RNA, 48 nt, synthetic construct
  misc_feature 1..48: note = derived and/or modified sequence opt11 from anti-influenza_CDR
  source 1..48: mol_type = other RNA
cacatcttcgactccggctccacctactacaacccctccctcaaatcc

SEQ ID NO: 60808 - RNA, 48 nt, synthetic construct
  misc_feature 1..48: note = derived and/or modified sequence opt11 from anti-influenza_CDR
  source 1..48: mol_type = other RNA
gtcttctactccgccgaccgcacctcctacgccgactccgtcaaaggc

SEQ ID NO: 60809 - RNA, 48 nt, synthetic construct
  misc_feature 1..48: note = derived and/or modified sequence opt11 from anti-influenza_CDR
  source 1..48: mol_type = other RNA
tacatctactactccggcaacacctactacaacccctccctcaaatcc

SEQ ID NO: 60810 - RNA, 48 nt, synthetic construct
  misc_feature 1..48: note = derived and/or modified sequence opt11 from anti-influenza_CDR
  source 1..48: mol_type = other RNA
cgctcctcccaatccctcctccactccaacggctacaactacctcgac

SEQ ID NO: 60811 - RNA, 48 nt, synthetic construct
  misc_feature 1..48: note = derived and/or modified sequence opt11 from anti-influenza_CDR
  source 1..48: mol_type = other RNA
accatctaccactccggctccacctactacaacccctccctcaaatcc

SEQ ID NO: 60812 - RNA, 48 nt, synthetic construct
  misc_feature 1..48: note = derived and/or modified sequence opt11 from anti-influenza_CDR
  source 1..48: mol_type = other RNA
cgctcctcccaatccctcctccactccaacggccacatctacttcgac

SEQ ID NO: 60813 - RNA, 48 nt, synthetic construct
  misc_feature 1..48: note = derived and/or modified sequence opt11 from anti-influenza_CDR
  source 1..48: mol_type = other RNA
atctggggcgtggccgcgccctcgaccgcgagcgcgcaaacgagcttg

SEQ ID NO: 60814 - RNA, 48 nt, synthetic construct
  misc_feature 1..48: note = derived and/or modified sequence opt11 from anti-influenza_CDR
  source 1..48: mol_type = other RNA
cgctcctcccaatccctcctctacaccgacggcttcacctacctctcc

SEQ ID NO: 60815 - RNA, 48 nt, synthetic construct
  misc_feature 1..48: note = derived and/or modified sequence opt11 from anti-influenza_CDR
  source 1..48: mol_type = other RNA
gccaaaccacgcctagactacctcgactacttccacgccgccgactcc

SEQ ID NO: 60816 - RNA, 48 nt, synthetic construct
  misc_feature 1..48: note = derived and/or modified sequence opt11 from anti-influenza_CDR
  source 1..48: mol_type = other RNA
gcccgctcccccggttactccggctatctctacggctggttcgacccc

SEQ ID NO: 60817 - RNA, 48 nt, synthetic construct
  misc_feature 1..48: note = derived and/or modified sequence opt11 from anti-influenza_CDR
  source 1..48: mol_type = other RNA
gcgatagcgggctcgggatcggccgattacgcgagctgggcaaaggga

SEQ ID NO: 60818 - RNA, 48 nt, synthetic construct
  misc_feature 1..48: note = derived and/or modified sequence opt11 from anti-influenza_CDR
  source 1..48: mol_type = other RNA
gcgatagcgggctcgggatcggccgattacgcgagctgggcaaagagc

SEQ ID NO: 60819 - RNA, 48 nt, synthetic construct
  misc_feature 1..48: note = derived and/or modified sequence opt11 from anti-influenza_CDR
  source 1..48: mol_type = other RNA
gcgataggggggggggggagtgcggattatgcgagttgggcgaagagt

SEQ ID NO: 60820 - RNA, 48 nt, synthetic construct
  misc_feature 1..48: note = derived and/or modified sequence opt11 from anti-influenza_CDR
  source 1..48: mol_type = other RNA
cgctcctcccaatccctcctccgctccaacggctacaactacctcgac

SEQ ID NO: 60821 - RNA, 48 nt, synthetic construct
  misc_feature 1..48: note = derived and/or modified sequence opt11 from anti-influenza_CDR
  source 1..48: mol_type = other RNA
caaggcgaccacatagcctggctcctccgcggaatcaacttcgactac

SEQ ID NO: 60822 - RNA, 51 nt, synthetic construct
  misc_feature 1..51: note = derived and/or modified sequence opt11 from anti-influenza_CDR
  source 1..51: mol_type = other RNA
gcccgactcggctccggctcataccacaacggccccaactggttcgaccca

SEQ ID NO: 60823 - RNA, 51 nt, synthetic construct
  misc_feature 1..51: note = derived and/or modified sequence opt11 from anti-influenza_CDR
  source 1..51: mol_type = other RNA
gcccgcgccgaaaacctcctctccccctacctcgccgaaggcttcgaccca

SEQ ID NO: 60824 - RNA, 51 nt, synthetic construct
  misc_feature 1..51: note = derived and/or modified sequence opt11 from anti-influenza_CDR
  source 1..51: mol_type = other RNA
gtgatctcgtacgatggctcgaacaagtactatgccgatagcgtgaaaggg

SEQ ID NO: 60825 - RNA, 51 nt, synthetic construct
  misc_feature 1..51: note = derived and/or modified sequence opt11 from anti-influenza_CDR
  source 1..51: mol_type = other RNA
ggcacaatcccgctcctgggcacgaccaactacgcacaaaaattccagggc

SEQ ID NO: 60826 - RNA, 51 nt, synthetic construct
  misc_feature 1..51: note = derived and/or modified sequence opt11 from anti-influenza_CDR
  source 1..51: mol_type = other RNA
ggcataatcgcggtcttcaacacggccaactacgcgcaaaagttccagggc

SEQ ID NO: 60827 - RNA, 51 nt, synthetic construct
  misc_feature 1..51: note = derived and/or modified sequence opt11 from anti-influenza_CDR
  source 1..51: mol_type = other RNA
aatatagaggacgatgggggggacaagtactatgtggatagcgtgaagggg

SEQ ID NO: 60828 - RNA, 51 nt, synthetic construct
  misc_feature 1..51: note = derived and/or modified sequence opt11 from anti-influenza_CDR
  source 1..51: mol_type = other RNA
tggataaacccgaactcgggcacgaccgggagcgcgcaaaggttccagggc

SEQ ID NO: 60829 - RNA, 51 nt, synthetic construct
  misc_feature 1..51: note = derived and/or modified sequence opt11 from anti-influenza_CDR
  source 1..51: mol_type = other RNA
ggcatcaaccccgtcttcggccgcccccactacgcccaaaaattccaaggc

SEQ ID NO: 60830 - RNA, 51 nt, synthetic construct
  misc_feature 1..51: note = derived and/or modified sequence opt11 from anti-influenza_CDR
  source 1..51: mol_type = other RNA
ggcatcatccccctcatcaacgcccccaactacgcccccaaattccaaggc

SEQ ID NO: 60831 - RNA, 51 nt, synthetic construct
  misc_feature 1..51: note = derived and/or modified sequence opt11 from anti-influenza_CDR
  source 1..51: mol_type = other RNA
ggcataatcccgatgatgggcacggtcaactacgcgcaaaagctccagggc

SEQ ID NO: 60832 - RNA, 51 nt, synthetic construct
  misc_feature 1..51: note = derived and/or modified sequence opt11 from anti-influenza_CDR
  source 1..51: mol_type = other RNA
ggcataatcccgctcttcggcgcggccaagtacgcgcaaaaattccagggc

SEQ ID NO: 60833 - RNA, 51 nt, synthetic construct
  misc_feature 1..51: note = derived and/or modified sequence opt11 from anti-influenza_CDR
  source 1..51: mol_type = other RNA
aaatcctcccaacgcgtcctctactcctccaacaacaaaaactacctcgcc

SEQ ID NO: 60834 - RNA, 51 nt, synthetic construct
  misc_feature 1..51: note = derived and/or modified sequence opt11 from anti-influenza_CDR
  source 1..51: mol_type = other RNA
ttgatctcggacgatggctcgaacaagttctatgccgatagcgtgaaaggg

SEQ ID NO: 60835 - RNA, 51 nt, synthetic construct
  misc_feature 1..51: note = derived and/or modified sequence opt11 from anti-influenza_CDR
  source 1..51: mol_type = other RNA
ataataagctacgacgggaacgaccaatactacacggactcggtcaagggc

SEQ ID NO: 60836 - RNA, 51 nt, synthetic construct
  misc_feature 1..51: note = derived and/or modified sequence opt11 from anti-influenza_CDR
  source 1..51: mol_type = other RNA
tggatctccacctacaacggcaacaccaacttcgcccaaaacttccaaggc

SEQ ID NO: 60837 - RNA, 51 nt, synthetic construct
  misc_feature 1..51: note = derived and/or modified sequence opt11 from anti-influenza_CDR
  source 1..51: mol_type = other RNA
gtcgaaggcagctaccgcgacttctggaacaaccaaaaccgcttcgaccca

SEQ ID NO: 60838 - RNA, 51 nt, synthetic construct
  misc_feature 1..51: note = derived and/or modified sequence opt11 from anti-influenza_CDR
  source 1..51: mol_type = other RNA
tggatcaaccccaactcaggcgacaccaactacgcccaaaaattccaaggc

SEQ ID NO: 60839 - RNA, 51 nt, synthetic construct
  misc_feature 1..51: note = derived and/or modified sequence opt11 from anti-influenza_CDR
  source 1..51: mol_type = other RNA
aaatcctcccaatccgtcctctactcctccaacaacaaatcccacctcgcc

SEQ ID NO: 60840 - RNA, 51 nt, synthetic construct
  misc_feature 1..51: note = derived and/or modified sequence opt11 from anti-influenza_CDR
  source 1..51: mol_type = other RNA
atcatctaccccggcgactccgacacccgctactccccctccttccaaggc

SEQ ID NO: 60841 - RNA, 51 nt, synthetic construct
  misc_feature 1..51: note = derived and/or modified sequence opt11 from anti-influenza_CDR
  source 1..51: mol_type = other RNA
ggcatcatccccgtcttccccacccccaactacgcccaaatgttccaaggc

SEQ ID NO: 60842 - RNA, 51 nt, synthetic construct
  misc_feature 1..51: note = derived and/or modified sequence opt11 from anti-influenza_CDR
  source 1..51: mol_type = other RNA
ggaatcgtccccgtcttcggcaccgccaactacgcccaaaaattccaaggc

SEQ ID NO: 60843 - RNA, 51 nt, synthetic construct
  misc_feature 1..51: note = derived and/or modified sequence opt11 from anti-influenza_CDR
  source 1..51: mol_type = other RNA
tggataaacccggaatcgggcgacaccaagtacgcgcaaaaattccagggc

SEQ ID NO: 60844 - RNA, 51 nt, synthetic construct
  misc_feature 1..51: note = derived and/or modified sequence opt11 from anti-influenza_CDR
  source 1..51: mol_type = other RNA
cgctcctcccaatccatcttccacaactccaacaacgaaaactacctcgcc

SEQ ID NO: 60845 - RNA, 51 nt, synthetic construct
  misc_feature 1..51: note = derived and/or modified sequence opt11 from anti-influenza_CDR
  source 1..51: mol_type = other RNA
tggataaacgcgaaaaggggcgggaccaattacgcgcaaaagttccagggc

SEQ ID NO: 60846 - RNA, 51 nt, synthetic construct
  misc_feature 1..51: note = derived and/or modified sequence opt11 from anti-influenza_CDR
  source 1..51: mol_type = other RNA
tggatcaaccccgactccggcgccacctcatccgcccaaaacttccaaggc

SEQ ID NO: 60847 - RNA, 51 nt, synthetic construct
  misc_feature 1..51: note = derived and/or modified sequence opt11 from anti-influenza_CDR
  source 1..51: mol_type = other RNA
tggataagcccggactcggacgcgaccaagtacgcgcaaaagttccagggc

SEQ ID NO: 60848 - RNA, 51 nt, synthetic construct
  misc_feature 1..51: note = derived and/or modified sequence opt11 from anti-influenza_CDR
  source 1..51: mol_type = other RNA
aacataaaacaggacgggcgcgagaaatattacgtggactcgctcaggggc

SEQ ID NO: 60849 - RNA, 51 nt, synthetic construct
  misc_feature 1..51: note = derived and/or modified sequence opt11 from anti-influenza_CDR
  source 1..51: mol_type = other RNA
ggcataatcgcgatctttggcacgcccaagtacgcgcaaaagttccagggc

SEQ ID NO: 60850 - RNA, 51 nt, synthetic construct; identical to SEQ ID NO: 53208
  misc_feature 1..51: note = derived and/or modified sequence opt11 from anti-influenza_CDR
  source 1..51: mol_type = other RNA

SEQ ID NO: 60851 - RNA, 51 nt, synthetic construct
  misc_feature 1..51: note = derived and/or modified sequence opt11 from anti-influenza_CDR
  source 1..51: mol_type = other RNA
tggataagcgcatacaacggcaacaccaactacgcacaaaaattccagggc

SEQ ID NO: 60852 - RNA, 51 nt, synthetic construct
  misc_feature 1..51: note = derived and/or modified sequence opt11 from anti-influenza_CDR
  source 1..51: mol_type = other RNA
ggcgtcatccccatcttccgcaccgccaactacgcccaaaacttccaaggc

SEQ ID NO: 60853 - RNA, 51 nt, synthetic construct
  misc_feature 1..51: note = derived and/or modified sequence opt11 from anti-influenza_CDR
  source 1..51: mol_type = other RNA
ggcataatcgcgatctttcacacgcccaagtacgcgcaaaagttccagggc

SEQ ID NO: 60854 - RNA, 51 nt, synthetic construct
  misc_feature 1..51: note = derived and/or modified sequence opt11 from anti-influenza_CDR
  source 1..51: mol_type = other RNA
ggcatctcccccatgttcggcaccaccacctacgcccaaaaattccaaggc

SEQ ID NO: 60855 - RNA, 51 nt, synthetic construct
  misc_feature 1..51: note = derived and/or modified sequence opt11 from anti-influenza_CDR
  source 1..51: mol_type = other RNA
aagagctcgcaatcggtcctgtactcgagcaataacaagaactatctcgcg

SEQ ID NO: 60856 - RNA, 51 nt, synthetic construct
  misc_feature 1..51: note = derived and/or modified sequence opt11 from anti-influenza_CDR
  source 1..51: mol_type = other RNA
ggcatcatccccatcttcggcaccaccaaatacgcccccaaattccaaggc

SEQ ID NO: 60857 - RNA, 51 nt, synthetic construct
  misc_feature 1..51: note = derived and/or modified sequence opt11 from anti-influenza_CDR
  source 1..51: mol_type = other RNA
ggcatctcccccctcttcggcaccaccaactacgcccaaaaattccaaggc

SEQ ID NO: 60858 - RNA, 51 nt, synthetic construct
  misc_feature 1..51: note = derived and/or modified sequence opt11 from anti-influenza_CDR
  source 1..51: mol_type = other RNA
ggaataatggggatgttcgggacgacaaactacgcgcagaagttccaggga

SEQ ID NO: 60859 - RNA, 51 nt, synthetic construct
  misc_feature 1..51: note = derived and/or modified sequence opt11 from anti-influenza_CDR
  source 1..51: mol_type = other RNA
gggatcataggcatgttcgggagcacgaactatgcccagaactttcaaggg

SEQ ID NO: 60860 - RNA, 51 nt, synthetic construct
  misc_feature 1..51: note = derived and/or modified sequence opt11 from anti-influenza_CDR
  source 1..51: mol_type = other RNA
tggatcaaccccaactcaggcggcaccaactacgcccaaaaattccaaggc

SEQ ID NO: 60861 - RNA, 51 nt, synthetic construct
  misc_feature 1..51: note = derived and/or modified sequence opt11 from anti-influenza_CDR
  source 1..51: mol_type = other RNA
gcgatctcgagctcgggcgatagcacgtactatgccgatagcgtgaaaggg

SEQ ID NO: 60862 - RNA, 51 nt, synthetic construct
  misc_feature 1..51: note = derived and/or modified sequence opt11 from anti-influenza_CDR
  source 1..51: mol_type = other RNA
tccatctcctcctcctcctcctacatctactacgtcgactccgtcaaaggc

SEQ ID NO: 60863 - RNA, 51 nt, synthetic construct
  misc_feature 1..51: note = derived and/or modified sequence opt11 from anti-influenza_CDR
  source 1..51: mol_type = other RNA
gacatcataggcatgttcgggagcacgaactatgcccagaacttccaaggg

SEQ ID NO: 60864 - RNA, 51 nt, synthetic construct
  misc_feature 1..51: note = derived and/or modified sequence opt11 from anti-influenza_CDR
  source 1..51: mol_type = other RNA
ggcatcatccccatgttcggcaccaccaactacgcccaaaaattccaaggc

SEQ ID NO: 60865 - RNA, 51 nt, synthetic construct
  misc_feature 1..51: note = derived and/or modified sequence opt11 from anti-influenza_CDR
  source 1..51: mol_type = other RNA
ggcatcatcgccatcttcggcaccgccaactacgcccaaaaattccaaggc

SEQ ID NO: 60866 - RNA, 51 nt, synthetic construct
  misc_feature 1..51: note = derived and/or modified sequence opt11 from anti-influenza_CDR
  source 1..51: mol_type = other RNA
ggcatcatccccatcttcggcaccaccaactacgcccaaaaattccaaggc

SEQ ID NO: 60867 - RNA, 51 nt, synthetic construct
  misc_feature 1..51: note = derived and/or modified sequence opt11 from anti-influenza_CDR
  source 1..51: mol_type = other RNA
ggcatattcgcgctctttggcacgaccgattacgcgcaaaagttccagggc

SEQ ID NO: 60868 - RNA, 51 nt, synthetic construct
  misc_feature 1..51: note = derived and/or modified sequence opt11 from anti-influenza_CDR
  source 1..51: mol_type = other RNA
ggaataatcgggatgttcggcacggccaactacgcgcaaaagttccagggc

SEQ ID NO: 60869 - RNA, 51 nt, synthetic construct
  misc_feature 1..51: note = derived and/or modified sequence opt11 from anti-influenza_CDR
  source 1..51: mol_type = other RNA
ggcataatcgcggtctttggcacgaccaagtacgcgcacaagttccagggc

SEQ ID NO: 60870 - RNA, 51 nt, synthetic construct
  misc_feature 1..51: note = derived and/or modified sequence opt11 from anti-influenza_CDR
  source 1..51: mol_type = other RNA
ggcatactcggggtctttggctcgccctcgtacgcgcaaaagttccagggc

SEQ ID NO: 60871 - RNA, 51 nt, synthetic construct
  misc_feature 1..51: note = derived and/or modified sequence opt11 from anti-influenza_CDR
  source 1..51: mol_type = other RNA
ggcatcttcggcatgttcggcaccgccaactacgcccaaaaattccaaggc

SEQ ID NO: 60872 - RNA, 51 nt, synthetic construct
  misc_feature 1..51: note = derived and/or modified sequence opt11 from anti-influenza_CDR
  source 1..51: mol_type = other RNA
tggataagcgcgtacacgggcgataccgattacgcgcaaaagttccagggc

SEQ ID NO: 60873 - RNA, 51 nt, synthetic construct
  misc_feature 1..51: note = derived and/or modified sequence opt11 from anti-influenza_CDR
  source 1..51: mol_type = other RNA
agcttcgacccggaagacggcgagaccatatacgcacaaaaattccagggc

SEQ ID NO: 60874 - RNA, 51 nt, synthetic construct
  misc_feature 1..51: note = derived and/or modified sequence opt11 from anti-influenza_CDR
  source 1..51: mol_type = other RNA
gggatctcgggctcgggcgagagcacgtactatgccgatagcgtgaaaggg

SEQ ID NO: 60875 - RNA, 51 nt, synthetic construct
  misc_feature 1..51: note = derived and/or modified sequence opt11 from anti-influenza_CDR
  source 1..51: mol_type = other RNA
gtggtctcgtacgatggcaattacaagtactatgccgatagcgtgcaaggg

SEQ ID NO: 60876 - RNA, 51 nt, synthetic construct
  misc_feature 1..51: note = derived and/or modified sequence opt11 from anti-influenza_CDR
  source 1..51: mol_type = other RNA
ggctccatctcctactccggctccacctactaccacccctccctcaaatcc

SEQ ID NO: 60877 - RNA, 51 nt, synthetic construct
  misc_feature 1..51: note = derived and/or modified sequence opt11 from anti-influenza_CDR
  source 1..51: mol_type = other RNA
acgagagggaggccgatagggagaaattgggagccgagggacaaggactat

SEQ ID NO: 60878 - RNA, 51 nt, synthetic construct
  misc_feature 1..51: note = derived and/or modified sequence opt11 from anti-influenza_CDR
  source 1..51: mol_type = other RNA
gcgcgcgaggccgggtaccatagctcgttctcgggcgtgtactttgactat

SEQ ID NO: 60879 - RNA, 51 nt, synthetic construct
  misc_feature 1..51: note = derived and/or modified sequence opt11 from anti-influenza_CDR
  source 1..51: mol_type = other RNA
cgaatagacccgaacgggagcgggaccacgtacgcgcaaaagttccagggc

SEQ ID NO: 60880 - RNA, 51 nt, synthetic construct
  misc_feature 1..51: note = derived and/or modified sequence opt11 from anti-influenza_CDR
  source 1..51: mol_type = other RNA
cgaatagacccgaacggggccgggaccacgtacgcgcaaaaattccagggc

SEQ ID NO: 60881 - RNA, 51 nt, synthetic construct
  misc_feature 1..51: note = derived and/or modified sequence opt11 from anti-influenza_CDR
  source 1..51: mol_type = other RNA
tggatcgaccccaacaacgacggcaccatatacgcccaaaaattccaaggc

SEQ ID NO: 60882 - RNA, 51 nt, synthetic construct
  misc_feature 1..51: note = derived and/or modified sequence opt11 from anti-influenza_CDR
  source 1..51: mol_type = other RNA
atgatgtaccccggcgactccgacaccatctactcaccctccttccaaggc

SEQ ID NO: 60883 - RNA, 51 nt, synthetic construct
  misc_feature 1..51: note = derived and/or modified sequence opt11 from anti-influenza_CDR
  source 1..51: mol_type = other RNA
atgatgtaccccggcgacgccgacgccatctactcaccctccttccaaggc

SEQ ID NO: 60884 - RNA, 51 nt, synthetic construct
  misc_feature 1..51: note = derived and/or modified sequence opt11 from anti-influenza_CDR
  source 1..51: mol_type = other RNA
atgatgtacccgggcgagagcgagaccatatactcgccctcattccagggc

SEQ ID NO: 60885 - RNA, 51 nt, synthetic construct
  misc_feature 1..51: note = derived and/or modified sequence opt11 from anti-influenza_CDR
  source 1..51: mol_type = other RNA
atgatgtaccccggcgacgccgacaccatatactcaccctccttccaaggc

SEQ ID NO: 60886 - RNA, 51 nt, synthetic construct
  misc_feature 1..51: note = derived and/or modified sequence opt11 from anti-influenza_CDR
  source 1..51: mol_type = other RNA
atgatgtaccccggctcctccgacaccatctactccccctccttccaaggc

SEQ ID NO: 60887 - RNA, 51 nt, synthetic construct
  misc_feature 1..51: note = derived and/or modified sequence opt11 from anti-influenza_CDR
  source 1..51: mol_type = other RNA
atgatgtaccccggcgactccgacgccatctactcaccctccttccaaggc

SEQ ID NO: 60888 - RNA, 51 nt, synthetic construct
  misc_feature 1..51: note = derived and/or modified sequence opt11 from anti-influenza_CDR
  source 1..51: mol_type = other RNA
atgatgtaccccggcgacaccgacaccatatactcaccctccttccaaggc

SEQ ID NO: 60889 - RNA, 51 nt, synthetic construct
  misc_feature 1..51: note = derived and/or modified sequence opt11 from anti-influenza_CDR
  source 1..51: mol_type = other RNA
atgatgtacccgggcgaaagcgacaccatatactcgccctcattccagggc

SEQ ID NO: 60890 - RNA, 51 nt, synthetic construct
  misc_feature 1..51: note = derived and/or modified sequence opt11 from anti-influenza_CDR
  source 1..51: mol_type = other RNA
gtaataagctgggactcgggaaggatagggtacgcggactcggtaaaggga

SEQ ID NO: 60891 - RNA, 51 nt, synthetic construct; identical to SEQ ID NO: 22681
  misc_feature 1..51: note = derived and/or modified sequence opt11 from anti-influenza_CDR
  source 1..51: mol_type = other RNA

SEQ ID NO: 60892 - RNA, 51 nt, synthetic construct; identical to SEQ ID NO: 22682
  misc_feature 1..51: note = derived and/or modified sequence opt11 from anti-influenza_CDR
  source 1..51: mol_type = other RNA

SEQ ID NO: 60893 - RNA, 51 nt, synthetic construct
  misc_feature 1..51: note = derived and/or modified sequence opt11 from anti-influenza_CDR
  source 1..51: mol_type = other RNA
ataataagttgggatagcgggaggatagggtatgcggatagcgtgaggggg

SEQ ID NO: 60894 - RNA, 51 nt, synthetic construct
  misc_feature 1..51: note = derived and/or modified sequence opt11 from anti-influenza_CDR
  source 1..51: mol_type = other RNA
cacgggggcgtgtactattacgggagcgcgagctcgggctggttcgatccc

SEQ ID NO: 60895 - RNA, 54 nt, synthetic construct
  misc_feature 1..54: note = derived and/or modified sequence opt11 from anti-influenza_CDR
  source 1..54: mol_type = other RNA
cgcacgtactaccgctcgaaatggtacaatgactacgccgagagcgtgaaatcg

SEQ ID NO: 60896 - RNA, 54 nt, synthetic construct
  misc_feature 1..54: note = derived and/or modified sequence opt11 from anti-influenza_CDR
  source 1..54: mol_type = other RNA
cgcacctactaccgctccaaatggtactacgactacgccgaatccgtcaaatcc

SEQ ID NO: 60897 - RNA, 54 nt, synthetic construct
  misc_feature 1..54: note = derived and/or modified sequence opt11 from anti-influenza_CDR
  source 1..54: mol_type = other RNA
cgcacctactaccgctccaaatggtacaacgactacgccgtctccgtcaaatcc

SEQ ID NO: 60898 - RNA, 54 nt, synthetic construct
  misc_feature 1..54: note = derived and/or modified sequence opt11 from anti-influenza_CDR
  source 1..54: mol_type = other RNA
cgcacctactaccgctccaaatggtacaacgactacgccgacttcctcaaacgc

SEQ ID NO: 60899 - RNA, 54 nt, synthetic construct
  misc_feature 1..54: note = derived and/or modified sequence opt11 from anti-influenza_CDR
  source 1..54: mol_type = other RNA
aggacatattacaggagcgggtggtataacgattacgcggaatcggtcaagagc

SEQ ID NO: 60900 - RNA, 54 nt, synthetic construct
  misc_feature 1..54: note = derived and/or modified sequence opt11 from anti-influenza_CDR
  source 1..54: mol_type = other RNA
gcgcgcttgggcgggaacaaggactatggcgattacttgtggtatttcgatctc

SEQ ID NO: 60901 - RNA, 54 nt, synthetic construct
  misc_feature 1..54: note = derived and/or modified sequence opt11 from anti-influenza_CDR
  source 1..54: mol_type = other RNA
gcaaaagacaccgcagaccacggcgactacgtagacctaggcttcttcgacgcc

SEQ ID NO: 60902 - RNA, 54 nt, synthetic construct
  misc_feature 1..54: note = derived and/or modified sequence opt11 from anti-influenza_CDR
  source 1..54: mol_type = other RNA
gcgcgctcgggcatattcgattggtcggccccgctcgtggaagcgttcgatatc

SEQ ID NO: 60903 - RNA, 54 nt, synthetic construct
  misc_feature 1..54: note = derived and/or modified sequence opt11 from anti-influenza_CDR
  source 1..54: mol_type = other RNA
gccaggcacgcgagctgtagcgcgagatcgtgctattgggggccagtggactat

SEQ ID NO: 60904 - RNA, 54 nt, synthetic construct
  misc_feature 1..54: note = derived and/or modified sequence opt11 from anti-influenza_CDR
  source 1..54: mol_type = other RNA
gacgccccccccaacgtcgaagtcgcctccatgaccaactggtacttcgacctc

SEQ ID NO: 60905 - RNA, 54 nt, synthetic construct
  misc_feature 1..54: note = derived and/or modified sequence opt11 from anti-influenza_CDR
  source 1..54: mol_type = other RNA
ctacgcacagactacggcgaccccgactcagtctactactacggaatggacgtc

SEQ ID NO: 60906 - RNA, 54 nt, synthetic construct
  misc_feature 1..54: note = derived and/or modified sequence opt11 from anti-influenza_CDR
  source 1..54: mol_type = other RNA
ggcacatgcgcaggcgactgctcactccactactactactacggcctggacgta

SEQ ID NO: 60907 - RNA, 54 nt, synthetic construct
  misc_feature 1..54: note = derived and/or modified sequence opt11 from anti-influenza_CDR
  source 1..54: mol_type = other RNA
cacgtctccgtctcccacggcggccgcacaaaatcaaacccctccgtcatgtca

SEQ ID NO: 60908 - RNA, 54 nt, synthetic construct
  misc_feature 1..54: note = derived and/or modified sequence opt11 from anti-influenza_CDR
  source 1..54: mol_type = other RNA
gcgctcatatactttgacgggagcaagcaatactacgcggactcggtcaagggc

SEQ ID NO: 60909 - RNA, 54 nt, synthetic construct
  misc_feature 1..54: note = derived and/or modified sequence opt11 from anti-influenza_CDR
  source 1..54: mol_type = other RNA
accctaatctcctacgacggcgccaaccaatactacgccgactccgtcaaaggc

SEQ ID NO: 60910 - RNA, 54 nt, synthetic construct; identical to SEQ ID NO: 22700
  misc_feature 1..54: note = derived and/or modified sequence opt11 from anti-influenza_CDR
  source 1..54: mol_type = other RNA

SEQ ID NO: 60911 - RNA, 54 nt, synthetic construct
  misc_feature 1..54: note = derived and/or modified sequence opt11 from anti-influenza_CDR
  source 1..54: mol_type = other RNA
gggggcataatcccgatctttggcgcggccaattacgcgcaaaagttccagggc

SEQ ID NO: 60912 - RNA, 54 nt, synthetic construct
  misc_feature 1..54: note = derived and/or modified sequence opt11 from anti-influenza_CDR
  source 1..54: mol_type = other RNA
ggatggataagcgcatacacaggcaacacccactacgcaaaaaacttcgaaggc

SEQ ID NO: 60913 - RNA, 54 nt, synthetic construct
  misc_feature 1..54: note = derived and/or modified sequence opt11 from anti-influenza_CDR
  source 1..54: mol_type = other RNA
gggtggataaacccgaactttggcgggacccattacgcgcgcaagttccagggc

SEQ ID NO: 60914 - RNA, 54 nt, synthetic construct
  misc_feature 1..54: note = derived and/or modified sequence opt11 from anti-influenza_CDR
  source 1..54: mol_type = other RNA
gtgaggtggagggcggcggcggtgataatggatcagttttataagatggatgtg

SEQ ID NO: 60915 - RNA, 54 nt, synthetic construct; identical to SEQ ID NO: 22705
  misc_feature 1..54: note = derived and/or modified sequence opt11 from anti-influenza_CDR
  source 1..54: mol_type = other RNA

SEQ ID NO: 60916 - RNA, 54 nt, synthetic construct
  misc_feature 1..54: note = derived and/or modified sequence opt11 from anti-influenza_CDR
  source 1..54: mol_type = other RNA
gccgcctccaccgccacctcaggcacctactacgccatgcgcccattcgacttc

SEQ ID NO: 60917 - RNA, 57 nt, synthetic construct
  misc_feature 1..57: note = derived and/or modified sequence opt11 from anti-influenza_CDR
  source 1..57: mol_type = other RNA
gcgcgcgggaaaaggcccgggtactgtagcgggggcgtgtgctcgagcgattactgg

SEQ ID NO: 60918 - RNA, 57 nt, synthetic construct
  misc_feature 1..57: note = derived and/or modified sequence opt11 from anti-influenza_CDR
  source 1..57: mol_type = other RNA
gcccgccactacccctactacgacctccccaccggcttctactcccaattcgacttc

SEQ ID NO: 60919 - RNA, 57 nt, synthetic construct
  misc_feature 1..57: note = derived and/or modified sequence opt11 from anti-influenza_CDR
  source 1..57: mol_type = other RNA
gggtcgggggggtatggggggtttgattattttgggaagttgaggacgtgggatttt

SEQ ID NO: 60920 - RNA, 57 nt, synthetic construct
  misc_feature 1..57: note = derived and/or modified sequence opt11 from anti-influenza_CDR
  source 1..57: mol_type = other RNA
ttcataagaacgagaccgtggggagggacggcagataccgcggcctcggtcaagggc

SEQ ID NO: 60921 - RNA, 57 nt, synthetic construct; identical to SEQ ID NO: 22711
  misc_feature 1..57: note = derived and/or modified sequence opt11 from anti-influenza_CDR
  source 1..57: mol_type = other RNA

SEQ ID NO: 60922 - RNA, 57 nt, synthetic construct
  misc_feature 1..57: note = derived and/or modified sequence opt11 from anti-influenza_CDR
  source 1..57: mol_type = other RNA
gtcaaagacggctactgcacactcacctcctgccccgtcggctggtacttcgaccta

SEQ ID NO: 60923 - RNA, 57 nt, synthetic construct; identical to SEQ ID NO: 22713
  misc_feature 1..57: note = derived and/or modified sequence opt11 from anti-influenza_CDR
  source 1..57: mol_type = other RNA

SEQ ID NO: 60924 - RNA, 57 nt, synthetic construct
  misc_feature 1..57: note = derived and/or modified sequence opt11 from anti-influenza_CDR
  source 1..57: mol_type = other RNA
gcgcgcgcgatgatacaaggggtcgtgaccttgtacttgcgcccgggcgattactgg

SEQ ID NO: 60925 - RNA, 57 nt, synthetic construct
  misc_feature 1..57: note = derived and/or modified sequence opt11 from anti-influenza_CDR
  source 1..57: mol_type = other RNA
gcgaaagtgggcccgtacacgggctatgacgattacaattactatggcatggacgtg

SEQ ID NO: 60926 - RNA, 57 nt, synthetic construct
  misc_feature 1..57: note = derived and/or modified sequence opt11 from anti-influenza_CDR
  source 1..57: mol_type = other RNA
gccaaggtcgagagatcgttctatgacgggagcgggtacggggacgcgctagagata

SEQ ID NO: 60927 - RNA, 57 nt, synthetic construct
  misc_feature 1..57: note = derived and/or modified sequence opt11 from anti-influenza_CDR
  source 1..57: mol_type = other RNA
tattgcgcgcgcgggcgagtgaactcgggctatgactggggcccgaactttgactcg

SEQ ID NO: 60928 - RNA, 57 nt, synthetic construct
  misc_feature 1..57: note = derived and/or modified sequence opt11 from anti-influenza_CDR
  source 1..57: mol_type = other RNA
ttttgcgcgcgcgggagcccgaactcgggctatgactggggcccgcactttgactat

SEQ ID NO: 60929 - RNA, 57 nt, synthetic construct
  misc_feature 1..57: note = derived and/or modified sequence opt11 from anti-influenza_CDR
  source 1..57: mol_type = other RNA
agaataaaatcgaacacggacgggggcacgacagattacgcggccccggtcaagggc

SEQ ID NO: 60930 - RNA, 57 nt, synthetic construct
  misc_feature 1..57: note = derived and/or modified sequence opt11 from anti-influenza_CDR
  source 1..57: mol_type = other RNA
ctccgcctccaaggcgaagtcgtcgtccccccctcccaatccaactggttcgacccc

SEQ ID NO: 60931 - RNA, 60 nt, synthetic construct
  misc_feature 1..60: note = derived and/or modified sequence opt11 from anti-influenza_CDR
  source 1..60: mol_type = other RNA
gcgaaagagggcgggaacacgatctttggcttggtcacgatggcgtactatttcgatagc

SEQ ID NO: 60932 - RNA, 60 nt, synthetic construct
  misc_feature 1..60: note = derived and/or modified sequence opt11 from anti-influenza_CDR
  source 1..60: mol_type = other RNA
gcgcgcgcgggcggggactcgagcgggtactatggcgcgctcgggcgatttttccagcac

SEQ ID NO: 60933 - RNA, 60 nt, synthetic construct
  misc_feature 1..60: note = derived and/or modified sequence opt11 from anti-influenza_CDR
  source 1..60: mol_type = other RNA
gcgaaagatagcaggggctattgctcgagcataatctgtttcgagggcgggctcgataac

SEQ ID NO: 60934 - RNA, 60 nt, synthetic construct; identical to SEQ ID NO: 22724
  misc_feature 1..60: note = derived and/or modified sequence opt11 from anti-influenza_CDR
  source 1..60: mol_type = other RNA

SEQ ID NO: 60935 - RNA, 60 nt, synthetic construct
  misc_feature 1..60: note = derived and/or modified sequence opt11 from anti-influenza_CDR
  source 1..60: mol_type = other RNA
ggcacagacccagacaccgaagtatactgccgagtcggaaactgcgcagccttcgactac

SEQ ID NO: 60936 - RNA, 60 nt, synthetic construct; identical to SEQ ID NO: 22726
  misc_feature 1..60: note = derived and/or modified sequence opt11 from anti-influenza_CDR
  source 1..60: mol_type = other RNA

SEQ ID NO: 60937 - RNA, 60 nt, synthetic construct
  misc_feature 1..60: note = derived and/or modified sequence opt11 from anti-influenza_CDR
  source 1..60: mol_type = other RNA
gggaccgatcccgataccgagggctattgcaggagcgggagctgtagcgcgttcgatttc

SEQ ID NO: 60938 - RNA, 60 nt, synthetic construct
  misc_feature 1..60: note = derived and/or modified sequence opt11 from anti-influenza_CDR
  source 1..60: mol_type = other RNA
ggcacggacccggacacggaagtgtactgccgagcgggaaattgcgcggcctttgacttt

SEQ ID NO: 60939 - RNA, 60 nt, synthetic construct
  misc_feature 1..60: note = derived and/or modified sequence opt11 from anti-influenza_CDR
  source 1..60: mol_type = other RNA
aggggcgggcactcgttcgggtacgggagcgggggcgatacacatagcgagttcgatagc

SEQ ID NO: 60940 - RNA, 60 nt, synthetic construct
  misc_feature 1..60: note = derived and/or modified sequence opt11 from anti-influenza_CDR
  source 1..60: mol_type = other RNA
catatgagtatgcagcaggtggtgagtgcggggtgggagagggcggatttggtgggggat

SEQ ID NO: 60941 - RNA, 60 nt, synthetic construct
  misc_feature 1..60: note = derived and/or modified sequence opt11 from anti-influenza_CDR
  source 1..60: mol_type = other RNA
gactcccgcctccgctccctcctctacttcgaatggctctcccaaggctacttcaacccc

SEQ ID NO: 60942 - RNA, 60 nt, synthetic construct
  misc_feature 1..60: note = derived and/or modified sequence opt11 from anti-influenza_CDR
  source 1..60: mol_type = other RNA
gcccgccacctcggccaacaactcgtctccaacacctactactactacggcatggacgtc

SEQ ID NO: 60943 - RNA, 63 nt, synthetic construct
  misc_feature 1..63: note = derived and/or modified sequence opt11 from anti-influenza_CDR
  source 1..63: mol_type = other RNA
acgacagggggaacgacaacgtgcacggcagcgggatgtggagggggatgttgcacgtgctgt

SEQ ID NO: 60944 - RNA, 63 nt, synthetic construct
  misc_feature 1..63: note = derived and/or modified sequence opt11 from anti-influenza_CDR
  source 1..63: mol_type = other RNA
gcccgcgccgccgacgaatcagtcgaatccctcaccataaaagccttccgaaccaactaccac

SEQ ID NO: 60945 - RNA, 63 nt, synthetic construct; identical to SEQ ID NO: 22735
  misc_feature 1..63: note = derived and/or modified sequence opt11 from anti-influenza_CDR
  source 1..63: mol_type = other RNA

SEQ ID NO: 60946 - RNA, 63 nt, synthetic construct
  misc_feature 1..63: note = derived and/or modified sequence opt11 from anti-influenza_CDR
  source 1..63: mol_type = other RNA
gacatgctcgcgtactatagcgataactcgggcaagaaatataacgtgtacgggatggacgtc

SEQ ID NO: 60947 - RNA, 63 nt, synthetic construct
  misc_feature 1..63: note = derived and/or modified sequence opt11 from anti-influenza_CDR
  source 1..63: mol_type = other RNA
gacatgctcgcgtactactacgacggctcgggcatacgctataacctgtacgggatggacgtc

SEQ ID NO: 60948 - RNA, 66 nt, synthetic construct
  misc_feature 1..66: note = derived and/or modified sequence opt11 from anti-influenza_CDR
  source 1..66: mol_type = other RNA
gccaaagacccccgcctccgccacctcctctacttccccttcacctccatgatctacttcgactac

SEQ ID NO: 60949 - RNA, 66 nt, synthetic construct
  misc_feature 1..66: note = derived and/or modified sequence opt11 from anti-influenza_CDR
  source 1..66: mol_type = other RNA
gccaaagactcccaactccgctccctcctctacttcgaatggctctcccaaggctacttcgacccc

SEQ ID NO: 60950 - RNA, 66 nt, synthetic construct
  misc_feature 1..66: note = derived and/or modified sequence opt11 from anti-influenza_CDR
  source 1..66: mol_type = other RNA
gccaaagactcccaactccgctccctcctctacttcgaatggctctcccaaggctacttcgactac

SEQ ID NO: 60951 - RNA, 66 nt, synthetic construct
  misc_feature 1..66: note = derived and/or modified sequence opt11 from anti-influenza_CDR
  source 1..66: mol_type = other RNA
gccaaagactcccaactccgctccctcctctacttcgaatggctctcccaaggctacttcgaaccc

SEQ ID NO: 60952 - RNA, 66 nt, synthetic construct
  misc_feature 1..66: note = derived and/or modified sequence opt11 from anti-influenza_CDR
  source 1..66: mol_type = other RNA
gcgaaagagcgcccgctcaggctcttgcgctatttcgattggttgagcgggggcgcgaacgattac

SEQ ID NO: 60953 - RNA, 66 nt, synthetic construct; identical to SEQ ID NO: 22743
  misc_feature 1..66: note = derived and/or modified sequence opt11 from anti-influenza_CDR
  source 1..66: mol_type = other RNA

SEQ ID NO: 60954 - RNA, 66 nt, synthetic construct
  misc_feature 1..66: note = derived and/or modified sequence opt11 from anti-influenza_CDR
  source 1..66: mol_type = other RNA
gcgcgcgatggcagggaagggtacttttacgggagcgggagcttttacaatctcaagggcttgaac

SEQ ID NO: 60955 - RNA, 66 nt, synthetic construct
  misc_feature 1..66: note = derived and/or modified sequence opt11 from anti-influenza_CDR
  source 1..66: mol_type = other RNA
agcacggacaggggacatgtattgagatatttcgggtggatgctgccgggagatgcatttgacgtg

SEQ ID NO: 60956 - RNA, 66 nt, synthetic construct
  misc_feature 1..66: note = derived and/or modified sequence opt11 from anti-influenza_CDR
  source 1..66: mol_type = other RNA
ctcaactactacgaccgctccggctaccactcacccgacggcccatccaacaactggttcgacccc

SEQ ID NO: 60957 - RNA, 66 nt, synthetic construct
  misc_feature 1..66: note = derived and/or modified sequence opt11 from anti-influenza_CDR
  source 1..66: mol_type = other RNA
gcccgcgtcccccgcgaccgcctcctcaccctctactacgaatcctccacctacggcttcgactac

SEQ ID NO: 60958 - RNA, 66 nt, synthetic construct
  misc_feature 1..66: note = derived and/or modified sequence opt11 from anti-influenza_CDR
  source 1..66: mol_type = other RNA
gcgcgcaagtgggggcgcatgaccgtgttcggggtcgcgaccgatcaattgtactatttcgattac

SEQ ID NO: 60959 - RNA, 66 nt, synthetic construct
  misc_feature 1..66: note = derived and/or modified sequence opt11 from anti-influenza_CDR
  source 1..66: mol_type = other RNA
gcgacggatatagtggtggagagggatgcgagtctgggggggtttaatagttatgggatggatgtg

SEQ ID NO: 60960 - RNA, 69 nt, synthetic construct
  misc_feature 1..69: note = derived and/or modified sequence opt11 from anti-influenza_CDR
  source 1..69: mol_type = other RNA
gcccgcaacctcccagacatcgccgtcgtcacagccgtccaagacgccacccccgtctggttcgaccca

SEQ ID NO: 60961 - RNA, 69 nt, synthetic construct
  misc_feature 1..69: note = derived and/or modified sequence opt11 from anti-influenza_CDR
  source 1..69: mol_type = other RNA
gatggcccgtactcggacgatttcaggagcgggtacgcggccaggtacaggtactttggcatggacgtg

SEQ ID NO: 60962 - RNA, 72 nt, synthetic construct
  misc_feature 1..72: note = derived and/or modified sequence opt11 from anti-influenza_CDR
  source 1..72: mol_type = other RNA
gggcgcgagctcttgcgcttgcaacatttcttgaccgatagccagagcgagcgcagggactgtttcgatccc

SEQ ID NO: 60963 - RNA, 72 nt, synthetic construct
  misc_feature 1..72: note = derived and/or modified sequence opt11 from anti-influenza_CDR
  source 1..72: mol_type = other RNA
atgagcctgctaacggaagtggaaacgcccacgcgcaatgaatggggctgccgctgtaacgacagctcggac

SEQ ID NO: 60964 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgaccaagaacgagtgggagtgcaggtgcaatgactcgagcgat

SEQ ID NO: 60965 - RNA, 72 nt, synthetic construct
  misc_feature 1..72: note = derived and/or modified sequence opt11 from anti-influenza_CDR
  source 1..72: mol_type = other RNA
atgagcctgctgacggaagtggagacgccgataagaaacgaatgggaatgcagatgcaacgacagcagcgac

SEQ ID NO: 60966 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggaacgggtgggagtgcaagtgcaatgactcgagcgat

SEQ ID NO: 60967 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggagcgagtgggggtgcaggtgcaatgactcgagcgat

SEQ ID NO: 60968 - RNA, 72 nt, synthetic construct
  misc_feature 1..72: note = derived and/or modified sequence opt11 from anti-influenza_CDR
  source 1..72: mol_type = other RNA
atgtccttcctccccgaagtcgaaacccccatccgcaacgaatggggctgccgctgcaacgactcctccgac

SEQ ID NO: 60969 - RNA, 72 nt, synthetic construct
  misc_feature 1..72: note = derived and/or modified sequence opt11 from anti-influenza_CDR
  source 1..72: mol_type = other RNA
atgtccctcctcaccgaagtcgaaacccccatccgcaacgaatggggctgccgctgcaacgactcctccaac

SEQ ID NO: 60970 - RNA, 72 nt, synthetic construct
  misc_feature 1..72: note = derived and/or modified sequence opt11 from anti-influenza_CDR
  source 1..72: mol_type = other RNA
atgagcctgctgacggaagtggagacgccgataagaaaggaatggggatgcagatgcaacgacagcagcgac

SEQ ID NO: 60971 - RNA, 72 nt, synthetic construct
  misc_feature 1..72: note = derived and/or modified sequence opt11 from anti-influenza_CDR
  source 1..72: mol_type = other RNA
atgtccttcctcaccgaagtcgaaacccccatccgcaacgaatggggctgccgctgcaacgactcctccgac

SEQ ID NO: 60972 - RNA, 72 nt, synthetic construct
  misc_feature 1..72: note = derived and/or modified sequence opt11 from anti-influenza_CDR
  source 1..72: mol_type = other RNA
atgtcgctcccgaccgaggtcgagaccccgatcaggagcgagtgggggtgcaggtgcaatgactcgagcgat

SEQ ID NO: 60973 - RNA, 72 nt, synthetic construct
  misc_feature 1..72: note = derived and/or modified sequence opt11 from anti-influenza_CDR
  source 1..72: mol_type = other RNA
atgtcgctcttgcccgaggtcgagaccccgatcaggaacgagtgggggtgcaggtgcaatgactcgagcgat

SEQ ID NO: 60974 - RNA, 72 nt, synthetic construct
  misc_feature 1..72: note = derived and/or modified sequence opt11 from anti-influenza_CDR
  source 1..72: mol_type = other RNA
atgtcgctcttgcccgaggtcgagacaccgatcaggaacgggtgggggtgcaggtgcaatgactcgagcgat

SEQ ID NO: 60975 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgaccaggaacgggtgggagtgcaggtgctcgggctcgagcgat

SEQ ID NO: 60976 - RNA, 72 nt, synthetic construct
  misc_feature 1..72: note = derived and/or modified sequence opt11 from anti-influenza_CDR
  source 1..72: mol_type = other RNA
atgtccctcctcaccgaagtcgaaacccccatccgcaacgaatgggaataccgctgcaacgactcctccgac

SEQ ID NO: 60977 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggaacgagtgggagtacaggtgctcggactcgagcgat

SEQ ID NO: 60978 - RNA, 72 nt, synthetic construct
  misc_feature 1..72: note = derived and/or modified sequence opt11 from anti-influenza_CDR
  source 1..72: mol_type = other RNA
atgtccctcctcaccgaagtcgaaacccccacccgcaacggctgggaatgccgctactccgactcctccgac

SEQ ID NO: 60979 - RNA, 72 nt, synthetic construct
  misc_feature 1..72: note = derived and/or modified sequence opt11 from anti-influenza_CDR
  source 1..72: mol_type = other RNA
atgtcgttcttgaccgaggtcgagaccttgaccaggaacgggtgggagtgcaggtgctcggactcgagcgat

SEQ ID NO: 60980 - RNA, 72 nt, synthetic construct
  misc_feature 1..72: note = derived and/or modified sequence opt11 from anti-influenza_CDR
  source 1..72: mol_type = other RNA
atgagcctgctaacggaagtggaaacgctcacgcgcaacggctgggaatgtaaatgccgcgacagctcggac

SEQ ID NO: 60981 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggaacgagtgggggtgcaggtgcaatgactcgagcgat

SEQ ID NO: 60982 - RNA, 72 nt, synthetic construct
  misc_feature 1..72: note = derived and/or modified sequence opt11 from anti-influenza_CDR
  source 1..72: mol_type = other RNA
atgagtctgttgacggaggtggagacgccgataaggagcgagtgggggtgtaggtgcaatgacagtggggat

SEQ ID NO: 60983 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggaacgagtgggagtgcaggtgcaatggctcgagcgat

SEQ ID NO: 60984 - RNA, 72 nt, synthetic construct
  misc_feature 1..72: note = derived and/or modified sequence opt11 from anti-influenza_CDR
  source 1..72: mol_type = other RNA
atgtccctcccaaccgaagtcgaaacccccatccgcaacgaatggggctgccgctgcaacgactcctccgac

SEQ ID NO: 60985 - RNA, 72 nt, synthetic construct
  misc_feature 1..72: note = derived and/or modified sequence opt11 from anti-influenza_CDR
  source 1..72: mol_type = other RNA
atgagtctgttgacggaggtggagacgccgataaggaacgagtgggggtgcaggtgcaatgggagtagcgat

SEQ ID NO: 60986 - RNA, 72 nt, synthetic construct
  misc_feature 1..72: note = derived and/or modified sequence opt11 from anti-influenza_CDR
  source 1..72: mol_type = other RNA
atgagcttgctaacggaagtggacacgctcacgcgcaatggctggggctgtcgctgtagcgatagctcggac

SEQ ID NO: 60987 - RNA, 72 nt, synthetic construct
  misc_feature 1..72: note = derived and/or modified sequence opt11 from anti-influenza_CDR
  source 1..72: mol_type = other RNA
atgtccctcctcaccgaagtcgaaaccctcaccaaaaacggctggggctgccgctgctccgactcctccgac

SEQ ID NO: 60988 - RNA, 72 nt, synthetic construct
  misc_feature 1..72: note = derived and/or modified sequence opt11 from anti-influenza_CDR
  source 1..72: mol_type = other RNA
atgagcctgctaacggaagtggaaacgcccacgcgcaacggctgggaatgtaaatgcagcgacagctcggac

SEQ ID NO: 60989 - RNA, 72 nt, synthetic construct
  misc_feature 1..72: note = derived and/or modified sequence opt11 from anti-influenza_CDR
  source 1..72: mol_type = other RNA
atgtccctcctaaccgaagtcgaaacccacacccgcaacggctgggaatgcaaatgctccgactcctccgac

SEQ ID NO: 60990 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcaagaccccgaccaggaacgggtgggagtgcaagtgctcggactcgagcgat

SEQ ID NO: 60991 - RNA, 72 nt, synthetic construct
  misc_feature 1..72: note = derived and/or modified sequence opt11 from anti-influenza_CDR
  source 1..72: mol_type = other RNA
atgagcttgctaacggaagtggaaacgctcacgcgcaatggctggggctgtcgctgtagcgatagctcggac

SEQ ID NO: 60992 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgaccagggacgggtgggagtgcaagtgctcggactcgagcgat

SEQ ID NO: 60993 - RNA, 72 nt, synthetic construct
  misc_feature 1..72: note = derived and/or modified sequence opt11 from anti-influenza_CDR
  source 1..72: mol_type = other RNA
atgagcttgctaacggaagtggaaacgcccacgcgcaatggctggggctgtcgctgtagcgatagctcggac

SEQ ID NO: 60994 - RNA, 72 nt, synthetic construct
  misc_feature 1..72: note = derived and/or modified sequence opt11 from anti-influenza_CDR
  source 1..72: mol_type = other RNA
atgagcctgctaacagaagtagaaacgccaacaagaaacggctgggaatgcaaatgcaacgacagcagcgac

SEQ ID NO: 60995 - RNA, 72 nt, synthetic construct
  misc_feature 1..72: note = derived and/or modified sequence opt11 from anti-influenza_CDR
  source 1..72: mol_type = other RNA
atgtccctcctcaccgaagtcgaaaccctcacccgcaacggctgggaatgcaaatgctccgactcctccgac

SEQ ID NO: 60996 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggaacgagtgggggtgcaagtgcaatgactcgagcgat

SEQ ID NO: 60997 - RNA, 72 nt, synthetic construct
  misc_feature 1..72: note = derived and/or modified sequence opt11 from anti-influenza_CDR
  source 1..72: mol_type = other RNA
atgtcgttcttgaccgaggtcgagaccccgatcaggaacgagtgggggtgcaggtgcaatggctcgagcgat

SEQ ID NO: 60998 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgaccaggaacgggtgggagtgcaggtgcaatgactcgagcgat

SEQ ID NO: 60999 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgatcaggaaagggtgggagtgcaattgctcggactcgagcgat

SEQ ID NO: 61000 - RNA, 72 nt, synthetic construct
  misc_feature 1..72: note = derived and/or modified sequence opt11 from anti-influenza_CDR
  source 1..72: mol_type = other RNA
atgtcgctcttgaccgaggtcgagaccccgaccaggaacgagtgggagtgcaggtgctcggactcgagcgat

SEQ ID NO: 61001 - RNA, 72 nt, synthetic construct
  misc_feature 1..72: note = derived and/or modified sequence opt11 from anti-influenza_CDR
  source 1..72: mol_type = other RNA
atgagcttgctaacgggcgtggaaacgcacacgcgaaatggctggggctgtaaatgtagcgatagctcggac

SEQ ID NO: 61002 - RNA, 72 nt, synthetic construct
  misc_feature 1..72: note = derived and/or modified sequence opt11 from anti-influenza_CDR
  source 1..72: mol_type = other RNA
atgtccctcctccccgaagtcgaaacacacacccgcaacggctggggctgccgctgctccgactcctccgac

SEQ ID NO: 61003 - RNA, 72 nt, synthetic construct
  misc_feature 1..72: note = derived and/or modified sequence opt11 from anti-influenza_CDR
  source 1..72: mol_type = other RNA
acagatggcccgtactcggacgatttcaggagcgggtacgcggccaggtacaggtactttggcatggacgtg

SEQ ID NO: 61004 - RNA, 75 nt, synthetic construct
  misc_feature 1..75: note = derived and/or modified sequence opt11 from anti-influenza_CDR
  source 1..75: mol_type = other RNA
gcgaaacatatgtcgctacagcaagtggtctcggccgggtgggagcgagcggacttggtcggggacgcgttcgat

SEQ ID NO: 61005 - RNA, 75 nt, synthetic construct
  misc_feature 1..75: note = derived and/or modified sequence opt11 from anti-influenza_CDR
  source 1..75: mol_type = other RNA
gcgaaacatctatcgatgcagcaagtggtctcggccgggtgggagcgagcggacttggtcggggacgcgttcgat

SEQ ID NO: 61006 - RNA, 75 nt, synthetic construct
  misc_feature 1..75: note = derived and/or modified sequence opt11 from anti-influenza_CDR
  source 1..75: mol_type = other RNA
gcgaaacatgcctcgctacagcaagtggtctcggccgggtgggagcgagcggacttggtcggggacgcgttcgat

SEQ ID NO: 61007 - RNA, 75 nt, synthetic construct
  misc_feature 1..75: note = derived and/or modified sequence opt11 from anti-influenza_CDR
  source 1..75: mol_type = other RNA
gcgaaacatagctcgctccagcaagtggtctcggccgggtgggagcgcgcggacttggtcggggacgcgttcgat

SEQ ID NO: 61008 - RNA, 75 nt, synthetic construct
  misc_feature 1..75: note = derived and/or modified sequence opt11 from anti-influenza_CDR
  source 1..75: mol_type = other RNA
gcgaaacatctctcgctccagcaagtggtctcggccgggtgggagcgcgcggacttggtcggggacgcgttcgat

SEQ ID NO: 61009 - RNA, 75 nt, synthetic construct
  misc_feature 1..75: note = derived and/or modified sequence opt11 from anti-influenza_CDR
  source 1..75: mol_type = other RNA
gcgaagcatatgagtatgcagcaggtggtgagtgcggggtgggagagggcggatttggtgggggatgcgtttgat

SEQ ID NO: 61010 - RNA, 75 nt, synthetic construct
  misc_feature 1..75: note = derived and/or modified sequence opt11 from anti-influenza_CDR
  source 1..75: mol_type = other RNA
gcccgcggccccgaaacctactactacgacaaaaccaactggctcaactcccaccccgacgaatacttccaacac

SEQ ID NO: 61011 - RNA, 75 nt, synthetic construct
  misc_feature 1..75: note = derived and/or modified sequence opt11 from anti-influenza_CDR
  source 1..75: mol_type = other RNA
acgacagacggcccgtactcggacgatttcaggagcgggtacgcggccaggtacaggtactttggcatggacgtg

SEQ ID NO: 61012 - RNA, 75 nt, synthetic construct
  misc_feature 1..75: note = derived and/or modified sequence opt11 from anti-influenza_CDR
  source 1..75: mol_type = other RNA
accgatggcccgtactcggacgatttcaggagcgggtacgcggccaggtacaggtactttggcatggacgtgtgg

SEQ ID NO: 61013 - RNA, 78 nt, synthetic construct
  misc_feature 1..78: note = derived and/or modified sequence opt11 from anti-influenza_CDR
  source 1..78: mol_type = other RNA
gacatacaaatgacccagagcccgagctcgctatcggcctcggtcggggacagggtcacgatcacgtgcaggagctcg

SEQ ID NO: 61014 - RNA, 78 nt, synthetic construct
  misc_feature 1..78: note = derived and/or modified sequence opt11 from anti-influenza_CDR
  source 1..78: mol_type = other RNA
gcgaccgggcgcgcggccacgggctcggcctcgtgcacgggcgggggcacgtactggacctattgcacgtgcacgaca

SEQ ID NO: 61015 - RNA, 81 nt, synthetic construct
  misc_feature 1..81: note = derived and/or modified sequence opt11 from anti-influenza_CDR
  source 1..81: mol_type = other RNA
gggtacatacccgaggccccgcgcgatggccaggcctatgtcaggaaagatggcgagtgggtgctcttgagcacgttcttg

SEQ ID NO: 61016 - RNA, 90 nt, synthetic construct
  misc_feature 1..90: note = derived and/or modified sequence opt11 from anti-influenza_CDR
  source 1..90: mol_type = other RNA
caagtgcaattgctcgagaccgggggcgggctcgtgaaaccgggccagagcttgaaattgagctgtgccgcgagcgggttcacgttcacg

SEQ ID NO: 61017 - RNA, 96 nt, synthetic construct
  misc_feature 1..96: note = derived and/or modified sequence opt11 from anti-influenza_CDR
  source 1..96: mol_type = other RNA
cgcttcaccatctcccgcgacaactccaaaaacaccctctacctccaaatgaactccctccgcgccgaagacaccgccgtctactactgcgccaaa

SEQ ID NO: 61018 - RNA, 96 nt, synthetic construct
  misc_feature 1..96: note = derived and/or modified sequence opt11 from anti-influenza_CDR
  source 1..96: mol_type = other RNA
ggcgtcccctcccgcttctccggctccggctccggcaccgacttcaccctcaccatctcctccctccaacccgaagacttcgccacctactactgc

SEQ ID NO: 61019 - RNA, 15 nt, synthetic construct
  misc_feature 1..15: note = derived and/or modified sequence opt11 from anti-OX40_HeavyChain_CDR1
  source 1..15: mol_type = other RNA
agctatagcatgaac

SEQ ID NO: 61020 - RNA, 15 nt, synthetic construct
  misc_feature 1..15: note = derived and/or modified sequence opt11 from anti-OX40_HeavyChain_CDR1
  source 1..15: mol_type = other RNA
gactacgccatgcat

SEQ ID NO: 61021 - RNA, 15 nt, synthetic construct
  misc_feature 1..15: note = derived and/or modified sequence opt11 from anti-OX40_HeavyChain_CDR1
  source 1..15: mol_type = other RNA
gactcgtacatgagt

SEQ ID NO: 61022 - RNA, 15 nt, synthetic construct
  misc_feature 1..15: note = derived and/or modified sequence opt11 from anti-OX40_HeavyChain_CDR1
  source 1..15: mol_type = other RNA
gacgcgtacatgagt

SEQ ID NO: 61023 - RNA, 15 nt, synthetic construct
  misc_feature 1..15: note = derived and/or modified sequence opt11 from anti-OX40_HeavyChain_CDR1
  source 1..15: mol_type = other RNA
gagtcgtacatgagt

SEQ ID NO: 61024 - RNA, 15 nt, synthetic construct
  misc_feature 1..15: note = derived and/or modified sequence opt11 from anti-OX40_HeavyChain_CDR1
  source 1..15: mol_type = other RNA
agcgggtactggaac

SEQ ID NO: 61025 - RNA, 21 nt, synthetic construct
  misc_feature 1..21: note = derived and/or modified sequence opt11 from anti-OX40_LightChain_CDR2
  source 1..21: mol_type = other RNA
tacacctcccgcctccactcc

SEQ ID NO: 61026 - RNA, 21 nt, synthetic construct
  misc_feature 1..21: note = derived and/or modified sequence opt11 from anti-OX40_LightChain_CDR2
  source 1..21: mol_type = other RNA
gccgcctcctccctccaatca

SEQ ID NO: 61027 - RNA, 21 nt, synthetic construct
  misc_feature 1..21: note = derived and/or modified sequence opt11 from anti-OX40_LightChain_CDR2
  source 1..21: mol_type = other RNA
gacgcgagcaatcgcgcgaca

SEQ ID NO: 61028 - RNA, 21 nt, synthetic construct
  misc_feature 1..21: note = derived and/or modified sequence opt11 from anti-OX40_LightChain_CDR2
  source 1..21: mol_type = other RNA
tacacctcccgcctccgctcc

SEQ ID NO: 61029 - RNA, 24 nt, synthetic construct
  misc_feature 1..24: note = derived and/or modified sequence opt11 from anti-OX40_LightChain_CDR3
  source 1..24: mol_type = other RNA
caacaacgctccaactggcccacc

SEQ ID NO: 61030 - RNA, 24 nt, synthetic construct
  misc_feature 1..24: note = derived and/or modified sequence opt11 from anti-OX40_HeavyChain_CDR3
  source 1..24: mol_type = other RNA
gccccccgctggtacttctccgta

SEQ ID NO: 61031 - RNA, 24 nt, synthetic construct
  misc_feature 1..24: note = derived and/or modified sequence opt11 from anti-OX40_HeavyChain_CDR3
  source 1..24: mol_type = other RNA
gcaccccgctggtacttctccgcc

SEQ ID NO: 61032 - RNA, 24 nt, synthetic construct
  misc_feature 1..24: note = derived and/or modified sequence opt11 from anti-OX40_HeavyChain_CDR3
  source 1..24: mol_type = other RNA
gccccacgctggtacttcgccgta

SEQ ID NO: 61033 - RNA, 27 nt, synthetic construct
  misc_feature 1..27: note = derived and/or modified sequence opt11 from anti-OX40_LightChain_CDR3
  source 1..27: mol_type = other RNA
cagcaaggaaacacgctcccgtggaca

SEQ ID NO: 61034 - RNA, 27 nt, synthetic construct
  misc_feature 1..27: note = derived and/or modified sequence opt11 from anti-OX40_HeavyChain_CDR3
  source 1..27: mol_type = other RNA
gaatcgggctggtacttgttcgactac

SEQ ID NO: 61035 - RNA, 27 nt, synthetic construct
  misc_feature 1..27: note = derived and/or modified sequence opt11 from anti-OX40_LightChain_CDR3
  source 1..27: mol_type = other RNA
caacaatacaactcctacccccccacc

SEQ ID NO: 61036 - RNA, 27 nt, synthetic construct
  misc_feature 1..27: note = derived and/or modified sequence opt11 from anti-OX40_LightChain_CDR3
  source 1..27: mol_type = other RNA
caacaaggccacaccctcccccccacc

SEQ ID NO: 61037 - RNA, 27 nt, synthetic construct
  misc_feature 1..27: note = derived and/or modified sequence opt11 from anti-OX40_LightChain_CDR3
  source 1..27: mol_type = other RNA
caacaaggccacaccctccccgccacc

SEQ ID NO: 61038 - RNA, 27 nt, synthetic construct
  misc_feature 1..27: note = derived and/or modified sequence opt11 from anti-OX40_LightChain_CDR3
  source 1..27: mol_type = other RNA
caacaaggccacaccgccccaccaacc

SEQ ID NO: 61039 - RNA, 27 nt, synthetic construct
  misc_feature 1..27: note = derived and/or modified sequence opt11 from anti-OX40_LightChain_CDR3
  source 1..27: mol_type = other RNA
caacaaggcgccaccctaccccccacc

SEQ ID NO: 61040 - RNA, 27 nt, synthetic construct
  misc_feature 1..27: note = derived and/or modified sequence opt11 from anti-OX40_LightChain_CDR3
  source 1..27: mol_type = other RNA
caacaaggccacgccctcccacccacc

SEQ ID NO: 61041 - RNA, 27 nt, synthetic construct
  misc_feature 1..27: note = derived and/or modified sequence opt11 from anti-OX40_LightChain_CDR3
  source 1..27: mol_type = other RNA
caacaagcccacaccctcccccccacc

SEQ ID NO: 61042 - RNA, 27 nt, synthetic construct
  misc_feature 1..27: note = derived and/or modified sequence opt11 from anti-OX40_LightChain_CDR3
  source 1..27: mol_type = other RNA
caacaaggccacaccctcgcccccacc

SEQ ID NO: 61043 - RNA, 27 nt, synthetic construct
  misc_feature 1..27: note = derived and/or modified sequence opt11 from anti-OX40_LightChain_CDR3
  source 1..27: mol_type = other RNA
caagccggccacaccctacccccaacc

SEQ ID NO: 61044 - RNA, 30 nt, synthetic construct
  misc_feature 1..30: note = derived and/or modified sequence opt11 from anti-OX40_HeavyChain_CDR1
  source 1..30: mol_type = other RNA
gggtacacgttcacgagctacgtcatgcac

SEQ ID NO: 61045 - RNA, 30 nt, synthetic construct; identical to SEQ ID NO: 22835
  misc_feature 1..30: note = derived and/or modified sequence opt11 from anti-OX40_HeavyChain_CDR3
  source 1..30: mol_type = other RNA

SEQ ID NO: 61046 - RNA, 33 nt, synthetic construct
  misc_feature 1..33: note = derived and/or modified sequence opt11 from anti-OX40_LightChain_CDR1
  source 1..33: mol_type = other RNA
cgcgcctcccaagacatatccaactacctaaac

SEQ ID NO: 61047 - RNA, 33 nt, synthetic construct
  misc_feature 1..33: note = derived and/or modified sequence opt11 from anti-OX40_LightChain_CDR1
  source 1..33: mol_type = other RNA
agggcaagtcaggggataagtagttggctggcg

SEQ ID NO: 61048 - RNA, 33 nt, synthetic construct
  misc_feature 1..33: note = derived and/or modified sequence opt11 from anti-OX40_LightChain_CDR1
  source 1..33: mol_type = other RNA
cgcgcgagccagagcgtgagctcatacttggcc

SEQ ID NO: 61049 - RNA, 39 nt, synthetic construct
  misc_feature 1..39: note = derived and/or modified sequence opt11 from anti-OX40_HeavyChain_CDR3
  source 1..39: mol_type = other RNA
tacaggtacgattacgatggcgggcacgcgatggattac

SEQ ID NO: 61050 - RNA, 39 nt, synthetic construct
  misc_feature 1..39: note = derived and/or modified sequence opt11 from anti-OX40_HeavyChain_CDR3
  source 1..39: mol_type = other RNA
tacaaatacgactacgacgccggacacgcaatggactac

SEQ ID NO: 61051 - RNA, 39 nt, synthetic construct
  misc_feature 1..39: note = derived and/or modified sequence opt11 from anti-OX40_HeavyChain_CDR3
  source 1..39: mol_type = other RNA
tacaagtacgattacgatggcgggcacgcgatggattac

SEQ ID NO: 61052 - RNA, 45 nt, synthetic construct
  misc_feature 1..45: note = derived and/or modified sequence opt11 from anti-OX40_HeavyChain_CDR3
  source 1..45: mol_type = other RNA
gaccaatcaaccgccgactactacttctactacggcatggacgtc

SEQ ID NO: 61053 - RNA, 48 nt, synthetic construct
  misc_feature 1..48: note = derived and/or modified sequence opt11 from anti-OX40_HeavyChain_CDR2
  source 1..48: mol_type = other RNA
tacatctcctacaacggcatcacctaccacaacccctccctcaaatcc

SEQ ID NO: 61054 - RNA, 48 nt, synthetic construct
  misc_feature 1..48: note = derived and/or modified sequence opt11 from anti-OX40_HeavyChain_CDR2
  source 1..48: mol_type = other RNA
tacatctcctacaacgccatcacctaccacaacccctccctcaaatcc

SEQ ID NO: 61055 - RNA, 48 nt, synthetic construct
  misc_feature 1..48: note = derived and/or modified sequence opt11 from anti-OX40_HeavyChain_CDR2
  source 1..48: mol_type = other RNA
tacatctcctactccggcatcacctaccacaacccctccctcaaatcc

SEQ ID NO: 61056 - RNA, 51 nt, synthetic construct
  misc_feature 1..51: note = derived and/or modified sequence opt11 from anti-OX40_HeavyChain_CDR2
  source 1..51: mol_type = other RNA
tacatcaacccctacaacgacggcaccaaatacaacgaaaaattcaaaggc

SEQ ID NO: 61057 - RNA, 51 nt, synthetic construct
  misc_feature 1..51: note = derived and/or modified sequence opt11 from anti-OX40_HeavyChain_CDR2
  source 1..51: mol_type = other RNA
tacatctcctcctcctcctccaccatcgactacgccgactccgtcaaaggc

SEQ ID NO: 61058 - RNA, 51 nt, synthetic construct
  misc_feature 1..51: note = derived and/or modified sequence opt11 from anti-OX40_HeavyChain_CDR2
  source 1..51: mol_type = other RNA
ggaataagctggaactcgggctcgatagggtacgcggactcggtaaaggga

SEQ ID NO: 61059 - RNA, 51 nt, synthetic construct
  misc_feature 1..51: note = derived and/or modified sequence opt11 from anti-OX40_HeavyChain_CDR2
  source 1..51: mol_type = other RNA
gacatgtacccggacaacggcgacagctcgtacaaccaaaaattcagggaa

SEQ ID NO: 61060 - RNA, 51 nt, synthetic construct
  misc_feature 1..51: note = derived and/or modified sequence opt11 from anti-OX40_HeavyChain_CDR2
  source 1..51: mol_type = other RNA
gacatgtaccccgacaacgccgactcctcctacaaccaaaaattccgcgaa

SEQ ID NO: 61061 - RNA, 51 nt, synthetic construct
  misc_feature 1..51: note = derived and/or modified sequence opt11 from anti-OX40_HeavyChain_CDR2
  source 1..51: mol_type = other RNA
gacatgtaccccgacaacgcagacgccagctacaaccaaaaattccgcgaa

SEQ ID NO: 61062 - RNA, 51 nt, synthetic construct
  misc_feature 1..51: note = derived and/or modified sequence opt11 from anti-OX40_HeavyChain_CDR2
  source 1..51: mol_type = other RNA
gacatgtaccccgacaacggagacgccagctacaaccaaaaattccgcgaa

SEQ ID NO: 61063 - RNA, 51 nt, synthetic construct
  misc_feature 1..51: note = derived and/or modified sequence opt11 from anti-OX40_HeavyChain_CDR2
  source 1..51: mol_type = other RNA
gacatgtacccggactcgggcgacagctcgtacaaccaaaagttcagggaa

SEQ ID NO: 61064 - RNA, 51 nt, synthetic construct
  misc_feature 1..51: note = derived and/or modified sequence opt11 from anti-OX40_HeavyChain_CDR2
  source 1..51: mol_type = other RNA
gacatgtaccccgacaacggcagctcaagctacaaccaaaaattccgcgaa

SEQ ID NO: 61065 - RNA, 309 nt, synthetic construct
  misc_feature 1..309: note = derived and/or modified sequence opt11 from Ig_LightChain_kappa_constant_domain
  source 1..309: mol_type = other RNA
accgtcgccgccccctccgtcttcatcttccccccctccgacgaacaactcaaatccggcaccgcctccgtcgtctgcctcctcaacaacttctacccccgcgaagccaaagtccaatggaaagtcgacaacgccctccaatccggcaactcccaagaatcagtcaccgaacaagactccaaagactccacctactccctatcctccaccctcaccctctccaaagccgactacgaaaaacacaaagtctacgcctgcgaagtcacccaccaaggcctctcctcccccgtcaccaaatccttcaaccgc

SEQ ID NO: 61066 - RNA, 309 nt, synthetic construct
  misc_feature 1..309: note = derived and/or modified sequence opt11 from Ig_LightChain_kappa_constant_domain
  source 1..309: mol_type = other RNA
accgtcgccgccccctccgtcttcatcttccccccctccgacgaacaactcaaatccggcaccgcctccgtcgtctgcctcctcaacaacttctacccccgcgaagccaaagtccaatggaaagtcgacaacgccctccaatccggcaactcccaagaatccgtcaccgaacaagactccaaagactccacctactccctctccaacaccctcaccctctccaaagccgactacgaaaaacacaaagtctacgcctgcgaagtcacccaccaaggcctctcctcccccgtcaccaaatccttcaaccgc

SEQ ID NO: 61067 - RNA, 312 nt, synthetic construct
  misc_feature 1..312: note = derived and/or modified sequence opt11 from Ig_LightChain_lambda_constant_domain
  source 1..312: mol_type = other RNA
cccaaagccgccccctcagtcaccctcttccccccctcctccgaagaactccaagccaacaaagccaccctcgtctgcctcatctcagacttctaccccggcgccgtcaccgtcgcctggaaagccgactcctcccccgtcaaagccggcgtcgaaaccaccaccccctccaaacaatccaacaacaaatacgccgcctcctcctacctctccctcacccccgaacaatggaaatcccaccgctcctactcctgccaagtcacccacgaaggctccaccgtcgaaaaaaccgtcgcccccaccgaatgctcc

SEQ ID NO: 61068 - RNA, 312 nt, synthetic construct
  misc_feature 1..312: note = derived and/or modified sequence opt11 from Ig_LightChain_lambda_constant_domain
  source 1..312: mol_type = other RNA
cccaaagccgccccctccgtcaccctcttccccccctcctccgaagaactccaagccaacaaagccaccctcgtctgcctcatctccgacttctaccccggcgccgtcaccgtcgcctggaaagccgactcctcccccgtcaaagccggcgtcgaaaccaccaccccctccaaacaatccaacaacaaatacgccgcctcctcctacctctccctcacccccgaacaatggaaatcacaccgctcctactcctgccaagtcacccacgaaggctccaccgtcgaaaaaaccgtcgcccccgccgaatgctcc

SEQ ID NO: 61069 - RNA, 312 nt, synthetic construct
  misc_feature 1..312: note = derived and/or modified sequence opt11 from Ig_LightChain_lambda_constant_domain
  source 1..312: mol_type = other RNA
cccaaagccgccccctccgtcaccctcttccccccctcctccgaagaactccaagccaacaaagccaccctcgtctgcctcatctccgacttctaccccggcgccgtcaccgtcgcctggaaagccgactcctcccccgtcaaagccggcgtagaaaccaccaccccctccaaacaatccaacaacaaatacgccgcctcctcctacctctccctcacccccgaacaatggaaatcccacaaatcctactcctgccaagtcacccacgaaggctccaccgtcgaaaaaaccgtcgcccccaccgaatgctcc

SEQ ID NO: 61070 - RNA, 312 nt, synthetic construct
  misc_feature 1..312: note = derived and/or modified sequence opt11 from Ig_LightChain_lambda_constant_domain
  source 1..312: mol_type = other RNA
cccaaagccgccccctccgtcaccctcttccccccctcctccgaagaactccaagccaacaaagccaccctcgtctgcctcatctccgacttctaccccggcgccgtcaccgtcgcctggaaagccgactcctcccccgtcaaagccggcgtcgaaaccaccaccccctccaaacaatccaacaacaaatacgccgcctcctcctacctctccctcacccccgaacaatggaaatcccacaaatcctactcctgccaagtcacccacgaaggctccaccgtcgaaaaaaccgtcgcccccgccgaatgctcc

SEQ ID NO: 61071 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcttccccctcgccccctcctccaaatccacctccggcggcaccgccgccctcggctgcctcgtcaaagactacttccccgaaccagtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaaaaagtc

SEQ ID NO: 61072 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaaaaagtc

SEQ ID NO: 61073 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcatcctccctcggcacccaaacctacatctgcaacgtcaaccacaaaccctccaacaccaaagtcgacaaaaaagcc

SEQ ID NO: 61074 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtaaaccacaaaccctccaacaccaaagtcgacaaacgcgtc

SEQ ID NO: 61075 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctcaaacaccaaagtcgacaaacgcgcc

SEQ ID NO: 61076 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcctccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaaaaagtc

SEQ ID NO: 61077 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcctccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaaaaagcc

SEQ ID NO: 61078 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcctccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaacgcgtc

SEQ ID NO: 61079 - RNA, 270 nt, synthetic construct
  misc_feature 1..270: note = derived and/or modified sequence opt11 from IgG1_HeavyChain_CH1_constant_domain
  source 1..270: mol_type = other RNA
tccggcccctccgtcctccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacatacatctgcaacgtcaaccacaaaccctcaaacaccaaagtcgacaaacgcgcc

SEQ ID NO: 61080 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctcactcggcacccaaacctacatctgcaacgtcaaccacaaaccctccaacaccaaagtcgacaaaaaagcc

SEQ ID NO: 61081 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaacgcgtc

SEQ ID NO: 61082 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcttccccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctatcctccgtcgtcaccgtcccctcctcctccctcggcacccaaacctacatctgcaacgtcaaccacaaaccctccaacaccaaagtcgacaaacgcgcc

SEQ ID NO: 61083 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcctacccctcgccccctcctccaaatccacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaaaaagtc

SEQ ID NO: 61084 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcctccccctcgccccctcctccaaatccacctccggcggaaccgccgccctaggctgcctcgtcaaagactacttccccgaacccgtcaccgtctcctggaactccggcgtccacaccttccccgccgtcctccaatcctccggcctctactccctctcctccgtcgtcaccgtcccctcctcctccctcggcacccaaacctacatctgcaacgtcaaccacaaaccctccaacaccaaagtcgacaaaaaagcc

SEQ ID NO: 61085 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcctccccctcgccccctcctccaaatcaacctccggcggcaccgccgccctcggctgcctcgtcaaagactacttccccgaacccgtcaccgtctcctggaactccggcgtccacaccttccccgccgtcctccaatcctccggcctctactccctctcctccgtcgtcaccgtcccctcctcatccctcggcacccaaacctacatctgcaacgtcaaccacaaaccctccaacaccaaagtcgacaaacgcgtc

SEQ ID NO: 61086 - RNA, 282 nt, synthetic construct
  misc_feature 1..282: note = derived and/or modified sequence opt11 from IgG1_HeavyChain_CH1_constant_domain
  source 1..282: mol_type = other RNA
tccgcctccaccaaaggcccctccgtcctccccctcgccccctcctcaaaatccacctccggcggcaccgccgccctcggctgcctcgtcaaagactacttccccgaacccgtcaccgtctcctggaactccggcgtccacaccttccccgccgtcctccaatcctccggcctctactcactctcctccgtcgtcaccgtcccctcctcctccctcggcacccaaacctacatctgcaacgtcaaccacaaaccctccaacaccaaagtcgacaaacgcgcc

SEQ ID NO: 61087 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcggcccatccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctccaacaaagccctccccgcccccatcgaaaaaaccatctccaaagcaaaa

SEQ ID NO: 61088 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcggcccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctccaacaaagccctacccgcccccatcgaaaaaaccatctccaaagccaaa

SEQ ID NO: 61089 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcggcccctccgtcttcctcttcccccccaaacccaaagacaccctcatgatctcccgcacccccgaagtaacctgcgtcgtcgtcgacgtctcccacgaagaccccgaagtcaaattcaacgtctacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctcaaaagccaaa

SEQ ID NO: 61090 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacgcctccacctaccgcgtagtctccgtcctaaccgtcctccaccaagactggctaaacggcaaagaatacaaatgcaaagtctccaacaaagccctccccgcccccatcgaaaaaaccatctccaaagccaaa

SEQ ID NO: 61091 - RNA, 330 nt, synthetic construct
  misc_feature 1..330: note = derived and/or modified sequence opt11 from IgG1_HeavyChain_CH2_constant_domain
  source 1..330: mol_type = other RNA
gcacccgaactcctcggcgccccctccgtcttcctcttcccccccaaacccaaagacaccctcatgatctcccgaacccccgaagtcacctgcgtagtcgtcgacgtctcccacgaagaccccgaagtcaaattcaacgtctacgtcgacggcgtcgaagtccacaacgccaaaaccaaaccccgcgaagaacaatacaactccacctaccgcgtcgtctccgtcctcaccgtcctccaccaagactggctaaacggcaaagaatacaaatgcaaagtctccaacaaagccctccccgcccccatcgaaaaaaccatctccaaagccaaa

SEQ ID NO: 61092 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcgccccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacgcctccacataccgcgtcgtctcagtcctcaccgtcctccaccaagactggctcaacggcaaagaatacaaatgcaaagtctccaacaaagccctccccgcccccatcgaaaaaaccatctccaaagccaaa

SEQ ID NO: 61093 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcgccccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacaactccacctaccgcgtcgtctccgtcctcaccgtcctccaccaagactggctaaacggcaaagaatacaaatgcaaagtctccaacaaagccctccccgcccccatcgaaaaaaccatctccaaagccaaa

SEQ ID NO: 61094 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcctcggcgccccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctcaaacaaagccctccccgcccccatcgaaaaaaccatctccaaagccaaa

SEQ ID NO: 61095 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcggcccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgagaagaacaatacaactccacctaccgcgtcgtctccgtcctcaccgtcctccaccaagactggctcaacggcaaagaatacaaatgcaaagtctccaacaaagccctccccgcccccatcgaaaaaacaatctcaaaagccaaa

SEQ ID NO: 61096 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcggcccctccgtcttcctcttcccccccaaacccaaagacaccctcatgatctcacgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctcaaaagccaaa

SEQ ID NO: 61097 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaacccagagaagaacaatacaactccacctaccgcgtcgtctccgtcctcaccgtcctccaccaagactggctcaacggcaaagaatacaaatgcaaagtctcaaacaaagccctccccgcacccatcgaaaaaaccatctccaaagccaaa

SEQ ID NO: 61098 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccacgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61099 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcgccccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61100 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcgccccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacgcctcaacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61101 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcgccccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61102 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaactcgccggcgccccctccgtcttcctcttcccccccaaacccaaagacaccctcatgatctcccgcacccccgaagtcacctgcgtagtcgtcgacgtctcccacgaagaccccgaagtcaaattcaactggtacgtcgacggcgtcgaagtccacaacgccaaaaccaaaccccgcgaagaacaatacgcctccacctaccgcgtcgtctccgtcctcaccgtcctccaccaagactggctaaacggcaaagaatacaaatgcaaagtctccaacaaagccctccccgcccccatcgaaaaaaccatctccaaagccaaa

SEQ ID NO: 61103 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcggcccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacaactccacctaccgcgtcgtctcagtcctcaccgtcctccaccaagactggctcaacggcaaagaatacaaatgcaaagtctccaacaaagccctccccgcccccatcgaaaaaaccatctccaaagccaaa

SEQ ID NO: 61104 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcggcccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61105 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgcaaaaaccaaaccccgcgaagaacaatacaactccacctaccgcgtcgtctccgtcctaaccgtcctccaccaagactggctcaacggcaaagaatacaaatgcaaagtctccaacaaagccctccccgcccccatcgaaaaaaccatctccaaagccaaa

SEQ ID NO: 61106 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61107 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcgccccctccgtcttcctattcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctcaaacaaagccctccccgcccccatcgaaaaaaccatctccaaagccaaa

SEQ ID NO: 61108 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcgccccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacgcctccacctaccgagtcgtatccgtcctcaccgtcctccaccaagactggctcaacggcaaagaatacaaatgcaaagtctccaacaaagccctccccgcccccatcgaaaaaaccatctccaaagccaaa

SEQ ID NO: 61109 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggagccccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61110 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccctcggcgccccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaacaaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61111 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcggcccctccgtcttcctcttcccccccaaacccaaagacaccctcatgatctcacgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacaactccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61112 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcggcccctccgtcttcctcttcccccccaaacccaaagacaccctcatgatctcccgcacccccgaagtcacctgcgtcgtcgtcgacgtctcccacgaagacccagaagtcaaattcaacgtctacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61113 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacaactccacctaccgagtcgtctccgtcctcaccgtcctccaccaagactggctcaacggcaaagaatacaaatgcaaagtctccaacaaagccctccccgcccccatcgaaaaaaccatctcaaaagccaaa

SEQ ID NO: 61114 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcggcccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgagaagaacaatacgcctccacctaccgcgtcgtctccgtcctcaccgtcctccaccaagactggctaaacggcaaagaatacaaatgcaaagtctccaacaaagccctccccgcccccatcgaaaaaaccatctccaaagccaaa

SEQ ID NO: 61115 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcgccccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacaactccacctaccgcgtcgtctccgtcctaaccgtactccaccaagactggctcaacggcaaagaatacaaatgcaaagtctccaacaaagccctccccgcccccatcgaaaaaaccatctccaaagccaaa

SEQ ID NO: 61116 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcgccccctccgtcttcctcttcccccccaaacccaaagacaccctcatgatctcccgcacccccgaagtcacctgcgtcgtcgtcgacgtctcccacgaagaccccgaagtcaaattcaacgtctacgtcgacggcgtcgaagtccacaacgccaaaaccaaaccccgcgaagaacaatacgcctccacctaccgcgtcgtctccgtcctcaccgtcctccaccaagactggctaaacggcaaagaatacaaatgcaaagtctccaacaaagccctccccgcccccatcgaaaaaaccatctccaaagccaaa

SEQ ID NO: 61117 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcgccccctccgtcttcctcttcccccccaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacaactccacctaccgcgtcgtctcagtcctcaccgtcctccaccaagactggctcaacggaaaagaatacaaatgcaaagtctccaacaaagccctccccgcccccatcgaaaaaaccatctccaaagccaaa

SEQ ID NO: 61118 - RNA, 330 nt, synthetic construct
  misc_feature 1..330: note = derived and/or modified sequence opt11 from IgG1_HeavyChain_CH2_constant_domain
  source 1..330: mol_type = other RNA
gcccccgaagccgccggcgccccctccgtcttcctcttccccccaaaacccaaagacaccctcatgatctcccgcacccccgaagtcacctgcgtcgtcgtcgacgtctcccacgaagaccccgaagtcaaattcaactggtacgtcgacggcgtcgaagtccacaacgccaaaaccaaaccccgcgaagaacaatacgcctccacctaccgcgtcgtctccgtcctcaccgtcctccaccaagactggctcaacggcaaagaatacaaatgcaaagtctccaacaaagccctccccgcccccatcgaaaaaaccatctccaaagccaaa

SEQ ID NO: 61119 - RNA, 318 nt, synthetic construct
  misc_feature 1..318: note = derived and/or modified sequence opt11 from IgG1_HeavyChain_CH3_constant_domain
  source 1..318: mol_type = other RNA
ggccaaccccgcgaaccccaagtctacaccctccccccctcccgcgaagaaatgaccaaaaaccaagtctccctcacctgcctcgtcaaaggcttctacccctccgacatcgccgtcgaatgggaatccaacggccaacccgaaaacaactacaaaaccaccccccccgtcctcgactccgacggctccttcttcctctactccaaactcaccgtcgacaaatcccgctggcaacaaggcaacgtcttctcctgctccgtcatgcacgaagccctccacaaccactacacccaaaaatccctctccctctcccccggc

SEQ ID NO: 61120 - RNA, 318 nt, synthetic construct
  misc_feature 1..318: note = derived and/or modified sequence opt11 from IgG1_HeavyChain_CH3_constant_domain
  source 1..318: mol_type = other RNA
ggccaaccccgcgaaccccaagtctacaccctccccccctcccgcgaagaactcaccaaaaaccaagtctccctcacctgcctcgtcaaaggcttctacccctccgacatcgccgtcgaatgggaatccaacggccaacccgaaaacaactacaaaaccaccccccccgtcctcgactccgacggctccttcttcctctactccaaactcaccgtcgacaaatcccgctggcaacaaggcaacgtcttctcctgctccgtcatgcacgaagccctccacaaccactacacccaaaaatcactctccctctcccccggc

SEQ ID NO: 61121 - RNA, 318 nt, synthetic construct
  misc_feature 1..318: note = derived and/or modified sequence opt11 from IgG1_HeavyChain_CH3_constant_domain
  source 1..318: mol_type = other RNA
ggccaaccccgcgaaccccaagtctacaccctccccccctcccgcgacgaaatgaccaaaaaccaagtctccctcacctgcctcgtcaaaggcttctacccctccgacatcgccgtcgaatgggaatccaacggccaacccgaaaacaactacaaaaccaccccccccgtcctcgactccgacggctccttcttcctctactccaaactcaccgtcgacaaatcccgctggcaacaaggcaacgtcttctcctgctccgtcatgcacgaagccctccacaaccactacacccaaaaatccctctccctctcccccggc

SEQ ID NO: 61122 - RNA, 318 nt, synthetic construct
  misc_feature 1..318: note = derived and/or modified sequence opt11 from IgG1_HeavyChain_CH3_constant_domain
  source 1..318: mol_type = other RNA
ggccaaccccgcgaaccccaagtctacaccctccccccctcccgcgacgaactcaccaaaaaccaagtctccctcacctgcctcgtcaaaggcttctacccctccgacatcgccgtcgaatgggaatccaacggccaacccgaaaacaactacaaaaccaccccccccgtcctcgactccgacggctccttcttcctctactccaaactcaccgtcgacaaatcccgctggcaacaaggcaacgtcttctcctgctccgtcatgcacgaagccctccacaaccactacacccaaaaatccctctccctctcccccggc

SEQ ID NO: 61123 - RNA, 297 nt, synthetic construct
  misc_feature 1..297: note = derived and/or modified sequence opt11 from IgG2_HeavyChain_CH1_constant_domain
  source 1..297: mol_type = other RNA
tccgcctccaccaaaggcccctccgtcttccccctcgccccctgctcccgctccacctccgaatccaccgccgccctcggctgcctcgtcaaagactacttccccgaacccgtcaccgtctcctggaactccggcgccctcacctccggcgtccacaccttccccgccgtcctccaatcctccggcctctactccctctcctccgtcgtcaccgtcccctcctccaacttcggcacccaaacctacacatgcaacgtcgaccacaaaccctccaacaccaaagtcgacaaaaccgtc

SEQ ID NO: 61124 - RNA, 297 nt, synthetic construct
  misc_feature 1..297: note = derived and/or modified sequence opt11 from IgG2_HeavyChain_CH1_constant_domain
  source 1..297: mol_type = other RNA
tccgcctccaccaaaggcccctccgtcttccccctcgccccctgctcccgctccacctccgaatccaccgccgccctcggctgcctcgtcaaagactacttccccgaacccgtcaccgtctcctggaactccggcgccctcacctccggcgtccacaccttccccgccgtcctccaatcctccggcctatactccctctcctccgtcgtcaccgtcacctcctccaacttcggcacccaaacctacacctgcaacgtcgaccacaaaccctccaacaccaaagtcgacaaaaccgtc

SEQ ID NO: 61125 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgcaggcccctccgtcttcctcttcccccccaaacccaaagacaccctcatgatctcccgcacccccgaagtcacctgcgtcgtcgtcgacgtctcccacgaagaccccgaagtccaattcaactggtacgtcgacggcgtcgaagtccacaacgccaaaaccaaaccccgcgaagaacaattcaactccaccttccgcgtcgtctccgtcctcaccgtcgtccaccaagactggctcaacggcaaagaatacaaatgcaaagtctccaacaaaggcctccccgcccccatcgaaaaaaccatctccaaaaccaaa

SEQ ID NO: 61126 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccctccgtcttcctcttcccccccaaacccaaagacaccctcatgatctcccgcacccccgaagtcacctgcgtcgtcgtcgacgtctcccacgaagaccccgaagtccaattcaactggtacgtcgacggcgtcgaagtccacaacgccaaaaccaaaccccgcgaagaacaattcaactccaccttccgcgtcgtctccgtcctcaccgtcgtccaccaagactggctcaacggcaaagaatacaaatgcaaagtctccaacaaaggcctccccgcctccatcgaaaaaaccatctccaaaaccaaa

SEQ ID NO: 61127 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccctccgtcttcctcttcccccccaaacccaaagacaccctcatgatctcccgcacccccgaagtcacctgcgtcgtcgtcgacgtctcccacgaagaccccgaagtccaattcaactggtacgtcgacggcgtcgaagtccacaacgccaaaaccaaaccccgcgaagaacaattcaactccaccttccgcgtcgtctccgtcctcaccgtcgtccaccaagactggctcaacggcaaagaatacaaatgcaaagtctccaacaaaggcctcccctcccccatcgaaaaaaccatctccaaaaccaaa

SEQ ID NO: 61128 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccctccgtcttcctcttcccccccaaacccaaagacaccctcatgatctcccgcacccccgaagtcacctgcgtagtcgtcgacgtctcccacgaagaccccgaagtccaattcaactggtacgtcgacggcgtcgaagtccacaacgccaaaaccaaaccccgagaagaacaattcaactccaccttccgcgtcgtctccgtcctcaccgtcgtccaccaagactggctcaacggcaaagaatacaaatgcaaagtctccaacaaaggcctcccctcctccatcgaaaaaaccatctccaaaaccaaa

SEQ ID NO: 61129 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccatccgtcttcctattcccccccaaacccaaagacaccctcatgatctcccgcacccccgaagtcacctgcgtcgtcgtcgacgtctcccacgaagaccccgaagtccaattcaactggtacgtcgacggcatggaagtccacaacgccaaaaccaaaccccgcgaagaacaattcaactccaccttccgcgtagtctccgtcctcaccgtagtccaccaagactggctcaacggcaaagaatacaaatgcaaagtctccaacaaaggcctccccgcccccatcgaaaaaaccatctccaaaaccaaa

SEQ ID NO: 61130 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccctccgtcttcctcttcccccccaaacccaaagacaccctcatgatctcccgcacccccgaagtcacctgcgtcgtcgtcgacgtatcccacgaagaccccgaagtccaattcaactggtacgtcgacggcatggaagtccacaacgccaaaaccaaaccccgcgaagaacaattcaactccaccttccgcgtcgtctccgtcctcaccgtcgtccaccaagactggctaaacggcaaagaatacaaatgcaaagtctccaacaaaggcctccccgcctccatcgaaaaaaccatctccaaaaccaaa

SEQ ID NO: 61131 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccctccgtcttcctcttcccccccaaacccaaagacaccctcatgatctcccgcacccccgaagtcacctgcgtcgtcgtcgacgtctcccacgaagaccccgaagtccaattcaactggtacgtcgacggcatggaagtccacaacgccaaaaccaaaccccgcgaagaacaattcaactccaccttccgcgtcgtctccgtcctcaccgtcgtccaccaagactggctcaacggcaaagaatacaaatgcaaagtctccaacaaaggcctcccctcccccatcgaaaaaaccatctccaaaaccaaa

SEQ ID NO: 61132 - RNA, 327 nt, synthetic construct
  misc_feature 1..327: note = derived and/or modified sequence opt11 from IgG2_HeavyChain_CH2_constant_domain
  source 1..327: mol_type = other RNA
gccccccccgtcgccggcccctccgtcttcctcttcccccccaaacccaaagacaccctcatgatctcccgcacccccgaagtcacctgcgtcgtcgtcgacgtctcccacgaagaccccgaagtccaattcaactggtacgtcgacggcatggaagtccacaacgccaaaaccaaaccccgcgaagaacaattcaactccaccttccgcgtcgtctccgtcctcaccgtcgtccaccaagactggctcaacggcaaagaatacaaatgcaaagtctccaacaaaggcctaccctcctccatcgaaaaaaccatctccaaaaccaaa

SEQ ID NO: 61133 - RNA, 318 nt, synthetic construct
  misc_feature 1..318: note = derived and/or modified sequence opt11 from IgG2_HeavyChain_CH3_constant_domain
  source 1..318: mol_type = other RNA
ggccaaccccgcgaaccccaagtctacaccctccccccctcccgcgaagaaatgaccaaaaaccaagtctccctcacctgcctcgtcaaaggcttctacccctccgacatcgccgtcgaatgggaatccaacggccaacccgaaaacaactacaaaaccaccccccccatgctcgactccgacggctccttcttcctctactccaaactcaccgtcgacaaatcccgctggcaacaaggcaacgtcttctcctgctccgtcatgcacgaagccctccacaaccactacacccaaaaatccctctccctctcccccggc

SEQ ID NO: 61134 - RNA, 297 nt, synthetic construct
  misc_feature 1..297: note = derived and/or modified sequence opt11 from IgG4_HeavyChain_CH1_constant_domain
  source 1..297: mol_type = other RNA
tccgcctccaccaaaggcccctccgtcttccccctcgccccctgctcccgctccacctccgaatccaccgccgccctcggctgcctcgtcaaagactacttccccgaacccgtcaccgtctcctggaactccggcgccctcacctccggcgtccacaccttccccgccgtcctccaatcctccggcctctactccctctcctccgtagtcaccgtcccctcatcctccctcggcaccaaaacctacacctgcaacgtcgaccacaaaccctccaacaccaaagtcgacaaacgcgtc

SEQ ID NO: 61135 - RNA, 330 nt, synthetic construct
  misc_feature 1..330: note = derived and/or modified sequence opt11 from IgG4_HeavyChain_CH2_constant_domain
  source 1..330: mol_type = other RNA
gcccccgaattcctcggcggcccctccgtcttcctcttcccccccaaacccaaagacaccctaatgatctcccgcacccccgaagtcacctgcgtcgtcgtcgacgtctcccaagaagaccccgaagtccaattcaactggtacgtcgacggcgtcgaagtccacaacgccaaaaccaaaccccgcgaagaacaattcaactccacctaccgcgtcgtctccgtcctcaccgtcctccaccaagactggctcaacggcaaagaatacaaatgcaaagtctcaaacaaaggcctcccctcctccatcgaaaaaaccatctccaaagccaaa

SEQ ID NO: 61136 - RNA, 318 nt, synthetic construct
  misc_feature 1..318: note = derived and/or modified sequence opt11 from IgG4_HeavyChain_CH3_constant_domain
  source 1..318: mol_type = other RNA
ggccaaccccgcgaaccccaagtctacaccctccccccctcccaagaagaaatgaccaaaaaccaagtctccctaacctgcctcgtcaaaggcttctacccctccgacatcgccgtcgaatgggaatccaacggccaacccgaaaacaactacaaaaccaccccccccgtcctcgactccgacggctccttcttcctctactcccgcctcaccgtcgacaaatcccgctggcaagaaggcaacgtcttctcctgctccgtcatgcacgaagccctccacaaccactacacccaaaaatccctctccctctccctcggc

SEQ ID NO: 61137 - DNA, 42 bp, synthetic construct
  misc_feature 1..42: note = 5'-UTR of human ribosomal protein Large 32 lacking the 5' terminal oligopyrimidine tract
  source 1..42: mol_type = other DNA
ggcgctgcctacggaggtggcagccatctccttctcggcatc

SEQ ID NO: 61138 - RNA, 42 nt, synthetic construct
  misc_feature 1..42: note = 5'-UTR of human ribosomal protein Large 32 lacking the 5' terminal oligopyrimidine tract mRNA
  source 1..42: mol_type = other RNA
ggcgctgcctacggaggtggcagccatctccttctcggcatc

SEQ ID NO: 61139 - DNA, 75 bp, synthetic construct
  misc_feature 1..75: note = 5'-UTR of human mitochondrial ATP synthase subunit alpha lacking the 5' terminal oligopyrimidine tract
  source 1..75: mol_type = other DNA
gcggctcggccattttgtcccagtcagtccggaggctgcggctgcagaagtaccgcctgcggagtaactgcaaag

SEQ ID NO: 61140 - RNA, 75 nt, synthetic construct
  misc_feature 1..75: note = 5'-UTR of human mitochondrial ATP synthase subunit alpha lacking the 5' terminal oligopyrimidine tract mRNA
  source 1..75: mol_type = other RNA
gcggctcggccattttgtcccagtcagtccggaggctgcggctgcagaagtaccgcctgcggagtaactgcaaag

SEQ ID NO: 61141 - DNA, 62 bp, synthetic construct
  misc_feature 1..62: note = 5'-UTR of human peroxisomal multifunctional enzyme type 2 lacking the 5' terminal oligopyrimidine tract
  source 1..62: mol_type = other DNA
gtcccgcagtcggcgtccagcggctctgcttgttcgtgtgtgtgtcgttgcaggccttattc

SEQ ID NO: 61142 - RNA, 62 nt, synthetic construct
  misc_feature 1..62: note = 5'-UTR of human peroxisomal multifunctional enzyme type 2 lacking the 5' terminal oligopyrimidine tract mRNA
  source 1..62: mol_type = other RNA
gtcccgcagtcggcgtccagcggctctgcttgttcgtgtgtgtgtcgttgcaggccttattc

SEQ ID NO: 61143 - DNA, 110 bp, synthetic construct
  misc_feature 1..110: note = 3'-UTR of Homo sapiens hemoglobin, alpha 1 (HBA1)
  source 1..110: mol_type = other DNA
gctggagcctcggtggccatgcttcttgccccttgggcctccccccagcccctcctccccttcctgcacccgtacccccgtggtctttgaataaagtctgagtgggcggc

SEQ ID NO: 61144 - RNA, 110 nt, synthetic construct
  misc_feature 1..110: note = 3'-UTR of Homo sapiens hemoglobin, alpha 1 (HBA1) mRNA
  source 1..110: mol_type = other RNA
gctggagcctcggtggccatgcttcttgccccttgggcctccccccagcccctcctccccttcctgcacccgtacccccgtggtctttgaataaagtctgagtgggcggc

SEQ ID NO: 61145 - DNA, 108 bp, synthetic construct
  misc_feature 1..108: note = 3'-UTR of Homo sapiens hemoglobin, alpha 2 (HBA2)
  source 1..108: mol_type = other DNA
gctggagcctcggtagccgttcctcctgcccgctgggcctcccaacgggccctcctcccctccttgcaccggcccttcctggtctttgaataaagtctgagtgggcag

SEQ ID NO: 61146 - RNA, 108 nt, synthetic construct
  misc_feature 1..108: note = 3'-UTR of Homo sapiens hemoglobin, alpha 2 (HBA2) mRNA
  source 1..108: mol_type = other RNA
gctggagcctcggtagccgttcctcctgcccgctgggcctcccaacgggccctcctcccctccttgcaccggcccttcctggtctttgaataaagtctgagtgggcag

SEQ ID NO: 61147 - DNA, 132 bp, synthetic construct
  misc_feature 1..132: note = 3'-UTR of Homo sapiens hemoglobin, beta (HBB)
  source 1..132: mol_type = other DNA
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 61148 - RNA, 132 nt, synthetic construct
  misc_feature 1..132: note = 3'-UTR of Homo sapiens hemoglobin, beta (HBB) mRNA
  source 1..132: mol_type = other RNA
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 61149 - DNA, 44 bp, synthetic construct
  misc_feature 1..44: note = Center, alpha-complex-binding portion of the 3'UTR of an alpha-globin gene (muag)
  source 1..44: mol_type = other DNA
gcccgatgggcctcccaacgggccctcctcccctccttgcaccg

SEQ ID NO: 61150 - RNA, 44 nt, synthetic construct
  misc_feature 1..44: note = Center, alpha-complex-binding portion of the 3'UTR of an alpha-globin gene (muag) mRNA
  source 1..44: mol_type = other RNA
gcccgatgggcctcccaacgggccctcctcccctccttgcaccg

SEQ ID NO: 61151 - DNA, 186 bp, synthetic construct
  misc_feature 1..186: note = 3'-UTR of human albumin
  source 1..186: mol_type = other DNA
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 61152 - RNA, 186 nt, synthetic construct
  misc_feature 1..186: note = 3'-UTR of human albumin mRNA
  source 1..186: mol_type = other RNA
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 61153 - DNA, 186 bp, synthetic construct
  misc_feature 1..186: note = 3'-UTR albumin7
  source 1..186: mol_type = other DNA
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 61154 - RNA, 186 nt, synthetic construct
  misc_feature 1..186: note = 3'-UTR albumin7 mRNA
  source 1..186: mol_type = other RNA
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 61155 - DNA, 187 bp, synthetic construct
  misc_feature 1..187: note = 3'-UTR ALB7
  source 1..187: mol_type = other DNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 61156 - RNA, 187 nt, synthetic construct
  misc_feature 1..187: note = 3'-UTR ALB7 mRNA
  source 1..187: mol_type = other RNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 61157 - DNA, 24 bp, synthetic construct
  misc_feature 1..24: note = histone stem-loop sequence
  source 1..24: mol_type = other DNA
caaaggctcttttcagagccacca

SEQ ID NO: 61158 - RNA, 24 nt, synthetic construct
  misc_feature 1..24: note = histone stem-loop sequence mRNA
  source 1..24: mol_type = other RNA
caaaggctcttttcagagccacca

SEQ ID NO: 61159 - DNA, 13 bp, synthetic construct
  misc_feature 1..13: note = Kozak
  source 1..13: mol_type = other DNA
gccgccaccatgg

SEQ ID NO: 61160 - RNA, 13 nt, synthetic construct
  misc_feature 1..13: note = Kozak mRNA
  source 1..13: mol_type = other RNA
gccgccaccatgg

SEQ ID NO: 61161 - DNA, 1344 bp, synthetic construct
  misc_feature 1..1344: note = Antibody Rituximab - wildtype, heavy chain
  source 1..1344: mol_type = other DNA
caggcgtatctgcagcagagcggcgcggaactggtgcgcccgggcgcgagcgtgaaaatgagctgcaaagcgagcggctatacctttaccagctataacatgcattgggtgaaacagaccccgcgccagggcctggaatggattggcgcgatttatccgggcaacggcgataccagctataaccagaaatttaaaggcaaagcgaccctgaccgtggataaaagcagcagcaccgcgtatatgcagctgagcagcctgaccagcgaagatagcgcggtgtatttttgcgcgcgcgtggtgtattatagcaacagctattggtattttgatgtgtggggcaccggcaccaccgtgaccgtgagcggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagcggaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaataa

SEQ ID NO: 61162 - DNA, 1344 bp, synthetic construct
  misc_feature 1..1344: note = Antibody Rituximab - GC-optimized heavy chain
  source 1..1344: mol_type = other DNA
caggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagtga

SEQ ID NO: 61163 - DNA, 633 bp, synthetic construct
  misc_feature 1..633: note = Antibody Rituximab - wildtype, light chain
  source 1..633: mol_type = other DNA
cagattgtgctgagccagagcccggcgattctgagcgcgagcccgggcgaaaaagtgaccatgacctgccgcgcgagcagcagcgtgagctatatgcattggtatcagcagaaaccgggcagcagcccgaaaccgtggatttatgcgccgagcaacctggcgagcggcgtgccggcgcgctttagcggcagcggcagcggcaccagctatagcctgaccattagccgcgtggaagcggaagatgcggcgacctattattgccagcagtggagctttaacccgccgacctttggcgcgggcaccaaactggaactgaaacgcaccgtggcggcgccgagcgtgtttatttttccgccgagcgatgaacagctgaaaagcggcaccgcgagcgtggtgtgcctgctgaacaacttttatccgcgcgaagcgaaagtgcagtggaaagtggataacgcgctgcagagcggcaacagccaggaaagcgtgaccgaacaggatagcaaagatagcacctatagcctgagcagcaccctgaccctgagcaaagcggattatgaaaaacataaagtgtatgcgtgcgaagtgacccatcagggcctgagcagcccggtgaccaaaagctttaaccgctaa

SEQ ID NO: 61164 - DNA, 633 bp, synthetic construct
  misc_feature 1..633: note = Antibody Rituximab - GC-optimized light chain
  source 1..633: mol_type = other DNA
cagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctga

SEQ ID NO: 61165 - DNA, 2269 bp, synthetic construct
  misc_feature 1..2269: note = Antibody Rituximab - modified RNA for the light and heavy chains in the total construct
  source 1..2269: mol_type = other DNA
aagcttaccatggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccagatctttctgacatttctgacatttctgacatttctgacatttctgacatttctgacatttctgacatttctgacatttctgacatttctgacatatgcataccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctgaccactagt

SEQ ID NO: 61166 - DNA, 1359 bp, synthetic construct
  misc_feature 1..1359: note = Antibody Cetuximab (Erbitux) - wildtype, heavy chain
  source 1..1359: mol_type = other DNA
caggtgcagctgaaacagagcggcccgggcctggtgcagccgagccagagcctgagcattacctgcaccgtgagcggctttagcctgaccaactatggcgtgcattgggtgcgccagagcccgggcaaaggcctggaatggctgggcgtgatttggagcggcggcaacaccgattataacaccccgtttaccagccgcctgagcattaacaaagataacagcaaaagccaggtgttttttaaaatgaacagcctgcagagcaacgataccgcgatttattattgcgcgcgcgcgctgacctattatgattatgaatttgcgtattggggccagggcaccctggtgaccgtgagcgcggcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaacgcgtggaaccgaaaagcccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaataa

SEQ ID NO: 61167 - DNA, 1359 bp, synthetic construct
  misc_feature 1..1359: note = Antibody Cetuximab (Erbitux) - GC-optimized heavy chain
  source 1..1359: mol_type = other DNA
caggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagtga

SEQ ID NO: 61168 - DNA, 642 bp, synthetic construct
  misc_feature 1..642: note = Antibody Cetuximab (Erbitux) - wildtype, light chain
  source 1..642: mol_type = other DNA
gatattctgctgacccagagcccggtgattctgagcgtgagcccgggcgaacgcgtgagctttagctgccgcgcgagccagagcattggcaccaacattcattggtatcagcagcgcaccaacggcagcccgcgcctgctgattaaatatgcgagcgaaagcattagcggcattccgagccgctttagcggcagcggcagcggcaccgattttaccctgagcattaacagcgtggaaagcgaagatattgcggattattattgccagcagaacaacaactggccgaccacctttggcgcgggcaccaaactggaactgaaacgcaccgtggcggcgccgagcgtgtttatttttccgccgagcgatgaacagctgaaaagcggcaccgcgagcgtggtgtgcctgctgaacaacttttatccgcgcgaagcgaaagtgcagtggaaagtggataacgcgctgcagagcggcaacagccaggaaagcgtgaccgaacaggatagcaaagatagcacctatagcctgagcagcaccctgaccctgagcaaagcggattatgaaaaacataaagtgtatgcgtgcgaagtgacccatcagggcctgagcagcccggtgaccaaaagctttaaccgcggcgcgtaa

SEQ ID NO: 61169 - DNA, 642 bp, synthetic construct
  misc_feature 1..642: note = Antibody Cetuximab (Erbitux) - GC-optimized light chain
  source 1..642: mol_type = other DNA
gacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctga

SEQ ID NO: 61170 - DNA, 2293 bp, synthetic construct
  misc_feature 1..2293: note = Antibody Cetuximab (Erbitux) - total construct with GC-optimized heavy and light chains
  source 1..2293: mol_type = other DNA
aagcttaccatggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccagatctttctgacatttctgacatttctgacatttctgacatttctgacatttctgacatttctgacatttctgacatttctgacatttctgacatatgcataccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctgaccactagt

SEQ ID NO: 61171 - DNA, 1356 bp, synthetic construct
  misc_feature 1..1356: note = Antibody Trastuzumab (Herceptin) - wildtype, heavy chain
  source 1..1356: mol_type = other DNA
gaagtgcagctggtggaaagcggcggcggcctggtgcagccgggcggcagcctgcgcctgagctgcgcggcgagcggctttaacattaaagatacctatattcattgggtgcgccaggcgccgggcaaaggcctggaatgggtggcgcgcatttatccgaccaacggctatacccgctatgcggatagcgtgaaaggccgctttaccattagcgcggataccagcaaaaacaccgcgtatctgcagatgaacagcctgcgcgcggaagataccgcggtgtattattgcagccgctggggcggcgatggcttttatgcgatggattattggggccagggcaccctggtgaccgtgagcagcgcgagcaccaaaggcccgagcgtgtttccgctggcgccgagcagcaaaagcaccagcggcggcaccgcggcgctgggctgcctggtgaaagattattttccggaaccggtgaccgtgagctggaacagcggcgcgctgaccagcggcgtgcatacctttccggcggtgctgcagagcagcggcctgtatagcctgagcagcgtggtgaccgtgccgagcagcagcctgggcacccagacctatatttgcaacgtgaaccataaaccgagcaacaccaaagtggataaaaaagtggaaccgccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaataa

SEQ ID NO: 61172 - DNA, 1356 bp, synthetic construct
  misc_feature 1..1356: note = Antibody Trastuzumab (Herceptin) - GC-optimized heavy chain
  source 1..1356: mol_type = other DNA
gaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagtga

SEQ ID NO: 61173 - DNA, 645 bp, synthetic construct
  misc_feature 1..645: note = Antibody Trastuzumab (Herceptin) - wildtype, light chain
  source 1..645: mol_type = other DNA
gatattcagatgacccagagcccgagcagcctgagcgcgagcgtgggcgatcgcgtgaccattacctgccgcgcgagccaggatgtgaacaccgcggtggcgtggtatcagcagaaaccgggcaaagcgccgaaactgctgatttatagcgcgagctttctgtatagcggcgtgccgagccgctttagcggcagccgcagcggcaccgattttaccctgaccattagcagcctgcagccggaagattttgcgacctattattgccagcagcattataccaccccgccgacctttggccagggcaccaaagtggaaattaaacgcaccgtggcggcgccgagcgtgtttatttttccgccgagcgatgaacagctgaaaagcggcaccgcgagcgtggtgtgcctgctgaacaacttttatccgcgcgaagcgaaagtgcagtggaaagtggataacgcgctgcagagcggcaacagccaggaaagcgtgaccgaacaggatagcaaagatagcacctatagcctgagcagcaccctgaccctgagcaaagcggattatgaaaaacataaagtgtatgcgtgcgaagtgacccatcagggcctgagcagcccggtgaccaaaagctttaaccgcggcgaatgctaa

SEQ ID NO: 61174 - DNA, 645 bp, synthetic construct
  misc_feature 1..645: note = Antibody Trastuzumab (Herceptin) - GC-optimized light chain
  source 1..645: mol_type = other DNA
gacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctga

SEQ ID NO: 61175 - DNA, 2295 bp, synthetic construct
  misc_feature 1..2295: note = Antibody Trastuzumab (Herceptin) - total construct with GC-optimized heavy und light chain
  source 1..2295: mol_type = other DNA
aagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccagatctttctgacatttctgacatttctgacatttctgacatttctgacatttctgacatttctgacatttctgacatttctgacatttctgacatatgcataccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgatgaccactag

SEQ ID NO: 61176 - protein, 4 aa, synthetic construct
  REGION 1..4: note = localization sequence for the endoplasmic reticulum
KDEL

SEQ ID NO: 61177 - protein, 4 aa, synthetic construct
  REGION 1..4: note = localization sequence for the endoplasmic reticulum
DDEL

SEQ ID NO: 61178 - protein, 4 aa, synthetic construct
  REGION 1..4: note = localization sequence for the endoplasmic reticulum
DEEL

SEQ ID NO: 61179 - protein, 4 aa, synthetic construct
  REGION 1..4: note = localization sequence for the endoplasmic reticulum
QEDL

SEQ ID NO: 61180 - protein, 4 aa, synthetic construct
  REGION 1..4: note = localization sequence for the endoplasmic reticulum
RDEL

SEQ ID NO: 61181 - protein, 7 aa, synthetic construct
  REGION 1..7: note = localization sequence for the nucleus
PKKKRKV

SEQ ID NO: 61182 - protein, 7 aa, synthetic construct
  REGION 1..7: note = localization sequence for the nucleus
PQKKIKS

SEQ ID NO: 61183 - protein, 5 aa, synthetic construct
  REGION 1..5: note = localization sequence for the nucleus
QPKKP

SEQ ID NO: 61184 - protein, 4 aa, synthetic construct
  REGION 1..4: note = localization sequence for the nucleus
RKKR

SEQ ID NO: 61185 - protein, 12 aa, synthetic construct
  REGION 1..12: note = localization sequence for the nuclear region
RKKRRQRRRAHQ

SEQ ID NO: 61186 - protein, 16 aa, synthetic construct
  REGION 1..16: note = localization sequence for the nuclear region
RQARRNRRRRWRERQR

SEQ ID NO: 61187 - protein, 19 aa, synthetic construct
  REGION 1..19: note = localization sequence for the nuclear region
MPLTRRRPAASQALAPPTP

SEQ ID NO: 61188 - protein, 15 aa, synthetic construct
  REGION 1..15: note = localization sequence for the endosomal compartiment
MDDQRDLISNNEQLP

SEQ ID NO: 61189 - protein, 32 aa, synthetic construct
  REGION 1..32: note = Myristoylation sequence, likalizing the antibody to the mitochondrial matrix
  REGION 7..8: note = misc_feature - Xaa can be any naturally occurring amino acid
  SITE 32: note = misc_feature - Xaa can be any naturally occurring amino acid
MLFNLRXXLNNAAFRHGHNFMVRNFRCGQPLX

SEQ ID NO: 61190 - protein, 8 aa, synthetic construct
  REGION 1..8: note = sequence for localization of antibodies to the plasma membrane
GCVCSSNP

SEQ ID NO: 61191 - protein, 8 aa, synthetic construct
  REGION 1..8: note = sequence for localization of antibodies to the plasma membrane
GQTVTTPL

SEQ ID NO: 61192 - protein, 8 aa, synthetic construct
  REGION 1..8: note = sequence for localization of antibodies to the plasma membrane
GQELSQHE

SEQ ID NO: 61193 - protein, 8 aa, synthetic construct
  REGION 1..8: note = sequence for localization of antibodies to the plasma membrane
GNSPSYNP

SEQ ID NO: 61194 - protein, 8 aa, synthetic construct
  REGION 1..8: note = sequence for localization of antibodies to the plasma membrane
GVSGSKGQ

SEQ ID NO: 61195 - protein, 8 aa, synthetic construct
  REGION 1..8: note = sequence for localization of antibodies to the plasma membrane
GQTITTPL

SEQ ID NO: 61196 - protein, 8 aa, synthetic construct
  REGION 1..8: note = sequence for localization of antibodies to the plasma membrane
GQTLTTPL

SEQ ID NO: 61197 - protein, 8 aa, synthetic construct
  REGION 1..8: note = sequence for localization of antibodies to the plasma membrane
GQIFSRSA

SEQ ID NO: 61198 - protein, 8 aa, synthetic construct
  REGION 1..8: note = sequence for localization of antibodies to the plasma membrane
GQIHGLSP

SEQ ID NO: 61199 - protein, 8 aa, synthetic construct
  REGION 1..8: note = sequence for localization of antibodies to the plasma membrane
GARASVLS

SEQ ID NO: 61200 - protein, 8 aa, synthetic construct
  REGION 1..8: note = sequence for localization of antibodies to the plasma membrane
GCTLSAEE

SEQ ID NO: 61201 - protein, 8 aa, synthetic construct
  REGION 1..8: note = sequence for localization of antibodies to the endoplasmic reticulum
GQNLSTSN

SEQ ID NO: 61202 - protein, 8 aa, synthetic construct
  REGION 1..8: note = sequence for localization of antibodies to the nucleus
GAALTILV

SEQ ID NO: 61203 - protein, 8 aa, synthetic construct
  REGION 1..8: note = sequence for localization of antibodies to the nucleus
GAALTLLG

SEQ ID NO: 61204 - protein, 8 aa, synthetic construct
  REGION 1..8: note = sequence for localization of antibodies to the nucleus endoplasmic reticulum and the cytoplasma
GAQVSSQK

SEQ ID NO: 61205 - protein, 8 aa, synthetic construct
  REGION 1..8: note = sequence for localization of antibodies to the nucleus endoplasmic reticulum and the cytoplasma
GAQLSRNT

SEQ ID NO: 61206 - protein, 8 aa, synthetic construct
  REGION 1..8: note = sequence for localization of antibodies to the golgi apparatus, the nucleus, the cytoplasma and the cytoskeleton
GNAAAAKK

SEQ ID NO: 61207 - protein, 8 aa, synthetic construct
  REGION 1..8: note = sequence for localization of antibodies to the cytoplasma and the cytoskeleton
GNEASYPL

SEQ ID NO: 61208 - protein, 8 aa, synthetic construct
  REGION 1..8: note = sequence for localization of antibodies to the plasma membrane and the cytoskeleton
GSSKSKPK

SEQ ID NO: 61209 - DNA, 2269 bp, synthetic construct
  misc_feature 1..2269: note = Alternative sequence of the construct of Fig. 12 (antibody rituximab), wherein the restriction sites have been modified as compared to SEQ ID NO. 6697 of Fig. 12
  source 1..2269: mol_type = other DNA
aagcttaccatggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccatgcatttctgacatttctgacatttctgacatttctgacatttctgacatttctgacatttctgacatttctgacatttctgacatttctgacatagatctaccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctgaccactagt

SEQ ID NO: 61210 - DNA, 2293 bp, synthetic construct
  misc_feature 1..2293: note = Alternative sequence of the construct of Fig. 17 (antibody cetuximab), wherein the restriction sites have been modified as compared to SEQ ID NO. 6702 of Fig. 17
  source 1..2293: mol_type = other DNA
aagcttaccatggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccatgcatttctgacatttctgacatttctgacatttctgacatttctgacatttctgacatttctgacatttctgacatttctgacatttctgacatagatctaccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctgaccactagt

SEQ ID NO: 61211 - DNA, 2295 bp, synthetic construct
  misc_feature 1..2295: note = Alternative sequence of the construct of Fig. 22 (antibody trastuzumab), wherein the restriction sites have been modified as compared to SEQ ID NO. 6707 of Fig. 22
  source 1..2295: mol_type = other DNA
aagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccatgcatttctgacatttctgacatttctgacatttctgacatttctgacatttctgacatttctgacatttctgacatttctgacatttctgacatagatctaccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgatgaccactag

SEQ ID NO: 61212 - protein, 458 aa, synthetic construct
  REGION 1..458: note = Protein (HC) w/o signal peptide encoded by mRNA R3578, R3000
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61213 - protein, 452 aa, synthetic construct; identical to SEQ ID NO: 154
  REGION 1..452: note = Protein (HC) w/o signal peptide & his-tag encoded by mRNA R3578, R3000

SEQ ID NO: 61214 - protein, 213 aa, synthetic construct; identical to SEQ ID NO: 156
  REGION 1..213: note = Protein (LC) w/o signal peptide encoded by mRNA R3578, R3000

SEQ ID NO: 61215 - RNA, 1374 nt, synthetic construct
  misc_feature 1..1374: note = CDS (HC) w/o signal peptide encoded by mRNA R3578, R3000
  source 1..1374: mol_type = other RNA
caggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcat

SEQ ID NO: 61216 - RNA, 1356 nt, synthetic construct
  misc_feature 1..1356: note = CDS (HC) w/o signal peptide & his-tag encoded by mRNA R3578, R3000
  source 1..1356: mol_type = other RNA
caggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaag

SEQ ID NO: 61217 - RNA, 639 nt, synthetic construct
  misc_feature 1..639: note = CDS (LC) w/o signal peptide encoded by mRNA R3578, R3000
  source 1..639: mol_type = other RNA
gacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcc

SEQ ID NO: 61218 - RNA, 1374 nt, synthetic construct
  misc_feature 1..1374: note = derived and/or modified sequence opt2 from CDS (HC) w/o signal peptide encoded by mRNA R3578, R3000
  source 1..1374: mol_type = other RNA
caggtccagctcaagcagtccggccccggcctcgtccagccctcccagtccctctccatcacctgcaccgtctccggcttctccctcaccaactacggcgtccactgggtccgccagtcccccggcaagggcctcgagtggctcggcgtcatctggtccggcggcaacaccgactacaacacccccttcacctcccgcctctccatcaacaaggacaactccaagtcccaggtcttcttcaagatgaactccctccagtccaacgacaccgccatctactactgcgcccgcgccctcacctactacgactacgagttcgcctactggggccagggcaccctcgtcaccgtctccgccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagcaccaccaccaccaccac

SEQ ID NO: 61219 - RNA, 1356 nt, synthetic construct; identical to SEQ ID NO: 15438
  misc_feature 1..1356: note = derived and/or modified sequence opt2 from CDS (HC) w/o signal peptide & his-tag encoded by mRNA R3578, R3000
  source 1..1356: mol_type = other RNA

SEQ ID NO: 61220 - RNA, 639 nt, synthetic construct; identical to SEQ ID NO: 15440
  misc_feature 1..639: note = derived and/or modified sequence opt2 from CDS (LC) w/o signal peptide encoded by mRNA R3578, R3000
  source 1..639: mol_type = other RNA

SEQ ID NO: 61221 - RNA, 1374 nt, synthetic construct
  misc_feature 1..1374: note = derived and/or modified sequence opt3 from CDS (HC) w/o signal peptide encoded by mRNA R3578, R3000
  source 1..1374: mol_type = other RNA
caggtgcaactgaagcagagcggccccgggctcgtccagccttcccagtctctttcaattacctgcacagttagtggattcagcctgactaactacggtgtgcactgggtaagacaatccccaggcaaagggttggagtggttaggagtgatctggtctggcggtaatacggactataacaccccgtttacatcgaggctgtcaataaataaggataacagcaaaagtcaggtcttctttaagatgaatagcctacagtctaacgacactgctatctactattgtgctcgggcactcacctactatgattacgagttcgcctattgggggcagggaacactggtgaccgttagcgcggcttccactaaaggcccctcagtgtttcctcttgccccaagtagcaagtctacatccggcgggaccgcagccctgggatgcttggtcaaggactacttccccgaacctgtgacggtatcatggaatagcggtgctctcacaagtggcgttcatacctttccagcagtgctgcaatcttccgggctgtacagcctctcgtctgtcgtgacagtgccctcctcaagtttaggaactcagacctatatttgtaacgtcaatcacaaacctagcaacacaaaggttgataaacgcgtggaaccaaagtccccgaaatcttgcgacaagacccatacgtgtcccccttgcccagcccccgagctgcttggcggtcctagcgtattcttgtttccacccaagccgaaagatactctgatgatctcacgaacacctgaagtgacctgtgtcgtggttgacgtgagtcacgaggatcccgaggtcaagttcaattggtacgtggacggggtagaagttcataacgctaaaactaagccacgtgaggaacagtataattccacatacagagtggtcagcgtgctaaccgtcctccaccaggattggctgaacggaaaagagtataagtgcaaagtgtctaataaggcccttcctgcgcccattgagaagacgatctcaaaagcaaagggccaaccaagggaaccccaggtttacaccctgcctccaagtcgggacgagttgactaaaaaccaggtgagcctcacttgtctggtaaagggcttttatccgtccgatatagccgtcgaatgggagtctaacgggcaacccgaaaataactacaaaaccacacctccagtgttagactcggacggatccttctttctgtactccaagctcactgttgataagtcacgctggcagcagggtaatgtgttcagttgctctgtcatgcacgaggcccttcataaccactatacccagaaaagcctgtccttgtcacccggcaagcatcaccaccatcaccat

SEQ ID NO: 61222 - RNA, 1356 nt, synthetic construct; identical to SEQ ID NO: 23080
  misc_feature 1..1356: note = derived and/or modified sequence opt3 from CDS (HC) w/o signal peptide & his-tag encoded by mRNA R3578, R3000
  source 1..1356: mol_type = other RNA

SEQ ID NO: 61223 - RNA, 639 nt, synthetic construct; identical to SEQ ID NO: 23082
  misc_feature 1..639: note = derived and/or modified sequence opt3 from CDS (LC) w/o signal peptide encoded by mRNA R3578, R3000
  source 1..639: mol_type = other RNA

SEQ ID NO: 61224 - RNA, 1374 nt, synthetic construct
  misc_feature 1..1374: note = derived and/or modified sequence opt4 from CDS (HC) w/o signal peptide encoded by mRNA R3578, R3000
  source 1..1374: mol_type = other RNA
caggtgcagctgaagcagagcggccccggcctggtgcagcccagccagagcctgagcatcacctgcaccgtgagcggcttcagcctgaccaactacggcgtgcactgggtgagacagagccccggcaagggcctggagtggctgggcgtgatctggagcggcggcaacaccgactacaacacccccttcaccagcagactgagcatcaacaaggacaacagcaagagccaggtgttcttcaagatgaacagcctgcagagcaacgacaccgccatctactactgcgccagagccctgacctactacgactacgagttcgcctactggggccagggcaccctggtgaccgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagccccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagcaccaccaccaccaccac

SEQ ID NO: 61225 - RNA, 1356 nt, synthetic construct; identical to SEQ ID NO: 30722
  misc_feature 1..1356: note = derived and/or modified sequence opt4 from CDS (HC) w/o signal peptide & his-tag encoded by mRNA R3578, R3000
  source 1..1356: mol_type = other RNA

SEQ ID NO: 61226 - RNA, 639 nt, synthetic construct; identical to SEQ ID NO: 30724
  misc_feature 1..639: note = derived and/or modified sequence opt4 from CDS (LC) w/o signal peptide encoded by mRNA R3578, R3000
  source 1..639: mol_type = other RNA

SEQ ID NO: 61227 - RNA, 1374 nt, synthetic construct
  misc_feature 1..1374: note = derived and/or modified sequence opt5 from CDS (HC) w/o signal peptide encoded by mRNA R3578, R3000
  source 1..1374: mol_type = other RNA
caggtgcaactgaagcagagcggccccgggctcgtccagccttcccagtctctgagcatcacatgcacagtttccggattctctcttacgaactacggcgtgcactgggtgagacaaagcccggggaaaggactggagtggctcggcgtcatttggtccgggggaaataccgactataacacaccctttacctctcggctgagcatcaataaggataactccaaaagccaggtgttctttaagatgaactctcttcagtccaatgacacagccatttactattgtgctcgcgccctgacctactatgattacgagttcgcgtattggggccagggcacactcgttaccgtgagcgctgcctctacgaaagggccttccgtctttcccctggcccctagctctaagtccaccagcggaggcacagctgccctggggtgcctcgtgaaggactacttccccgaacctgttaccgtgtcctggaactctggagctctgacaagcggcgtccatacctttccggccgtgcttcaatccagcgggctgtactctctctccagcgtggtcacggttccctctagctccctgggaacacagacctatatctgtaatgtgaatcacaaaccttctaacacaaaggtggataaaagagtcgaacccaagagccctaaatcctgcgacaagacccatacctgtcccccgtgccctgcgcccgagcttctgggcggccctagcgtgttcctctttcctcccaagcccaaagatacactgatgatttctcggacgccggaagttacctgtgtggtcgtggacgtttcccacgaggatcccgaggtgaagttcaattggtacgtcgacggggtggaagtccataacgccaaaacaaagcctcgcgaggaacagtataatagcacctacagagtggtttctgtgctgacagtcctccaccaggattggctgaacggaaaagagtataagtgcaaagtgtccaataaggcccttcccgctcctatcgagaagaccatcagcaaagctaagggccaaccccgggaaccgcaggtttacacgctgcctccctcccgcgacgagctcaccaaaaaccaggtgtctctgacctgtcttgtcaaggggttttatcctagcgatattgccgtggaatgggagtccaacggacaacccgaaaataactacaaaaccacacctcccgtgctggactctgacggcagcttctttctctactccaagctgaccgttgataagagcagatggcagcaggggaatgtcttctcttgctccgtgatgcacgaggcgctgcataaccactatacacagaaaagcctctctctgtccccgggaaagcatcaccaccatcaccat

SEQ ID NO: 61228 - RNA, 1356 nt, synthetic construct; identical to SEQ ID NO: 38364
  misc_feature 1..1356: note = derived and/or modified sequence opt5 from CDS (HC) w/o signal peptide & his-tag encoded by mRNA R3578, R3000
  source 1..1356: mol_type = other RNA

SEQ ID NO: 61229 - RNA, 639 nt, synthetic construct; identical to SEQ ID NO: 38366
  misc_feature 1..639: note = derived and/or modified sequence opt5 from CDS (LC) w/o signal peptide encoded by mRNA R3578, R3000
  source 1..639: mol_type = other RNA

SEQ ID NO: 61230 - RNA, 1374 nt, synthetic construct
  misc_feature 1..1374: note = derived and/or modified sequence opt6 from CDS (HC) w/o signal peptide encoded by mRNA R3578, R3000
  source 1..1374: mol_type = other RNA
caagtacaactcaaacaatcaggaccaggacttgtccaaccttcccaatccttatcaataacatgcacagtatcaggattctccttaacaaactacggagtacactgggtccgccaatccccaggcaaaggactagaatggctaggagttatatggtccggaggaaatacagactacaacacaccatttacatcaagactctcaataaataaagacaattccaaatcacaagtcttcttcaaaatgaactctttacaatccaacgacacagctatctactactgcgcccgtgctctaacatactacgattacgaatttgcatactggggacaaggaacattagttaccgtctcagccgcttcaactaaaggaccatccgtattcccactagctccaagctccaaatcaacatccggaggaacagcagctctaggatgtctcgtcaaagactacttccccgaaccagtaaccgtatcatggaactcaggagcactaacatctggtgtacataccttcccagcagtactacaatcatcaggtttatactcattatcaagcgtagtaacagtcccatcttcatcactaggaacacaaacgtacatatgtaatgtaaaccacaaaccttccaatacaaaagtagacaaaagagtagaacccaaatctcccaaatcatgcgataaaacccacacatgtccaccatgccccgctccagaactactaggaggcccatccgtctttctattcccaccaaaacctaaagataccctaatgatttcacgcacaccagaagtaacttgcgtagtagtagacgtatcacacgaagatcctgaagtaaaatttaactggtatgtagacggagtagaagtacacaatgcaaaaaccaaaccccgtgaagaacaatataactccacatacagagtagtatctgtacttacagtactccaccaagactggttaaatggaaaagaatacaaatgcaaagtatccaacaaagccttaccagctcccatagaaaaaaccatatcaaaagcaaaaggtcaaccaagagaaccacaagtttataccctaccaccttctagagatgaactaaccaaaaaccaagtatcacttacatgcctagtcaaaggcttctatccatctgatatcgcagtcgaatgggaaagtaacggacaaccagaaaacaactacaaaactacacctccagtactagattccgacggctcattcttcctatattcaaaattaactgtggataaatcaagatggcaacaaggcaatgtattctcatgctcagtaatgcatgaagcattacacaaccattacacacaaaaatccctctcattatcacccggaaaacaccatcatcaccaccac

SEQ ID NO: 61231 - RNA, 1356 nt, synthetic construct
  misc_feature 1..1356: note = derived and/or modified sequence opt6 from CDS (HC) w/o signal peptide & his-tag encoded by mRNA R3578, R3000
  source 1..1356: mol_type = other RNA
caagttcaattaaaacaatcaggacctggattagtacaaccctcccaaagcctatccatcacatgcacagtatcaggattttctctcacaaactatggagtccactgggtacgacaatcaccaggaaaaggtctagaatggctaggagtaatatggtctggcggcaacacagactacaacaccccattcacatcaagattatctataaacaaagataactcaaaatcacaagtctttttcaaaatgaatagtctacaatcaaatgatacagcaatatattactgcgcacgagctctaacatactatgactacgaatttgcttactggggtcaaggaactctagtcaccgtatcagctgcctcaacaaaaggaccatcagtattccccctagcaccatcatctaaatcaacatcaggcggaactgcagcattaggatgcctcgtaaaagactacttcccagaaccagtaacagtctcatggaactcaggcgcactcacatcaggtgtacacacattcccagctgtattacaatcatcaggcctatactccctctcatctgtcgtaacagttccaagttcatccttaggtacacaaacatacatatgcaatgtaaatcacaaaccatcaaacaccaaagtcgataaaagagtcgaaccaaaaagcccaaaatcttgcgataaaacacacacatgtcccccttgcccagccccagaattactaggtggaccttcagtctttctattcccacctaaacctaaagacacattaatgatatcaagaacacccgaagttacatgtgtagttgtagatgtctcacatgaagatcctgaagtaaaattcaactggtacgtcgacggagtagaagtacacaacgcaaaaacaaaaccaagagaagaacaatacaattcaacctaccgtgtcgtctcagtactaaccgttcttcaccaagactggctaaatggaaaagaatacaaatgtaaagtatcaaataaagcattacccgccccaatcgaaaagacaatatcaaaagctaaaggtcaaccaagagaacctcaagtatataccctaccaccatctagagacgaattaaccaaaaatcaagtatcattaacttgcctagtaaaaggcttctacccctccgacattgctgtagaatgggaatctaacggccaaccagaaaataactataaaacaacaccaccagtcctagactcagacggatctttcttcttatattcaaaactaacagtagacaaatccagatggcaacaaggaaatgtcttctcctgctcagtaatgcatgaagcactacacaaccactacacacaaaaatccctcagcctctcccccggaaaa

SEQ ID NO: 61232 - RNA, 639 nt, synthetic construct
  misc_feature 1..639: note = derived and/or modified sequence opt6 from CDS (LC) w/o signal peptide encoded by mRNA R3578, R3000
  source 1..639: mol_type = other RNA
gacatactactaacacaatcaccagtaatattatccgtatccccaggcgaaagagtatcattctcatgcagagcatcacaatcaataggaacaaacatacactggtaccaacaaagaactaacggatcaccaagactattaataaaatacgcatcagaatccatatcaggaataccatcaagattctcaggatcaggatcaggaacagacttcacactatccataaactcagtagaatccgaagacatagccgactactactgccaacaaaacaacaactggccaacaacatttggagccggaacaaaattagaactcaaaagaacagtagcagccccatcagtattcatattcccaccctccgacgaacaactaaaatcaggtacagcatcagtagtatgcctactaaacaacttctacccaagagaagcaaaagtacaatggaaagtagacaacgcactacaatcaggaaactcacaagaatcagtaacagaacaagattcaaaagactcaacatactcactatcatcaacattaacactatccaaagccgattacgaaaaacacaaagtatacgcatgcgaagtaacacatcaaggcctatcatcaccagtaacaaaatcattcaacagaggagca

SEQ ID NO: 61233 - RNA, 1374 nt, synthetic construct
  misc_feature 1..1374: note = derived and/or modified sequence opt11 from CDS (HC) w/o signal peptide encoded by mRNA R3578, R3000
  source 1..1374: mol_type = other RNA
caagtccaacttaaacaatcaggccccggcctcgtacaaccctcccaatcgctttcaatcacctgtaccgtctcaggcttctctctcaccaactacggcgttcattgggtccgccaatcccccggcaaaggcctcgaatggctcggcgtcatctggtccggcggcaatacagactacaacaccccctttacctcccgcctctcaatcaacaaagacaactccaaatctcaggtcttcttcaaaatgaatagcctccaatccaacgacaccgctatctattactgtgcacgcgctctgacttactacgactacgaatttgcatactggggacaaggcaccctagtcaccgtatccgccgcctccactaagggcccctctgtcttccccctagccccatcctccaagagcacctccggcggaaccgccgcactaggctgcctcgtcaaagactacttcccagaacccgtcaccgtctcctggaactcaggtgccctaacctcaggcgtccacacattccccgccgttctgcaatcctcaggcctttactctctctcttcagttgtaaccgtcccctcctctagcctcggcacccaaacttatatttgcaacgtaaaccacaaaccatccaatacaaaagtagacaaaagagtcgaacccaaaagccccaaatcctgcgacaaaacccatacctgcccaccctgccccgcacccgaactactcggcggcccctccgtcttcctcttcccacccaaacccaaagacaccctcatgatctcccgcacacccgaagtaacctgcgtcgtcgtcgacgttagccacgaagaccccgaagttaaattcaactggtacgtagacggtgtagaagtccacaatgcaaagaccaaaccccgcgaagaacaatacaattcaacctatcgagtagtatccgtcctcactgtactccaccaagactggctaaacggcaaagaatacaaatgcaaagtaagcaacaaagccctacccgcccccatagaaaagacaataagcaaagctaaaggccaaccccgcgaaccccaagtctacaccctcccaccctcacgtgacgaactcaccaaaaaccaagtatcattaacttgcctcgtcaaaggcttctacccctccgacatcgccgtcgaatgggaatccaatggccaaccagaaaacaactacaaaaccacaccacccgtcctcgactccgatggatctttctttctctactccaaactaacagtcgacaaaagccgatggcaacaaggcaacgttttctcctgctccgtcatgcacgaagccctacacaaccactacacccaaaaatccctctccctatcccccggcaaacaccaccaccaccaccac

SEQ ID NO: 61234 - RNA, 1356 nt, synthetic construct
  misc_feature 1..1356: note = derived and/or modified sequence opt11 from CDS (HC) w/o signal peptide & his-tag encoded by mRNA R3578, R3000
  source 1..1356: mol_type = other RNA
caagtccagctaaaacagtccggccccggcctggtccaaccatcccaatccctatccatcacttgcaccgtctccggcttctccctcactaactacggcgtccactgggtccgccaaagccccggaaaaggcctcgaatggcttggagtcatatggtcgggcggcaacacagactacaacacgcccttcacctcacgattatcaatcaacaaagacaacagcaaaagccaagtcttcttcaaaatgaactcactccaatcaaacgacacagccatctactactgcgcccgtgccctcacatactacgactacgagttcgcctactggggacaaggcactctcgtaaccgttagcgccgcatctaccaagggccccagcgtctttccactcgccccctcctccaaatctacctccggcggaaccgccgcccttggctgcctcgtaaaagactacttccccgaaccagtaaccgtttcctggaactccggagcactcacctccggcgtacacacattcccagccgtcctccaatcctccggcctctactcactctcctccgtagtcacggtcccgtcctcctccctcggcacccaaacatatatctgcaatgtcaatcacaaaccctccaacaccaaagtagacaaacgcgtcgaacccaaatcccccaaaagctgcgacaaaacccacacatgccctccctgcccagcccccgaattactaggcggcccctccgtattcctattcccacccaaacccaaagacacgctcatgatctccagaacccccgaagtaacctgcgtcgtcgtcgacgtctcccatgaagaccccgaagtcaaattcaactggtacgtcgacggagtcgaagtccacaacgccaaaaccaaaccccgcgaagaacaatacaactccacataccgagtagtctccgttctaaccgtcctacaccaagactggctcaacggcaaagaatacaaatgcaaagtctcaaacaaagcccttcccgcccccatcgaaaagaccatctcaaaagccaaaggacaaccccgagaaccacaagtctatacactcccaccctcacgtgacgaactaaccaaaaaccaagtctccctaacctgcctagtaaaaggtttctacccctccgacattgccgtcgaatgggaaagcaatggccagcccgaaaacaactacaaaaccaccccacccgtcctcgactccgacggcagcttcttcctatactccaaactcacagtagacaaatcccgctggcaacagggcaacgtattctcatgctccgttatgcacgaagcactccacaaccactacacccaaaaatcactatcactatctcccggcaaa

SEQ ID NO: 61235 - RNA, 639 nt, synthetic construct
  misc_feature 1..639: note = derived and/or modified sequence opt11 from CDS (LC) w/o signal peptide encoded by mRNA R3578, R3000
  source 1..639: mol_type = other RNA
gacatcctcctcacccaatcccccgtaatcctctccgtctcacccggcgaacgcgtctccttctcctgccgcgcctcccaatccatcggaaccaacatacactggtaccaacaacgaaccaacggatcccccagactcctaatcaaatacgcatccgaatccatctccggaatcccctcccgcttctccggctcaggctccggcaccgacttcaccctatccatcaactcagtcgaatccgaagacatcgccgactactactgccaacaaaacaacaactggcccaccacattcggcgccggaaccaaactcgaactcaaacgaaccgtcgccgccccctccgtcttcatcttcccaccctccgacgaacaactcaaatccggcaccgcctctgtcgtctgcctcctcaacaacttctacccccgcgaagccaaagtccaatggaaagtcgacaacgcacttcaatccggcaactcccaagaatcagtcaccgaacaagactccaaagactccacctactccctatcctcaacactcaccctcagcaaagccgactacgaaaaacacaaagtatacgcctgcgaagtcacccaccaaggcctttcctcccccgtcaccaaatccttcaaccgaggagcc

SEQ ID NO: 61236 - protein, 477 aa, synthetic construct
  REGION 1..477: note = Protein 1 (HC) w/o his-tag encoded by mRNA R3578, R3000
MAVMAPRTLVLLLSGALALTQTWAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61237 - protein, 483 aa, synthetic construct
  REGION 1..483: note = Protein 1 (HC) encoded by mRNA R3578, R3000
MAVMAPRTLVLLLSGALALTQTWAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61238 - protein, 238 aa, synthetic construct
  REGION 1..238: note = Protein 2 (LC) encoded by mRNA R3578, R3000
MAVMAPRTLVLLLSGALALTQTWAGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 61239 - RNA, 1434 nt, synthetic construct
  misc_feature 1..1434: note = CDS 1 (HC) w/o his-tag as RNA from mRNA R3578, R3000
  source 1..1434: mol_type = other RNA
atggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagtga

SEQ ID NO: 61240 - RNA, 1452 nt, synthetic construct
  misc_feature 1..1452: note = CDS 1 (HC) as RNA from mRNA R3578, R3000
  source 1..1452: mol_type = other RNA
atggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattga

SEQ ID NO: 61241 - RNA, 717 nt, synthetic construct
  misc_feature 1..717: note = CDS 2 (LC) as RNA from mRNA R3578, R3000
  source 1..717: mol_type = other RNA
atggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctga

SEQ ID NO: 61242 - RNA, 2848 nt, synthetic construct
  misc_feature 1..2848: note = CDS (HC)-IRES-CDS (LC) as RNA from mRNA R3578, R3000
  source 1..2848: mol_type = other RNA
atggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctga

SEQ ID NO: 61243 - RNA, 3040 nt, synthetic construct
  misc_feature 1..3040: note = R3578
  source 1..3040: mol_type = other RNA
gggagaaagcttaccatggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61244 - RNA, 3052 nt, synthetic construct
  misc_feature 1..3052: note = R3000
  source 1..3052: mol_type = other RNA
gggagaaagcttaccatggccgtgatggcgccgcggaccctggtcctcctgctgagcggcgccctcgccctgacgcagacctgggccgggcaggtgcagctgaagcagagcggcccggggctcgtccagccctcgcagagcctgagcatcacctgcacggtgagcggcttcagcctgaccaactacggggtgcactgggtccggcagtcgcccggcaaggggctcgagtggctgggcgtgatctggagcggcgggaacaccgactacaacacccccttcacgagccgcctgagcatcaacaaggacaacagcaagtcgcaggtgttcttcaagatgaacagcctccagagcaacgacaccgccatctactactgcgcgcgggccctgacctactacgactacgagttcgcctactggggccaggggaccctggtcacggtgagcgccgcgagcaccaagggcccgagcgtgttccccctcgccccctcgagcaagagcaccagcggcgggaccgccgccctgggctgcctggtcaaggactacttccccgagccggtgacggtgagctggaactcgggggccctcaccagcggcgtccacaccttccccgcggtgctgcagagcagcgggctgtacagcctcagctcggtggtcaccgtgcccagcagcagcctgggcacgcagacctacatctgcaacgtgaaccacaagcccagcaacaccaaggtcgacaagcgcgtggagccgaagtcgcccaagagctgcgacaagacccacacgtgcccgccctgccccgcccccgagctgctcggcgggcccagcgtgttcctgttcccgcccaagcccaaggacaccctgatgatcagccggacccccgaggtcacctgcgtggtggtcgacgtgagccacgaggacccggaggtgaagttcaactggtacgtcgacggcgtggaggtgcacaacgccaagacgaagccccgcgaggagcagtacaacagcacctaccgggtcgtgtcggtgctcaccgtcctgcaccaggactggctgaacgggaaggagtacaagtgcaaggtgagcaacaaggccctccccgcgcccatcgagaagaccatcagcaaggccaagggccagccgcgcgagccccaggtgtacacgctgccccccagccgggacgagctgaccaagaaccaggtcagcctcacctgcctggtgaaggggttctacccgtcggacatcgccgtggagtgggagagcaacggccagcccgagaacaactacaagaccacgcccccggtcctggacagcgacggcagcttcttcctctacagcaagctgaccgtggacaagagccgctggcagcaggggaacgtgttctcgtgcagcgtcatgcacgaggccctgcacaaccactacacccagaagagcctcagcctgagccccggcaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatcctgctcacccagagcccggtgatcctgtcggtcagccccggcgagcgggtgagcttcagctgccgcgccagccagtcgatcgggacgaacatccactggtaccagcagcggaccaacggcagcccccgcctgctcatcaagtacgcgagcgagagcatcagcgggatcccctcgcggttcagcggcagcgggagcggcaccgacttcaccctgagcatcaacagcgtggagtcggaggacatcgccgactactactgccagcagaacaacaactggccgacgaccttcggcgccgggaccaagctggagctcaagcgcaccgtcgccgcgcccagcgtgttcatcttcccgcccagcgacgagcagctgaagagcggcacggccagcgtggtctgcctgctcaacaacttctacccccgggaggccaaggtgcagtggaaggtggacaacgccctgcagtcggggaacagccaggagagcgtcaccgagcaggacagcaaggacagcacctacagcctgtcgagcaccctcacgctgagcaaggccgactacgagaagcacaaggtgtacgcgtgcgaggtgacccaccagggcctgagcagccccgtcaccaagtcgttcaaccgcggcgcctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61245 - protein, 457 aa, synthetic construct
  REGION 1..457: note = Protein (HC) w/o signal peptide encoded by mRNA R1965, R2999, R3012
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61246 - protein, 451 aa, synthetic construct; identical to SEQ ID NO: 888
  REGION 1..451: note = Protein (HC) w/o signal peptide & his-tag encoded by mRNA R1965, R2999, R3012

SEQ ID NO: 61247 - protein, 214 aa, synthetic construct; identical to SEQ ID NO: 742
  REGION 1..214: note = Protein (LC) w/o signal peptide encoded by mRNA R1965, R2999, R3012

SEQ ID NO: 61248 - RNA, 1371 nt, synthetic construct
  misc_feature 1..1371: note = CDS (HC) w/o signal peptide encoded by mRNA R1965, R2999, R3012
  source 1..1371: mol_type = other RNA
gaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcat

SEQ ID NO: 61249 - RNA, 1353 nt, synthetic construct
  misc_feature 1..1353: note = CDS (HC) w/o signal peptide & his-tag encoded by mRNA R1965, R2999, R3012
  source 1..1353: mol_type = other RNA
gaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaag

SEQ ID NO: 61250 - RNA, 642 nt, synthetic construct
  misc_feature 1..642: note = CDS (LC) w/o signal peptide encoded by mRNA R1965, R2999, R3012
  source 1..642: mol_type = other RNA
gacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgc

SEQ ID NO: 61251 - RNA, 1371 nt, synthetic construct
  misc_feature 1..1371: note = derived and/or modified sequence opt2 from CDS (HC) w/o signal peptide encoded by mRNA R1965, R2999, R3012
  source 1..1371: mol_type = other RNA
gaggtccagctcgtcgagtccggcggcggcctcgtccagcccggcggctccctccgcctctcctgcgccgcctccggcttcaacatcaaggacacctacatccactgggtccgccaggcccccggcaagggcctcgagtgggtcgcccgcatctaccccaccaacggctacacccgctacgccgactccgtcaagggccgcttcaccatctccgccgacacctccaagaacaccgcctacctccagatgaactccctccgcgccgaggacaccgccgtctactactgctcccgctggggcggcgacggcttctacgccatggactactggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagccccccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagcaccaccaccaccaccac

SEQ ID NO: 61252 - RNA, 1353 nt, synthetic construct; identical to SEQ ID NO: 16172
  misc_feature 1..1353: note = derived and/or modified sequence opt2 from CDS (HC) w/o signal peptide & his-tag encoded by mRNA R1965, R2999, R3012
  source 1..1353: mol_type = other RNA

SEQ ID NO: 61253 - RNA, 642 nt, synthetic construct; identical to SEQ ID NO: 16026
  misc_feature 1..642: note = derived and/or modified sequence opt2 from CDS (LC) w/o signal peptide encoded by mRNA R1965, R2999, R3012
  source 1..642: mol_type = other RNA

SEQ ID NO: 61254 - RNA, 1371 nt, synthetic construct
  misc_feature 1..1371: note = derived and/or modified sequence opt3 from CDS (HC) w/o signal peptide encoded by mRNA R1965, R2999, R3012
  source 1..1371: mol_type = other RNA
gaggtgcagctggtcgaaagcggcgggggactcgttcaacccggtggctcccttagactgtcttgcgccgcttcagggttcaacatcaaggacacctacattcactgggtgaggcaggcacctggaaaaggcttggagtgggtagcccggatatatccaacaaatggttacactcgctatgcggatagtgtgaaggggcgatttacgatcagcgctgacacctccaaaaacacagcctacttacagatgaatagcctgcgtgcagaagatactgccgtctattactgttcgagatggggaggcgacggcttctatgctatggattactgggggcagggaaccctagtgacagtttcaagcgcaagtaccaagggtccgtccgtgtttcccctcgccccttctagcaaatccacttcaggcgggacagctgccctgggatgccttgtcaaggactacttcccagagcccgtgaccgtaagttggaacagcggcgcgctgacgtctggtgttcatacttttcctgcagtgttgcaatcctcagggctctatagcctgagttctgtcgtgaccgtgccatccagctcgctgggaacacagacttacatttgtaatgtcaaccacaagccctctaataccaaagttgataagaaagtggaacctccaaagtcctgcgacaaaacacatacctgtccgccctgccctgccccagagctcttaggcggcccctcagtattcctgtttcctccaaagcccaaggatacgcttatgatcagtaggactccggaggtgacatgtgtcgtggttgacgtgagccacgaagatcctgaggtcaaattcaactggtatgtggacggggtagaagttcataatgctaagaccaaaccccgggaggagcagtacaactccacttatcgcgtggtctctgtgttgacagtcctgcaccaggattggctaaatggaaaggaatacaaatgcaaggtgagcaacaaagccctcccagcacctattgagaagaccatctcaaaggctaaaggtcaacccagagaaccacaggtttatacgctgccccctagtagggacgagcttaccaagaatcaggtgtccctgacatgtttggtaaaaggcttttacccaagcgacatagccgtcgaatgggagtctaacgggcagccggagaataactacaagactacaccccctgtgctcgattcagacggaagtttctttctgtatagcaaattaaccgttgataagtcccggtggcaacagggcaacgtgttctcttgctcggtcatgcacgaagcgctgcataatcactacactcagaagtctctctccctttcaccaggtaaacatcaccaccatcaccat

SEQ ID NO: 61255 - RNA, 1353 nt, synthetic construct; identical to SEQ ID NO: 23814
  misc_feature 1..1353: note = derived and/or modified sequence opt3 from CDS (HC) w/o signal peptide & his-tag encoded by mRNA R1965, R2999, R3012
  source 1..1353: mol_type = other RNA

SEQ ID NO: 61256 - RNA, 642 nt, synthetic construct; identical to SEQ ID NO: 23668
  misc_feature 1..642: note = derived and/or modified sequence opt3 from CDS (LC) w/o signal peptide encoded by mRNA R1965, R2999, R3012
  source 1..642: mol_type = other RNA

SEQ ID NO: 61257 - RNA, 1371 nt, synthetic construct
  misc_feature 1..1371: note = derived and/or modified sequence opt4 from CDS (HC) w/o signal peptide encoded by mRNA R1965, R2999, R3012
  source 1..1371: mol_type = other RNA
gaggtgcagctggtggagagcggcggcggcctggtgcagcccggcggcagcctgagactgagctgcgccgccagcggcttcaacatcaaggacacctacatccactgggtgagacaggcccccggcaagggcctggagtgggtggccagaatctaccccaccaacggctacaccagatacgccgacagcgtgaagggcagattcaccatcagcgccgacaccagcaagaacaccgcctacctgcagatgaacagcctgagagccgaggacaccgccgtgtactactgcagcagatggggcggcgacggcttctacgccatggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccccccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagcaccaccaccaccaccac

SEQ ID NO: 61258 - RNA, 1353 nt, synthetic construct; identical to SEQ ID NO: 31456
  misc_feature 1..1353: note = derived and/or modified sequence opt4 from CDS (HC) w/o signal peptide & his-tag encoded by mRNA R1965, R2999, R3012
  source 1..1353: mol_type = other RNA

SEQ ID NO: 61259 - RNA, 642 nt, synthetic construct; identical to SEQ ID NO: 31310
  misc_feature 1..642: note = derived and/or modified sequence opt4 from CDS (LC) w/o signal peptide encoded by mRNA R1965, R2999, R3012
  source 1..642: mol_type = other RNA

SEQ ID NO: 61260 - RNA, 1371 nt, synthetic construct
  misc_feature 1..1371: note = derived and/or modified sequence opt5 from CDS (HC) w/o signal peptide encoded by mRNA R1965, R2999, R3012
  source 1..1371: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacctcccaagtcttgcgacaaaacacatacctgtcctccctgcccggcccctgagctcctgggcgggcccagcgtgttcctttttcctcccaagcccaaggataccctgatgatttcccggacacctgaggttacgtgtgtggtcgtggacgtttctcacgaagatccggaggtgaaattcaactggtatgtcgacggagtggaagtccataatgcgaagaccaaaccccgcgaggagcagtacaacagcacatatagagtggtttccgtgctcaccgtcctgcaccaggattggctgaatggcaaggaatacaaatgcaaggtgagcaacaaagccctccctgctcccatcgagaagacaatctctaaggccaaagggcaacctcgggaaccccaggtttataccctgccgccttcccgcgacgagcttacgaagaatcaggtgagcctgacatgtctcgtcaaaggattttacccctctgacattgctgtggaatgggagtccaacggccagcctgagaataactacaagaccacaccccctgtgctggatagcgacggctccttctttctttattctaaactgaccgttgataagagcagatggcaacaggggaacgtcttctcctgctctgtgatgcacgaagccctccataatcactacacccaaaagagcctgtccctgagccccggaaaacatcaccaccatcaccat

SEQ ID NO: 61261 - RNA, 1353 nt, synthetic construct; identical to SEQ ID NO: 39098
  misc_feature 1..1353: note = derived and/or modified sequence opt5 from CDS (HC) w/o signal peptide & his-tag encoded by mRNA R1965, R2999, R3012
  source 1..1353: mol_type = other RNA

SEQ ID NO: 61262 - RNA, 642 nt, synthetic construct; identical to SEQ ID NO: 38952
  misc_feature 1..642: note = derived and/or modified sequence opt5 from CDS (LC) w/o signal peptide encoded by mRNA R1965, R2999, R3012
  source 1..642: mol_type = other RNA

SEQ ID NO: 61263 - RNA, 1371 nt, synthetic construct
  misc_feature 1..1371: note = derived and/or modified sequence opt6 from CDS (HC) w/o signal peptide encoded by mRNA R1965, R2999, R3012
  source 1..1371: mol_type = other RNA
gaagtccaattagtagaatcaggaggtggattagtccaaccaggaggatctctacgattatcttgtgctgcaagcggattcaatataaaagatacatatatccactgggtaagacaagcaccaggaaaaggtttagaatgggtagcaagaatatatcctaccaatggatatacacgatacgcagactctgttaaaggacgattcacaatatcagcagatacatctaaaaatacagcatacctacaaatgaactccctaagagctgaagacacagcagtttactattgctcacgctggggtggtgacggattctatgcaatggactattggggtcaaggaacactagtaacagtctcctcagcatcaacaaaaggaccttcagtattcccactagcaccatcatcaaaatcaacatccggaggaacagctgcattaggatgcttagtaaaagattactttccagagccagtaacagtatcatggaactcaggagcgctaacatctggtgtacacacatttccagcagtactacaatcttcaggactatactccctatcctctgtagtcacagtaccatcatcttctctaggtacacaaacatacatatgtaacgttaaccacaaacccagcaacacaaaagtcgataaaaaagttgaaccacctaaatcatgcgataaaacacacacatgcccaccatgccccgcaccagaactcttaggaggaccatcagtattcctatttccccctaaaccaaaagatacattaatgatatcaagaaccccagaagtcacatgcgttgttgtagatgtaagtcacgaagacccagaagttaaatttaactggtatgtagacggagtagaagtacataacgctaaaacaaaacctagagaagaacaatataatagcacataccgcgtagtttcagtcttaacagtactacaccaagactggttaaatggaaaagaatataaatgcaaagtaagcaataaagcattacctgcaccaatagaaaaaacaatatctaaagcaaaaggacaaccaagagaaccacaagtctacacactaccaccatcaagagacgaactaactaaaaaccaagtttccctaacttgtctagtcaaaggattttatccttcagacattgcggtagaatgggaaagtaacggacaacctgaaaataattataaaacaacaccaccagtactcgacagtgatggatctttttttctatattccaaattaactgtagataaatcaagatggcaacaaggaaatgtattctcatgttcagtaatgcatgaagcattacacaatcattacacacaaaaatcattatccttaagccccggaaaacaccaccaccatcaccat

SEQ ID NO: 61264 - RNA, 1353 nt, synthetic construct
  misc_feature 1..1353: note = derived and/or modified sequence opt6 from CDS (HC) w/o signal peptide & his-tag encoded by mRNA R1965, R2999, R3012
  source 1..1353: mol_type = other RNA
gaagtacaactagtagaatcaggaggcggattagttcaacccggaggaagcctaagattatcatgcgccgcttccggatttaatataaaagatacatatatccattgggtaagacaagcacctggaaaaggattagaatgggtagcacgaatataccctacaaacggatatacgcgttatgcagactcagtaaaaggaagatttacaatatcagcagacacaagtaaaaatacagcctatcttcaaatgaactccttaagagcagaagacaccgctgtctactattgcagcagatggggaggagatggattctatgccatggactattggggtcaaggaacactagtaacagtatcatcagcttcaacaaaaggaccatcagtattcccattagcaccgtcctcaaagtcaacaagcggtggaacagcagcacttggatgcctagtaaaagattactttccagaaccagtaacagtaagttggaacagcggagccttaacatccggtgtacatacttttccagctgtcctacaatcgtcaggactatattcattatcttcagttgtaacagtaccatcatcatcactagggacccaaacctatatatgtaatgtaaaccataaaccatctaatacaaaagtcgataaaaaagtagaaccacctaaatcctgtgataaaactcacacatgcccaccatgtcctgcaccagaactactaggaggtccatcagtatttttattcccaccaaaacctaaagacacccttatgatatcaagaacaccagaagtaacatgtgtagttgtcgacgtatcacatgaagacccagaagtaaaatttaactggtatgttgacggagtagaagtacacaatgcaaaaacaaaaccacgtgaagaacaatacaattcaacatacagagttgtatcagtattaaccgtcctacatcaagactggctaaacggaaaagaatacaaatgtaaagtatcaaacaaagcactaccagcaccaatagaaaaaacaatatcaaaagccaaaggacaaccaagagaaccacaagtatacacactaccaccatctagagacgaattaactaaaaatcaagtatctctaacatgtctagttaaaggtttctatcccagtgacatagcagttgaatgggaatcaaacggacaaccagaaaacaattataaaacaacacccccagtactagattctgatggctcttttttcttatattcaaaactaactgtagataaatcaagatggcaacaaggcaatgtcttttcatgttcagttatgcacgaagccctacataatcactatactcaaaaatcattatcactaagccccggcaaa

SEQ ID NO: 61265 - RNA, 642 nt, synthetic construct
  misc_feature 1..642: note = derived and/or modified sequence opt6 from CDS (LC) w/o signal peptide encoded by mRNA R1965, R2999, R3012
  source 1..642: mol_type = other RNA
gacatacaaatgacacaatcaccatcatcattaagcgcatcagtaggagacagagtaacaataacatgcagagcatcccaagacgtaaacacagctgtagcatggtaccaacaaaaaccaggaaaagcacccaaactattaatatacagcgcatccttcctatactcaggagtaccatcaagattctcaggatcaagatcaggcacagacttcacactaacaatatcctcactacaaccagaagacttcgcaacatactactgccaacaacattacacaactccacccacattcggacaaggaacaaaagtagaaatcaaaagaacagtagcagcaccatcagtattcatattcccaccatcagacgaacaactaaaatcaggaactgcatcagtagtatgcttactaaacaacttctacccaagagaagcaaaagtacaatggaaagtagacaacgcactccaaagcggaaactcacaagaatcagtaacagaacaagactcaaaagactccacatactccctatcctcaacactaacactaagcaaagcagactacgaaaaacataaagtatacgcatgcgaagtaacccaccaaggattaagctcaccagtaacaaaatcattcaacagaggagaatgc

SEQ ID NO: 61266 - RNA, 1371 nt, synthetic construct
  misc_feature 1..1371: note = derived and/or modified sequence opt11 from CDS (HC) w/o signal peptide encoded by mRNA R1965, R2999, R3012
  source 1..1371: mol_type = other RNA
gaagtccaactcgtcgagagcggcggaggcctcgtccaacccggcggcagcctgcgcctctcctgcgccgcatccggattcaacatcaaagacacctacatccactgggtccgacaagcccccggcaaaggcctcgaatgggtcgcccgaatataccccaccaacggatatacacgctatgccgacagcgtcaaaggccgcttcaccatctccgcggacacctccaaaaacaccgcctacctccaaatgaactcactacgcgcagaagacaccgccgtatactactgctcaagatggggcggcgacggattctacgcaatggactactggggccaaggcacccttgttacagtctcctcagcatctaccaaaggcccctctgtcttcccccttgcaccatccagcaaatcaaccagcggaggcaccgccgccctaggctgcctagttaaagactacttccccgaacccgtcacggtctcctggaactccggtgccctcacctcgggcgtccacacatttccagcagtgctccaatcctcaggcctctactccctatcaagcgtcgtaactgtccccagctcatctctcggaacccaaacatacatctgcaacgtaaaccacaaaccctccaacacaaaagtagacaagaaagtcgaaccgcccaaatcatgcgacaaaacccacacctgtcctccctgccccgcacccgaactcctaggcggcccctccgtattcctattcccaccaaagccaaaagacaccctaatgatctcccgcacacccgaagtaacatgcgtcgtagtggacgtctcccacgaagaccccgaggtcaaattcaactggtacgtcgacggcgtcgaagtccataatgcaaagaccaaaccacgagaagaacaatacaactcaacctaccgcgtagtctcagtactcaccgtcctacaccaagactggctcaacggtaaagaatacaaatgcaaagtctcgaacaaagcactcccagcccccatcgagaaaaccatatcaaaggccaaaggccaaccccgcgaaccacaagtctacaccctacccccatcccgcgacgaactcaccaaaaatcaagtctcactaacatgcctcgtcaaaggcttctacccctctgacatcgccgtcgaatgggaatccaacggacagcccgaaaacaactacaaaaccacccctcccgtcctcgactcagacggctcctttttcctctattccaaactcaccgtcgacaaatccagatggcaacaaggcaacgtattctcctgctccgtcatgcacgaagccctacacaaccactacacccagaagtcactctcactctcacccggaaaacaccaccaccaccaccac

SEQ ID NO: 61267 - RNA, 1353 nt, synthetic construct
  misc_feature 1..1353: note = derived and/or modified sequence opt11 from CDS (HC) w/o signal peptide & his-tag encoded by mRNA R1965, R2999, R3012
  source 1..1353: mol_type = other RNA
gaagtccagctcgtagaatccggaggcggcctcgtacaacccggtggatcactacgcctctcatgtgccgcctcaggcttcaacatcaaagacacatacatccactgggtccgccaagcccccggaaaaggtcttgaatgggtcgcccgcatctaccccaccaacggatacacccgctacgccgactccgtaaaaggccgcttcacaatttcagcagacacctccaaaaacacagcttacctccaaatgaactccctacgcgccgaagacaccgcagtctactactgctcccgctggggcggcgacggcttctacgcaatggattactggggccaaggtaccctagtcacagtcagcagcgcatccaccaaaggtccatcagtcttccccctcgccccctcctccaaatctacatccggaggaacagccgccctaggctgcctagtcaaagactacttcccggaacccgtcacagtttcctggaactccggagcactaacctccggcgtccacacctttccagccgtactccagtcctccggcctctactccctatcttcagtcgtaaccgtcccctcctcttcactcggcacccaaacctacatctgcaacgtcaaccacaaaccctccaacaccaaagtagataagaaagtggaaccgccaaaatcctgcgacaaaacccacacttgccctccctgccccgcccccgaattactcggaggcccctccgtcttcctattcccacccaaacccaaagacaccctcatgatctcccgcactcccgaagtaacctgcgtcgtcgtcgacgtcagccacgaagacccagaagtcaaattcaactggtacgttgacggcgtagaagtacacaacgcaaaaaccaaaccccgcgaagaacaatacaactccacctacagagttgtaagcgtactcaccgtactgcaccaagactggctcaacggcaaggaatacaaatgcaaagtctcgaacaaagctctccccgccccaatcgagaaaaccatctccaaagctaaaggccaaccaagagaaccccaagtctatacactacccccttcccgcgacgagctcaccaaaaaccaagtctccctcacctgtctcgtcaaaggtttctacccatccgacatagcagtggaatgggaatccaacggacaacccgagaacaactacaaaaccaccccacccgttctcgacagtgacggctccttcttcctctactcgaagctaacagtagacaaatcccgatggcaacaaggcaacgtcttctcctgctccgtaatgcacgaagcactccacaaccactacacacaaaaatccctctccctctcccccggcaaa

SEQ ID NO: 61268 - RNA, 642 nt, synthetic construct
  misc_feature 1..642: note = derived and/or modified sequence opt11 from CDS (LC) w/o signal peptide encoded by mRNA R1965, R2999, R3012
  source 1..642: mol_type = other RNA
gacatacaaatgacccaatccccctcctccctctccgcctccgtcggcgaccgcgtcaccatcacctgccgcgcctcccaagacgtcaacacagccgtcgcctggtaccaacaaaaacccggaaaagcccccaaactactaatctactccgcctccttcctctactccggcgtcccctcccgcttctccggctcacgctctggcaccgacttcaccctcaccatctcctccctccaaccagaagacttcgccacttactactgccaacaacactacaccaccccccccaccttcggacaaggcaccaaagtcgaaatcaaacgcaccgtcgccgccccctccgtcttcatcttccccccctccgacgaacaactcaaatcaggcaccgcctcagtcgtctgcctactcaataacttctacccccgcgaagccaaagtccaatggaaagtcgacaacgccctccaatccggcaactcccaagaatccgtcaccgaacaagactccaaagactccacctactccctctcctccaccctaaccctcagcaaagccgactacgaaaaacacaaagtctacgcctgcgaagtcacccaccaaggactatcctcccccgtcaccaaatcattcaaccgaggcgaatgc

SEQ ID NO: 61269 - protein, 476 aa, synthetic construct
  REGION 1..476: note = Protein 1 (HC) w/o his-tag encoded by mRNA R1965, R2999, R3012
MAVMAPRTLVLLLSGALALTQTWAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61270 - protein, 482 aa, synthetic construct
  REGION 1..482: note = Protein 1 (HC) encoded by mRNA R1965, R2999, R3012
MAVMAPRTLVLLLSGALALTQTWAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61271 - protein, 239 aa, synthetic construct
  REGION 1..239: note = Protein 2 (LC) encoded by mRNA R1965, R2999, R3012
MAVMAPRTLVLLLSGALALTQTWAGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61272 - RNA, 1431 nt, synthetic construct
  misc_feature 1..1431: note = CDS 1 (HC) w/o his-tag as RNA from mRNA R1965, R2999, R3012
  source 1..1431: mol_type = other RNA
atggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagtga

SEQ ID NO: 61273 - RNA, 1449 nt, synthetic construct
  misc_feature 1..1449: note = CDS 1 (HC) as RNA from mRNA R1965, R2999, R3012
  source 1..1449: mol_type = other RNA
atggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattga

SEQ ID NO: 61274 - RNA, 720 nt, synthetic construct
  misc_feature 1..720: note = CDS 2 (LC) as RNA from mRNA R1965, R2999, R3012
  source 1..720: mol_type = other RNA
atggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctga

SEQ ID NO: 61275 - RNA, 2848 nt, synthetic construct
  misc_feature 1..2848: note = CDS (HC)-IRES-CDS (LC) as RNA from mRNA R1965, R2999, R3012
  source 1..2848: mol_type = other RNA
atggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctga

SEQ ID NO: 61276 - RNA, 3040 nt, synthetic construct
  misc_feature 1..3040: note = R1965
  source 1..3040: mol_type = other RNA
gggagaaagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61277 - RNA, 3052 nt, synthetic construct
  misc_feature 1..3052: note = R2999
  source 1..3052: mol_type = other RNA
gggagaaagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61278 - RNA, 3230 nt, synthetic construct
  misc_feature 1..3230: note = R3012
  source 1..3230: mol_type = other RNA
ggggcgctgcctacggaggtggcagccatctccttctcggcatcaagcttaccatggccgtgatggcgccgcggaccctggtcctcctgctgagcggcgccctcgccctgacgcagacctgggccggggaggtgcagctggtcgagagcggcgggggcctcgtgcagccgggcgggtcgctgcggctgagctgcgccgcgagcgggttcaacatcaaggacacctacatccactgggtgcgccaggcccccggcaagggcctcgagtgggtcgcccggatctaccccacgaacgggtacacccgctacgccgacagcgtgaagggccggttcaccatcagcgcggacacctcgaagaacacggcctacctgcagatgaacagcctgcgcgccgaggacaccgccgtgtactactgcagccggtggggcggcgacgggttctacgccatggactactgggggcagggcaccctcgtcaccgtgagcagcgcgtcgacgaaggggcccagcgtgttcccgctggcccccagcagcaagagcaccagcggcgggaccgccgccctgggctgcctcgtcaaggactacttccccgagcccgtgaccgtgtcgtggaacagcggcgcgctgacgagcggggtccacaccttcccggccgtgctgcagagcagcggcctctactcgctgagcagcgtggtcaccgtgcccagcagcagcctggggacccagacgtacatctgcaacgtgaaccacaagccctcgaacaccaaggtcgacaagaaggtggagcccccgaagagctgcgacaagacccacacctgcccgccctgccccgcccccgagctcctgggcgggcccagcgtgttcctgttcccgcccaagcccaaggacacgctcatgatcagccgcacccccgaggtcacctgcgtggtggtcgacgtgagccacgaggaccccgaggtgaagttcaactggtacgtcgacggcgtggaggtgcacaacgccaagaccaagccgcgggaggagcagtacaactcgacgtaccgcgtcgtgagcgtgctgaccgtcctgcaccaggactggctcaacggcaaggagtacaagtgcaaggtgagcaacaaggccctgcccgcgcccatcgagaagaccatcagcaaggccaaggggcagccccgggagccgcaggtgtacaccctgccccccagccgcgacgagctcacgaagaaccaggtcagcctgacctgcctggtgaagggcttctacccctcggacatcgccgtggagtgggagagcaacgggcagccggagaacaactacaagaccaccccgcccgtcctcgacagcgacggcagcttcttcctgtacagcaagctgacggtggacaagtcgcggtggcagcagggcaacgtgttcagctgcagcgtcatgcacgaggccctccacaaccactacacccagaagagcctgagcctgagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagatgacccagagcccgtcgagcctgagcgccagcgtgggcgaccgggtcacgatcacctgccgcgcgagccaggacgtgaacaccgccgtggcctggtaccagcagaagcccgggaaggcccccaagctcctgatctactcggcgagcttcctgtacagcggcgtccccagccggttcagcgggtcgcgcagcggcaccgacttcacgctcaccatcagcagcctgcagccggaggacttcgccacctactactgccagcagcactacaccacgccccccaccttcgggcagggcaccaaggtggagatcaagcggaccgtggccgcccccagcgtcttcatcttcccgcccagcgacgagcagctgaagtcgggcacggccagcgtggtgtgcctcctgaacaacttctacccccgcgaggcgaaggtccagtggaaggtggacaacgccctgcagagcgggaacagccaggagagcgtgaccgagcaggactcgaaggacagcacctacagcctcagcagcaccctgacgctgagcaaggccgactacgagaagcacaaggtctacgcctgcgaggtgacccaccaggggctctcgagccccgtgaccaagagcttcaaccggggcgagtgctgaccactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61279 - protein, 453 aa, synthetic construct
  REGION 1..453: note = Protein (HC) w/o signal peptide encoded by mRNA R3001, R3484
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61280 - protein, 447 aa, synthetic construct; identical to SEQ ID NO: 877
  REGION 1..447: note = Protein (HC) w/o signal peptide & his-tag encoded by mRNA R3001, R3484

SEQ ID NO: 61281 - protein, 210 aa, synthetic construct; identical to SEQ ID NO: 878
  REGION 1..210: note = Protein (LC) w/o signal peptide encoded by mRNA R3001, R3484

SEQ ID NO: 61282 - RNA, 1359 nt, synthetic construct
  misc_feature 1..1359: note = CDS (HC) w/o signal peptide encoded by mRNA R3001, R3484
  source 1..1359: mol_type = other RNA
caggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcat

SEQ ID NO: 61283 - RNA, 1341 nt, synthetic construct
  misc_feature 1..1341: note = CDS (HC) w/o signal peptide & his-tag encoded by mRNA R3001, R3484
  source 1..1341: mol_type = other RNA
caggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaag

SEQ ID NO: 61284 - RNA, 630 nt, synthetic construct
  misc_feature 1..630: note = CDS (LC) w/o signal peptide encoded by mRNA R3001, R3484
  source 1..630: mol_type = other RNA
cagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgc

SEQ ID NO: 61285 - RNA, 1359 nt, synthetic construct
  misc_feature 1..1359: note = derived and/or modified sequence opt2 from CDS (HC) w/o signal peptide encoded by mRNA R3001, R3484
  source 1..1359: mol_type = other RNA
caggcctacctccagcagtccggcgccgagctcgtccgccccggcgcctccgtcaagatgtcctgcaaggcctccggctacaccttcacctcctacaacatgcactgggtcaagcagaccccccgccagggcctcgagtggatcggcgccatctaccccggcaacggcgacacctcctacaaccagaagttcaagggcaaggccaccctcaccgtcgacaagtcctcctccaccgcctacatgcagctctcctccctcacctccgaggactccgccgtctacttctgcgcccgcgtcgtctactactccaactcctactggtacttcgacgtctggggcaccggcaccaccgtcaccgtctccggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggccgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaagcaccaccaccaccaccac

SEQ ID NO: 61286 - RNA, 1341 nt, synthetic construct; identical to SEQ ID NO: 16161
  misc_feature 1..1341: note = derived and/or modified sequence opt2 from CDS (HC) w/o signal peptide & his-tag encoded by mRNA R3001, R3484
  source 1..1341: mol_type = other RNA

SEQ ID NO: 61287 - RNA, 630 nt, synthetic construct; identical to SEQ ID NO: 16162
  misc_feature 1..630: note = derived and/or modified sequence opt2 from CDS (LC) w/o signal peptide encoded by mRNA R3001, R3484
  source 1..630: mol_type = other RNA

SEQ ID NO: 61288 - RNA, 1359 nt, synthetic construct
  misc_feature 1..1359: note = derived and/or modified sequence opt3 from CDS (HC) w/o signal peptide encoded by mRNA R3001, R3484
  source 1..1359: mol_type = other RNA
caggcctacctgcaacagagcggcgctgagctcgtgagacccggggcatccgtcaagatgtcttgcaaagcctcaggatataccttcacaagttacaacatgcactgggttaagcagactcctaggcagggtcttgaatggatcggcgcgatttatccagggaatggagacacgagctacaaccaaaaatttaagggcaaagctaccctgacagtggataagtcctcttcgactgcctatatgcagttgagctcattaaccagtgaggactccgcagtatacttctgtgcccgggtggtctattactctaatagctactggtattttgatgtgtggggtacagggaccactgttacagtgtccggaccgtcagtcttccccctggctcctagtagcaagtctacctccggcggcacggcagccctagggtgcctcgtgaaagactactttccagaacccgtaactgtttcatggaacagcggagctctgaccagtggtgtgcatacattccctgccgtccttcagtcttccggcctgtatagcttgtcgtctgtggtgactgtcccatcctcaagtctcgggacccagacatacatatgtaatgttaaccacaagcccagcaataccaaagtggataagaaagcggagcctaagtcctgcgacaagacgcatacttgtccaccgtgccccgcacctgaactgctgggaggcccatctgtatttctctttccccctaaaccaaaggatacattaatgatcagccgcacccccgaggtgacttgtgtcgtggttgacgtgtcacacgaggatccggaagtcaaattcaactggtatgtggacggtgtagaggttcataatgccaagacaaaacctcgagaagaacaatacaacagtacctatcgtgtggtctccgtgctgacggtccttcaccaggattggttgaatgggaaggagtacaaatgcaaggtgagcaacaaggctctgcccgccccaattgagaaaaccatctctaaggcaaaaggacagcctagagagccccaggtttacacactaccaccctcaagggacgaactcactaagaatcaagtgagtctgacctgtcttgtaaaaggcttctatcctagcgatattgctgtcgagtgggaatccaacggccagccagagaataactacaagacaactccgcccgtgctggactctgacgggtcgtttttcttgtatagcaagctcaccgttgataaatcccggtggcagcaaggaaacgtgttttcatgcagtgtcatgcacgaggccctgcataatcactacacacagaagtctttaagcctgtcccctggtaaacatcaccaccatcaccat

SEQ ID NO: 61289 - RNA, 1341 nt, synthetic construct; identical to SEQ ID NO: 23803
  misc_feature 1..1341: note = derived and/or modified sequence opt3 from CDS (HC) w/o signal peptide & his-tag encoded by mRNA R3001, R3484
  source 1..1341: mol_type = other RNA

SEQ ID NO: 61290 - RNA, 630 nt, synthetic construct; identical to SEQ ID NO: 23804
  misc_feature 1..630: note = derived and/or modified sequence opt3 from CDS (LC) w/o signal peptide encoded by mRNA R3001, R3484
  source 1..630: mol_type = other RNA

SEQ ID NO: 61291 - RNA, 1359 nt, synthetic construct
  misc_feature 1..1359: note = derived and/or modified sequence opt4 from CDS (HC) w/o signal peptide encoded by mRNA R3001, R3484
  source 1..1359: mol_type = other RNA
caggcctacctgcagcagagcggcgccgagctggtgagacccggcgccagcgtgaagatgagctgcaaggccagcggctacaccttcaccagctacaacatgcactgggtgaagcagacccccagacagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagagtggtgtactacagcaacagctactggtacttcgacgtgtggggcaccggcaccaccgtgaccgtgagcggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggccgagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaagcaccaccaccaccaccac

SEQ ID NO: 61292 - RNA, 1341 nt, synthetic construct; identical to SEQ ID NO: 31445
  misc_feature 1..1341: note = derived and/or modified sequence opt4 from CDS (HC) w/o signal peptide & his-tag encoded by mRNA R3001, R3484
  source 1..1341: mol_type = other RNA

SEQ ID NO: 61293 - RNA, 630 nt, synthetic construct; identical to SEQ ID NO: 31446
  misc_feature 1..630: note = derived and/or modified sequence opt4 from CDS (LC) w/o signal peptide encoded by mRNA R3001, R3484
  source 1..630: mol_type = other RNA

SEQ ID NO: 61294 - RNA, 1359 nt, synthetic construct
  misc_feature 1..1359: note = derived and/or modified sequence opt5 from CDS (HC) w/o signal peptide encoded by mRNA R3001, R3484
  source 1..1359: mol_type = other RNA
caggcttacctgcaacagagcggcgctgagctcgtgagacccggggcctccgtcaagatgtcttgcaaagcgagcggatataccttcacatcctacaacatgcactgggttaagcagacgcctcggcagggcctggaatggatcggggctatttatccgggaaatggcgacacctcttacaaccaaaaatttaaggggaaagccacacttaccgtggataagagctcctctacagcctatatgcagctgagctccctcaccagcgaggactctgctgtgtacttctgtgcccgcgtcgtgtattactccaatagctactggtattttgatgtttggggaacaggcaccacggtgaccgtctctggcccctccgtgttccctctggctcccagctctaagtccacaagcgggggaaccgccgcgcttggctgcctggttaaagactactttcctgaacccgtgacagtctcctggaactctggggccctcaccagcggagtgcatacgttccctgctgtgctgcagtccagcggcctgtattctctctccagcgtcgttacagtgccgtctagctccctggggacccagacatacatctgtaatgtgaaccacaagccctctaataccaaagtcgataagaaagccgagcctaagagctgcgacaagacccatacatgtcccccttgccccgctccggaacttctgggaggcccttccgtgtttctctttccccctaaacccaaggatacgctgatgattagcagaacccccgaggttacatgtgtggtcgtggacgtttctcacgaggatcctgaagtgaaatttaactggtatgtcgacggcgtggaggtccataatgccaagaccaaaccgcgggaagaacaatacaactccacatatcgcgtggttagcgtgcttaccgtcctgcaccaggattggctcaatgggaaggagtacaaatgcaaggtgtctaacaaggcgctgcccgcccctatcgagaaaacgatttccaaggctaaaggacagcccagagagcctcaggtttacacactgcccccgagccgggacgaactcaccaagaatcaagtgtccctgacctgtcttgtcaaaggcttctatccttctgatatcgccgtggagtgggaaagcaacgggcagcccgagaataactacaagacaacccctcccgtgctggactccgacggatctttcttcctctatagcaagctgacagttgataaatcccgctggcagcaaggcaacgtctttagctgctctgtgatgcacgaggcccttcataatcactacacgcagaagtccctgagcctctctcctgggaaacatcaccaccatcaccat

SEQ ID NO: 61295 - RNA, 1341 nt, synthetic construct; identical to SEQ ID NO: 39087
  misc_feature 1..1341: note = derived and/or modified sequence opt5 from CDS (HC) w/o signal peptide & his-tag encoded by mRNA R3001, R3484
  source 1..1341: mol_type = other RNA

SEQ ID NO: 61296 - RNA, 630 nt, synthetic construct; identical to SEQ ID NO: 39088
  misc_feature 1..630: note = derived and/or modified sequence opt5 from CDS (LC) w/o signal peptide encoded by mRNA R3001, R3484
  source 1..630: mol_type = other RNA

SEQ ID NO: 61297 - RNA, 1359 nt, synthetic construct
  misc_feature 1..1359: note = derived and/or modified sequence opt6 from CDS (HC) w/o signal peptide encoded by mRNA R3001, R3484
  source 1..1359: mol_type = other RNA
caagcatacttacaacaatcaggagcagaattagtaagaccaggagcctcagtaaaaatgtcctgcaaagcatccggatatacattcacatcatacaacatgcactgggtcaaacaaactcctagacaaggcctagaatggataggagcaatctatccaggtaacggagatacatcctacaatcaaaaattcaaaggaaaagcaacactaacagttgacaaatcatcatctacagcttatatgcaactctcctcattaacatcagaagactccgcagtatacttctgcgcacgagtcgtttactactcaaattcctactggtacttcgacgtctggggaacaggcacaacagtaacagtctcaggaccatcagtatttcccttagcaccatcttcaaaatcaacatccggaggaactgccgcactcggatgcctagtaaaagactattttccagaaccagtaacagtctcctggaactcaggagcactaacatcaggagtacacacatttccagcagttttacaatcatccggactatattcattatcatccgtagtaacagtaccttcatcatcactaggaacacaaacatacatctgcaacgtaaaccataaaccatccaatacaaaagtagacaaaaaagcagaacctaaatcatgcgataaaacacacacatgtcccccatgcccagccccagaactactaggaggcccctcagtcttcctttttccaccaaaaccaaaagacactctaatgatctcacgaacaccagaagtaacatgcgtagtagtagacgtctcacacgaagatcccgaagtcaaatttaactggtacgtagacggagtagaagttcacaacgcaaaaacaaaaccaagagaagaacaatataactcaacatatagagtagtatcagtactaacagtactacaccaagactggctaaacggtaaagaatacaaatgtaaagtctcaaataaagcattaccagccccaatagaaaaaactatatcaaaagccaaaggtcaaccaagagaaccacaagtatatacattacctccatccagagatgaactaacaaaaaaccaagtatctcttacctgtctagtaaaaggtttttacccatcagatatagcagtagaatgggaatccaacggccaaccagaaaacaactacaaaacaaccccaccagtactagattccgacggatcattctttctttactcaaaacttaccgtagacaaatcaagatggcaacaaggaaacgtattctcatgctcagtaatgcatgaagccctacataatcattatacccaaaaatcactaagtctatcaccaggaaaacaccatcaccaccaccat

SEQ ID NO: 61298 - RNA, 1341 nt, synthetic construct
  misc_feature 1..1341: note = derived and/or modified sequence opt6 from CDS (HC) w/o signal peptide & his-tag encoded by mRNA R3001, R3484
  source 1..1341: mol_type = other RNA
caagcatatttacaacaatctggagccgaattagtaagaccaggagcctccgtcaaaatgagctgtaaagcatcaggatacacattcacatcatataacatgcattgggtcaaacaaactccaagacaaggactagaatggataggagcaatttatcctggtaacggagataccagctacaatcaaaaattcaaaggaaaagctactctaacagtagataaatcatcatcaacagcttacatgcaattatcatccctaacttcagaagactccgcagtatatttctgcgcaagagtagtatattactccaactcatactggtatttcgacgtatggggaaccggaacaactgtaacagtatccggcccttccgtctttcctctcgccccatcatcaaaatcaacatcaggaggaaccgcagcactaggctgtctagtaaaagactacttcccagaaccagtcacagtatcatggaactcaggtgcactaacctctggagtacacacctttccagcagtactacaatcatcaggactatattcattatcctcagttgtaactgtaccatcatcgtcactcggaacccaaacgtatatctgtaacgtaaaccacaaaccatcaaacaccaaagttgacaaaaaagcagaacctaaatcatgcgataaaacacatacttgcccaccatgcccagcaccagaacttctaggaggaccatccgtgttcctattcccaccaaaaccaaaagatacattaatgatatctcgaacccctgaagttacatgcgtagtagtagacgtatcacacgaagatccagaagttaaattcaactggtatgtagacggagtagaagtacacaatgccaaaacaaaaccaagagaagaacaatataactccacatatcgagtcgtatcagtcctaaccgtactacaccaagattggttaaacggaaaagaatacaaatgtaaagtatccaacaaagcactaccagcacctatagaaaaaacaatatcaaaagcaaaaggacaaccaagagaaccacaagtctataccctcccaccatcaagagacgaattaaccaaaaaccaagtttcattaacatgcctagttaaaggattctatccatccgatatagcagtcgaatgggaatccaacggacaaccagaaaacaattacaaaacaactccacccgtattagattcagacggatcattcttcctttactccaaactaacagtcgacaaatcaagatggcaacaaggaaatgtattctcttgttcagtaatgcacgaagccttacataaccactacacacaaaaatccctatcattatccccaggaaaa

SEQ ID NO: 61299 - RNA, 630 nt, synthetic construct
  misc_feature 1..630: note = derived and/or modified sequence opt6 from CDS (LC) w/o signal peptide encoded by mRNA R3001, R3484
  source 1..630: mol_type = other RNA
caaatagtattatcacaatcacccgcaatcctatcagcatcaccaggcgaaaaagtcacaatgacatgcagagcatcctcatcagtatcatacatgcattggtaccaacaaaaaccaggatcatcaccaaaaccatggatatacgcaccatccaacctagcatcaggagtaccagcaagattctcaggatcaggatcaggaacatcatactcactaacaatatcaagagtagaagccgaagacgcagcaacatactactgccaacaatggtcattcaacccaccaacattcggagcaggaacaaaactcgaactaaaaagaacagtagcagcaccatcagtattcatattcccaccctcagacgaacaactaaaatcaggaacagcatcagtagtatgcctactaaacaacttctacccaagagaagcaaaagtacaatggaaagtagacaacgcactacaatcaggaaactcccaagaatcagtaacagaacaagactcaaaagactcaacatactcattatcatctaccctaacactatcaaaagcagactacgaaaaacacaaagtatacgcttgcgaagtaacacaccaaggactctcctcaccagtaacaaaatcattcaacaga

SEQ ID NO: 61300 - RNA, 1359 nt, synthetic construct
  misc_feature 1..1359: note = derived and/or modified sequence opt11 from CDS (HC) w/o signal peptide encoded by mRNA R3001, R3484
  source 1..1359: mol_type = other RNA
caagcatacctccaacaatcaggcgcagaacttgttcgccccggcgcatccgtcaaaatgtcatgcaaagcctccggctacaccttcacctcctataacatgcactgggtcaaacaaacaccccgccaaggcctagaatggatcggcgcaatctaccccggcaacggcgatacctcgtacaatcaaaaattcaaaggcaaagccaccctcaccgttgacaagtcgagttcaaccgcctacatgcaactcagctccctcaccagcgaagactccgccgtctacttctgcgcaagagtcgtctactactctaactcctactggtacttcgatgtatggggcaccggtaccaccgtcaccgtctccggcccatcggtcttccccctcgcaccatcttcaaaatccacctcaggcggcacagccgccctagggtgcctcgtcaaagactacttccctgaaccagtaaccgtttcctggaactccggcgcactcacctctggcgttcacaccttccccgccgtcctacaatcctcaggcctctactccctctcgtccgtcgtcaccgtcccgtcatcctcactcggcacccaaacctacatctgcaacgtaaatcacaagccctcaaacaccaaagttgacaagaaagccgaaccaaaatcatgcgacaaaacccacacatgcccaccctgccccgcacccgagcttctaggcggcccctccgtcttcctcttcccacccaaacccaaagacaccctcatgatctcccgaacacccgaggtcacttgcgtagtcgtcgacgtctcccacgaagaccccgaagtaaaattcaactggtacgtcgacggcgtcgaagttcacaacgccaaaacaaaaccccgagaggaacagtacaacagcacatacagagtcgtctcagtcctaaccgttctccaccaagactggcttaacggcaaagaatacaaatgcaaagtctccaacaaagctctgcccgcccctatcgagaaaaccatctccaaagccaaaggccaaccccgcgaaccccaagtatacaccctaccaccctcccgcgacgaacttaccaaaaaccaagtatctcttacatgcctcgtcaaaggattctacccaagcgacatcgccgtagaatgggaatccaacggccaacccgagaacaactacaaaaccaccccacccgtcctagactccgacggatccttcttcctctacagcaaactcaccgtcgacaaatcacgctggcaacaaggcaacgtattctcctgctcagtaatgcacgaagcactccacaaccactacactcaaaaatcactctccctctcccccggcaaacaccaccaccaccaccac

SEQ ID NO: 61301 - RNA, 1341 nt, synthetic construct
  misc_feature 1..1341: note = derived and/or modified sequence opt11 from CDS (HC) w/o signal peptide & his-tag encoded by mRNA R3001, R3484
  source 1..1341: mol_type = other RNA
caagcctacctccaacaatccggagccgaactcgttcgacccggcgcctccgtaaaaatgtcctgcaaagcctccggctacaccttcacctcctacaacatgcactgggtcaaacaaacaccccgccaaggccttgaatggatcggcgccatataccccggcaacggggacacctcctacaaccaaaaattcaagggaaaggccacactcactgtcgataaatcctcatccaccgcctatatgcaactttcctccctcacctcagaagactccgccgtctacttctgcgcccgagtcgtctactactccaactcctactggtacttcgacgtttggggcactggaacaaccgtcaccgtatccggcccctccgtattcccactcgccccatcctccaaatccacctctggcggaaccgccgcactcggatgcctcgtcaaagactacttccccgaaccagtcaccgtctcctggaactcaggcgcactcacctccggcgtacacaccttccccgccgtccttcaatcctccggactctactccctctcaagcgtcgtcaccgtcccctcctcatcactaggcacccaaacatacatctgtaacgtaaaccacaaaccgagcaacaccaaagtcgacaagaaagctgagcccaaatcatgcgacaaaacccacacatgtcccccatgcccagcaccagaactcctaggcggcccgtccgtattcctattcccacccaaacccaaagacaccctcatgatctcccgcacccccgaagtaacctgcgtcgtcgtcgacgtctcccacgaggaccccgaggtcaaattcaactggtacgtcgacggcgtcgaagtccacaacgccaaaaccaaaccccgcgaggaacaatacaactccacatatcgtgtagtatccgtcctcaccgtcctccaccaagactggctcaacggcaaagaatacaaatgcaaagtatccaacaaagccctaccggccccaatcgagaaaacgatcagcaaagctaaaggacaaccccgagaaccccaagtttacactctgcccccatcacgcgacgaactcaccaaaaaccaagtctcactcacatgcctagtcaaaggcttctacccctcagacatcgccgtagaatgggaatccaacggccaaccagaaaacaactacaaaaccaccccacccgtcctcgactcagacggatccttcttcctctactccaaactaaccgtagacaaatcccgctggcaacaaggaaacgtattttcctgctcagtcatgcacgaagccttacataaccactacacccagaaaagcctctccctctcacccggaaaa

SEQ ID NO: 61302 - RNA, 630 nt, synthetic construct
  misc_feature 1..630: note = derived and/or modified sequence opt11 from CDS (LC) w/o signal peptide encoded by mRNA R3001, R3484
  source 1..630: mol_type = other RNA
caaatcgtcctctcccaatcccccgccatcctctccgcatcccccggcgaaaaagtcaccatgacctgccgcgcctcctcctccgtctcctacatgcactggtaccaacaaaaacccggctcctcccccaaaccctggatctacgccccctcaaacctcgcctccggcgtccccgcccgcttctccggctccggctccggcacctcctactccctcaccatctcacgcgtcgaagccgaagacgccgccacctactactgccaacaatggtcctttaacccccccaccttcggcgccggcaccaaactcgaactcaaacgcaccgtcgcagccccctccgtcttcatcttccccccctcagacgaacaactaaaatccggcaccgcctccgtcgtctgcctcctcaacaacttctacccccgagaagccaaagtccaatggaaagtcgacaacgccctccaatctggaaactcacaagaatccgtcaccgaacaagactccaaagactccacctactccctctcctccacactcaccctctccaaagccgactacgaaaaacacaaagtctatgcctgcgaagtcacacaccaaggcctctcatcccccgtcaccaaatcattcaaccgc

SEQ ID NO: 61303 - protein, 478 aa, synthetic construct
  REGION 1..478: note = Protein 1 (HC) encoded by mRNA R3001, R3484
MAVMAPRTLVLLLSGALALTQTWAGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 61304 - protein, 472 aa, synthetic construct
  REGION 1..472: note = Protein 1 (HC) w/o his-tag encoded by mRNA R3001, R3484
MAVMAPRTLVLLLSGALALTQTWAGQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61305 - protein, 235 aa, synthetic construct
  REGION 1..235: note = Protein 2 (LC) encoded by mRNA R3001, R3484
MAVMAPRTLVLLLSGALALTQTWAGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 61306 - RNA, 1437 nt, synthetic construct
  misc_feature 1..1437: note = CDS 1 (HC) as RNA from mRNA R3001, R3484
  source 1..1437: mol_type = other RNA
atggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattga

SEQ ID NO: 61307 - RNA, 1419 nt, synthetic construct
  misc_feature 1..1419: note = CDS 1 (HC) w/o his-tag as RNA from mRNA R3001, R3484
  source 1..1419: mol_type = other RNA
atggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagtga

SEQ ID NO: 61308 - RNA, 708 nt, synthetic construct
  misc_feature 1..708: note = CDS 2 (LC) as RNA from mRNA R3001, R3484
  source 1..708: mol_type = other RNA
atggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctga

SEQ ID NO: 61309 - RNA, 2824 nt, synthetic construct
  misc_feature 1..2824: note = CDS (HC)-IRES-CDS (LC) as RNA from mRNA R3001, R3484
  source 1..2824: mol_type = other RNA
atggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctga

SEQ ID NO: 61310 - RNA, 3028 nt, synthetic construct
  misc_feature 1..3028: note = R3001
  source 1..3028: mol_type = other RNA
gggagaaagcttaccatggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61311 - RNA, 3016 nt, synthetic construct
  misc_feature 1..3016: note = R3484
  source 1..3016: mol_type = other RNA
gggagaaagcttaccatggccgtgatggcgccgcggaccctggtcctcctgctgagcggcgccctcgccctgacgcagacctgggccgggcaggcctacctgcagcagagcggcgcggagctcgtgcggccgggggcctcggtcaagatgagctgcaaggccagcggctacaccttcacgagctacaacatgcactgggtgaagcagaccccgcgccaggggctggagtggatcggcgccatctaccccgggaacggcgacaccagctacaaccagaagttcaagggcaaggcgaccctgacggtggacaagtcgagcagcaccgcctacatgcagctcagcagcctgacctcggaggacagcgccgtctacttctgcgcccgggtggtgtactacagcaacagctactggtacttcgacgtctgggggaccggcacgaccgtgaccgtgagcgggcccagcgtcttccccctggccccctcgagcaagagcaccagcggcggcacggcggccctcgggtgcctggtgaaggactacttccccgagcccgtgaccgtcagctggaactcgggcgccctgaccagcggggtgcacaccttcccggccgtgctccagagcagcggcctgtacagcctgagctcggtcgtgacggtgcccagcagcagcctcgggacccagacctacatctgcaacgtcaaccacaagcccagcaacaccaaggtggacaagaaggcggagcccaagtcgtgcgacaagacgcacacctgcccgccctgccccgcccccgagctgctgggcggcccgagcgtgttcctcttcccgcccaagcccaaggacaccctgatgatcagccgcacccccgaggtcacgtgcgtggtggtcgacgtgagccacgaggaccccgaggtgaagttcaactggtacgtcgacggggtggaggtgcacaacgccaagaccaagccccgggaggagcagtacaacagcacctaccgcgtcgtgagcgtgctgaccgtcctccaccaggactggctgaacggcaaggagtacaagtgcaaggtgtcgaacaaggccctgccggcccccatcgagaagacgatcagcaaggcgaaggggcagccccgggagccccaggtgtacaccctcccgcccagccgcgacgagctgaccaagaaccaggtcagcctgacctgcctcgtgaagggcttctaccccagcgacatcgccgtggagtgggagtcgaacgggcagcccgagaacaactacaagacgaccccgcccgtcctggacagcgacggcagcttcttcctgtacagcaagctcaccgtggacaagagccggtggcagcagggcaacgtgttcagctgctcggtcatgcacgaggccctgcacaaccactacacccagaagagcctgagcctcagccccgggaagcatcatcatcatcatcattgaccatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccgggcagatcgtgctgagccagtcgccggccatcctcagcgcgagccccggcgagaaggtcaccatgacgtgccgggccagcagctcggtgagctacatgcactggtaccagcagaagcccgggagcagccccaagccgtggatctacgcccccagcaacctggcctcgggcgtgcccgcgcgcttcagcgggagcggcagcgggaccagctacagcctgaccatctcgcgggtcgaggccgaggacgccgccacctactactgccagcagtggagcttcaacccgcccacgttcggcgccggcaccaagctcgagctgaagcgcaccgtggcggcccccagcgtgttcatcttcccgcccagcgacgagcagctgaagagcgggaccgcctcggtcgtgtgcctcctgaacaacttctacccccgggaggccaaggtgcagtggaaggtcgacaacgcgctgcagagcggcaacagccaggagagcgtgacggagcaggacagcaaggacagcacctactcgctcagcagcaccctgaccctgagcaaggccgactacgagaagcacaaggtgtacgcctgcgaggtcacgcaccaggggctcagctcgcccgtgaccaagagcttcaaccgctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61312 - protein, 451 aa, synthetic construct; identical to SEQ ID NO: 766
  REGION 1..451: note = Protein (HC) w/o signal peptide encoded by mRNA R3917, R4128, R5910

SEQ ID NO: 61313 - RNA, 1353 nt, synthetic construct
  misc_feature 1..1353: note = CDS (HC) w/o signal peptide encoded by mRNA R3917, R4128, R5910
  source 1..1353: mol_type = other RNA
caggtgcagctgcagcagcccggggcggagctggtcaagccgggcgccagcgtgaagatgtcctgcaaggccagcgggtacaccttcacgtcctacaacatgcactgggtgaagcagacccccggccgggggctcgagtggatcggcgccatctaccccggcaacggggacaccagctacaaccagaagttcaagggcaaggccaccctgacggcggacaagtccagctccaccgcctacatgcagctgagctccctcaccagcgaggactccgccgtctactactgcgcccgcagcacctactacgggggcgactggtacttcaacgtgtggggcgcggggacgaccgtgaccgtctccgccgccagcaccaagggcccctccgtgttcccgctggcccccagctccaagagcacgagcgggggcaccgccgcgctggggtgcctcgtgaaggactacttccccgagcccgtcaccgtgtcctggaacagcggcgccctgacctccggcgtgcacacgttcccggccgtcctgcagagctccgggctctacagcctgtccagcgtggtgaccgtcccctccagctccctgggcacccagacctacatctgcaacgtgaaccacaagcccagcaacacgaaggtggacaagaaggtggagcccaagtcctgcgacaagacccacacctgcccgccctgccccgccccggagctcctgggcgggccgagcgtcttcctgttcccgcccaagcccaaggacaccctcatgatctcccggacgcccgaggtgacctgcgtggtcgtggacgtcagccacgaggaccccgaggtgaagttcaactggtacgtggacggggtcgaggtgcacaacgcgaagaccaagccccgcgaggagcagtacaactccacctaccgggtggtcagcgtgctgacggtgctgcaccaggactggctcaacggcaaggagtacaagtgcaaggtctccaacaaggccctgcccgccccgatcgagaagaccatcagcaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggcgctccacaaccactacacgcagaagagcctgtccctgagccccgggaag

SEQ ID NO: 61314 - RNA, 1353 nt, synthetic construct; identical to SEQ ID NO: 16050
  misc_feature 1..1353: note = derived and/or modified sequence opt2 from CDS (HC) w/o signal peptide encoded by mRNA R3917, R4128, R5910
  source 1..1353: mol_type = other RNA

SEQ ID NO: 61315 - RNA, 1353 nt, synthetic construct; identical to SEQ ID NO: 23692
  misc_feature 1..1353: note = derived and/or modified sequence opt3 from CDS (HC) w/o signal peptide encoded by mRNA R3917, R4128, R5910
  source 1..1353: mol_type = other RNA

SEQ ID NO: 61316 - RNA, 1353 nt, synthetic construct; identical to SEQ ID NO: 31334
  misc_feature 1..1353: note = derived and/or modified sequence opt4 from CDS (HC) w/o signal peptide encoded by mRNA R3917, R4128, R5910
  source 1..1353: mol_type = other RNA

SEQ ID NO: 61317 - RNA, 1353 nt, synthetic construct; identical to SEQ ID NO: 38976
  misc_feature 1..1353: note = derived and/or modified sequence opt5 from CDS (HC) w/o signal peptide encoded by mRNA R3917, R4128, R5910
  source 1..1353: mol_type = other RNA

SEQ ID NO: 61318 - RNA, 1353 nt, synthetic construct
  misc_feature 1..1353: note = derived and/or modified sequence opt6 from CDS (HC) w/o signal peptide encoded by mRNA R3917, R4128, R5910
  source 1..1353: mol_type = other RNA
caagtacaactacaacaacctggagcagaattagtaaaaccaggagcatcagtcaaaatgtcatgcaaagcctcaggatatacttttacttcatacaatatgcactgggtaaaacaaacaccaggacgaggcctagaatggataggagcaatctaccccggcaatggggacacatcatacaatcaaaaatttaaaggaaaagcaactctaacagcagacaaatcttcatcaacagcatatatgcaactaagctcactaacaagcgaagactcagcagtatactactgtgcacgatccacatactacggaggtgactggtatttcaacgtatggggagcaggaaccacagtaaccgtatcagcagcatcaacaaaaggaccctccgtatttccactagcaccatcaagtaaatcaacatccggaggaacagcagcattaggctgtctagtaaaagactactttccagaaccagtaaccgtatcatggaactcaggagcactaacctccggcgtacacacattcccagcagtccttcaatcatcaggactatacagtttatcctcagtagtaaccgtaccctcatcttctttaggaacacagacatacatatgcaatgtcaaccacaaaccctccaataccaaagtagacaagaaagtagaaccaaaaagctgtgacaaaacacatacctgtccaccatgtcccgcaccagaattattaggagggccatcagtattcctattcccaccaaaaccaaaagacacactaatgatctcacgaacaccagaagtaacatgcgttgtggtagacgtatcacatgaagaccccgaagtaaaattcaactggtacgtagacggagtagaagtacataatgccaaaacaaaaccccgcgaagaacaatataattcaacctatagggtcgtcagtgtattaacagtactacatcaagactggctaaacggaaaagaatacaaatgcaaagtatctaacaaagcattaccagcaccaatagagaaaacaatctcaaaagcaaaaggacaaccaagagaaccacaagtttacactctcccaccatcaagagacgaactaaccaaaaaccaagtctcattaacatgtctagtaaaaggattctacccctcagacatagctgtcgaatgggaatcaaatggacaaccagaaaataactacaaaaccacaccaccagttcttgattcagacggatcattcttcctatactcaaaactaacagtagataaatctagatggcaacaaggaaacgtattctcatgctcagtaatgcacgaagcattacacaaccactatacccaaaaatcactatcactatctccaggaaaa

SEQ ID NO: 61319 - RNA, 1353 nt, synthetic construct
  misc_feature 1..1353: note = derived and/or modified sequence opt11 from CDS (HC) w/o signal peptide encoded by mRNA R3917, R4128, R5910
  source 1..1353: mol_type = other RNA
caagtacaactacaacaacccggcgccgaactcgtcaaacccggcgccagcgtcaaaatgtcctgcaaagcctccggctacactttcacctcatacaacatgcactgggtaaaacaaacccccggtcgaggactcgaatggatcggcgcaatctatcccggcaacggagacacctcctacaaccagaaattcaaaggcaaagccaccctcacagcagacaaatcctcctcaacagcctacatgcaactctcctccctgacctccgaagacagcgccgtctactactgcgcccgctccacctactacggcggagactggtacttcaacgtatggggagctggcaccacagtcaccgtctcagccgcttcaacaaaaggccccagtgtcttccccctcgcaccctcatccaaatccacctccggagggaccgcagccctcggctgtctggtaaaagactacttccccgaacccgtcaccgtctcctggaactcaggtgcactcacctccggagtccacaccttccccgccgtcctccaaagctccggcctctactccctctcctccgtagtcaccgtgccctcaagctcactcgggacacagacatacatctgcaacgtcaaccataaaccatccaacaccaaagtcgacaagaaagtcgaacccaaatcctgcgacaaaacccacacctgtccaccctgccccgcccccgaattactcggcggaccctccgtcttcctcttcccaccaaaacccaaagacacactaatgataagccgcacccctgaagtaacctgcgtcgtcgtagacgtctcacacgaagacccagaagtcaaattcaactggtacgtcgatggcgtcgaagtccacaacgcaaaaacaaaaccccgggaagaacaatataactccacataccgagtcgtctccgtccttaccgttctccaccaagactggctaaacggcaaagaatacaaatgcaaagtatcaaacaaagcactccccgcccccatagagaaaaccatctccaaagccaaaggacaaccccgcgaaccccaagtatacaccctcccaccctcccgcgacgaactcacgaaaaaccaagtctctctaacctgcctcgtaaaaggcttctacccctccgacatagccgtcgaatgggaatccaacggccaacccgaaaacaactacaaaacaaccccacccgtcctcgactcagacggctccttctttctatactcaaaactcaccgtggataagtctagatggcagcaaggaaacgtcttttcctgcagcgtaatgcacgaagcactacacaaccactacacccaaaaatccctcagcttaagccccggaaaa

SEQ ID NO: 61320 - protein, 475 aa, synthetic construct
  REGION 1..475: note = Protein (HC) encoded by mRNA R3917, R4128, R5910
MAVMAPRTLVLLLSGALALTQTWAQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61321 - RNA, 1428 nt, synthetic construct
  misc_feature 1..1428: note = CDS (HC) encoded by mRNA R3917, R4128, R5910
  source 1..1428: mol_type = other RNA
atggccgtgatggccccgcggaccctggtcctcctgctgagcggcgcgctcgccctgacccagacgtgggcccaggtgcagctgcagcagcccggggcggagctggtcaagccgggcgccagcgtgaagatgtcctgcaaggccagcgggtacaccttcacgtcctacaacatgcactgggtgaagcagacccccggccgggggctcgagtggatcggcgccatctaccccggcaacggggacaccagctacaaccagaagttcaagggcaaggccaccctgacggcggacaagtccagctccaccgcctacatgcagctgagctccctcaccagcgaggactccgccgtctactactgcgcccgcagcacctactacgggggcgactggtacttcaacgtgtggggcgcggggacgaccgtgaccgtctccgccgccagcaccaagggcccctccgtgttcccgctggcccccagctccaagagcacgagcgggggcaccgccgcgctggggtgcctcgtgaaggactacttccccgagcccgtcaccgtgtcctggaacagcggcgccctgacctccggcgtgcacacgttcccggccgtcctgcagagctccgggctctacagcctgtccagcgtggtgaccgtcccctccagctccctgggcacccagacctacatctgcaacgtgaaccacaagcccagcaacacgaaggtggacaagaaggtggagcccaagtcctgcgacaagacccacacctgcccgccctgccccgccccggagctcctgggcgggccgagcgtcttcctgttcccgcccaagcccaaggacaccctcatgatctcccggacgcccgaggtgacctgcgtggtcgtggacgtcagccacgaggaccccgaggtgaagttcaactggtacgtggacggggtcgaggtgcacaacgcgaagaccaagccccgcgaggagcagtacaactccacctaccgggtggtcagcgtgctgacggtgctgcaccaggactggctcaacggcaaggagtacaagtgcaaggtctccaacaaggccctgcccgccccgatcgagaagaccatcagcaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggcgctccacaaccactacacgcagaagagcctgtccctgagccccgggaagtga

SEQ ID NO: 61322 - RNA, 1632 nt, synthetic construct
  misc_feature 1..1632: note = R4128
  source 1..1632: mol_type = other RNA
gggagaaagcttaccatggccgtgatggccccgcggaccctggtcctcctgctgagcggcgcgctcgccctgacccagacgtgggcccaggtgcagctgcagcagcccggggcggagctggtcaagccgggcgccagcgtgaagatgtcctgcaaggccagcgggtacaccttcacgtcctacaacatgcactgggtgaagcagacccccggccgggggctcgagtggatcggcgccatctaccccggcaacggggacaccagctacaaccagaagttcaagggcaaggccaccctgacggcggacaagtccagctccaccgcctacatgcagctgagctccctcaccagcgaggactccgccgtctactactgcgcccgcagcacctactacgggggcgactggtacttcaacgtgtggggcgcggggacgaccgtgaccgtctccgccgccagcaccaagggcccctccgtgttcccgctggcccccagctccaagagcacgagcgggggcaccgccgcgctggggtgcctcgtgaaggactacttccccgagcccgtcaccgtgtcctggaacagcggcgccctgacctccggcgtgcacacgttcccggccgtcctgcagagctccgggctctacagcctgtccagcgtggtgaccgtcccctccagctccctgggcacccagacctacatctgcaacgtgaaccacaagcccagcaacacgaaggtggacaagaaggtggagcccaagtcctgcgacaagacccacacctgcccgccctgccccgccccggagctcctgggcgggccgagcgtcttcctgttcccgcccaagcccaaggacaccctcatgatctcccggacgcccgaggtgacctgcgtggtcgtggacgtcagccacgaggaccccgaggtgaagttcaactggtacgtggacggggtcgaggtgcacaacgcgaagaccaagccccgcgaggagcagtacaactccacctaccgggtggtcagcgtgctgacggtgctgcaccaggactggctcaacggcaaggagtacaagtgcaaggtctccaacaaggccctgcccgccccgatcgagaagaccatcagcaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggcgctccacaaccactacacgcagaagagcctgtccctgagccccgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61323 - RNA, 1830 nt, synthetic construct
  misc_feature 1..1830: note = R5910
  source 1..1830: mol_type = other RNA
gggtcccgcagtcggcgtccagcggctctgcttgttcgtgtgtgtgtcgttgcaggccttattcaagcttaccatggccgtgatggccccgcggaccctggtcctcctgctgagcggcgcgctcgccctgacccagacgtgggcccaggtgcagctgcagcagcccggggcggagctggtcaagccgggcgccagcgtgaagatgtcctgcaaggccagcgggtacaccttcacgtcctacaacatgcactgggtgaagcagacccccggccgggggctcgagtggatcggcgccatctaccccggcaacggggacaccagctacaaccagaagttcaagggcaaggccaccctgacggcggacaagtccagctccaccgcctacatgcagctgagctccctcaccagcgaggactccgccgtctactactgcgcccgcagcacctactacgggggcgactggtacttcaacgtgtggggcgcggggacgaccgtgaccgtctccgccgccagcaccaagggcccctccgtgttcccgctggcccccagctccaagagcacgagcgggggcaccgccgcgctggggtgcctcgtgaaggactacttccccgagcccgtcaccgtgtcctggaacagcggcgccctgacctccggcgtgcacacgttcccggccgtcctgcagagctccgggctctacagcctgtccagcgtggtgaccgtcccctccagctccctgggcacccagacctacatctgcaacgtgaaccacaagcccagcaacacgaaggtggacaagaaggtggagcccaagtcctgcgacaagacccacacctgcccgccctgccccgccccggagctcctgggcgggccgagcgtcttcctgttcccgcccaagcccaaggacaccctcatgatctcccggacgcccgaggtgacctgcgtggtcgtggacgtcagccacgaggaccccgaggtgaagttcaactggtacgtggacggggtcgaggtgcacaacgcgaagaccaagccccgcgaggagcagtacaactccacctaccgggtggtcagcgtgctgacggtgctgcaccaggactggctcaacggcaaggagtacaagtgcaaggtctccaacaaggccctgcccgccccgatcgagaagaccatcagcaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggcgctccacaaccactacacgcagaagagcctgtccctgagccccgggaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61324 - protein, 213 aa, synthetic construct; identical to SEQ ID NO: 768
  REGION 1..213: note = Protein (LC) w/o signal peptide encoded by mRNA R3917, R4129, R5911

SEQ ID NO: 61325 - RNA, 639 nt, synthetic construct
  misc_feature 1..639: note = CDS (LC) w/o signal peptide encoded by mRNA R3917, R4129, R5911
  source 1..639: mol_type = other RNA
cagatcgtgctgagccagtcccccgccatcctgagcgcgtccccgggggagaaggtgaccatgacctgccgggccagctccagcgtctcctacatccactggttccagcagaagcccggcagctcccccaagccctggatctacgccacgagcaacctcgcctccggggtgccggtgcgcttcagcggctccgggagcggcacctcctacagcctgaccatcagccgggtcgaggccgaggacgcggccacctactactgccagcagtggacgtccaacccgcccaccttcggcgggggcaccaagctggagatcaagcgcaccgtggccgcccccagcgtgttcatcttcccgccctccgacgagcagctcaagagcgggacggcgtccgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcctgcgaggtcacccaccaggggctgtccagccccgtgaccaagtccttcaaccgcggcgagtgc

SEQ ID NO: 61326 - RNA, 639 nt, synthetic construct; identical to SEQ ID NO: 16052
  misc_feature 1..639: note = derived and/or modified sequence opt2 from CDS (LC) w/o signal peptide encoded by mRNA R3917, R4129, R5911
  source 1..639: mol_type = other RNA

SEQ ID NO: 61327 - RNA, 639 nt, synthetic construct; identical to SEQ ID NO: 23694
  misc_feature 1..639: note = derived and/or modified sequence opt3 from CDS (LC) w/o signal peptide encoded by mRNA R3917, R4129, R5911
  source 1..639: mol_type = other RNA

SEQ ID NO: 61328 - RNA, 639 nt, synthetic construct; identical to SEQ ID NO: 31336
  misc_feature 1..639: note = derived and/or modified sequence opt4 from CDS (LC) w/o signal peptide encoded by mRNA R3917, R4129, R5911
  source 1..639: mol_type = other RNA

SEQ ID NO: 61329 - RNA, 639 nt, synthetic construct; identical to SEQ ID NO: 38978
  misc_feature 1..639: note = derived and/or modified sequence opt5 from CDS (LC) w/o signal peptide encoded by mRNA R3917, R4129, R5911
  source 1..639: mol_type = other RNA

SEQ ID NO: 61330 - RNA, 639 nt, synthetic construct
  misc_feature 1..639: note = derived and/or modified sequence opt6 from CDS (LC) w/o signal peptide encoded by mRNA R3917, R4129, R5911
  source 1..639: mol_type = other RNA
caaatcgtcctatcacaatcaccagcaatactatcagcatcaccaggagaaaaagtaacaatgacatgcagagcatcatcatcagtatcatacatacactggttccaacaaaaaccaggatcctcacccaaaccatggatatacgcaacaagcaacctagcatcaggagtaccagtaagattctcaggctcaggatctggaacatcatactcactaacaatatccagagtagaagcagaagacgcagcaacatactactgccaacaatggacatcaaacccaccaacattcggaggcggaacaaaattagaaataaaaagaacagtagcagcaccatcagtattcatattcccaccatcagacgaacaactaaaatcaggaacagcatccgtagtatgcctactaaacaacttctaccccagagaagcaaaagtccaatggaaagtagacaacgcactacaatcaggaaactcccaagaatcagtaacagaacaagacagtaaagactcaacatattcattatcatcaacattaacactatcaaaagcagactacgaaaaacacaaagtatacgcctgcgaagtaacacaccaaggactatcctcaccagtaacaaaatcattcaacagaggcgaatgc

SEQ ID NO: 61331 - RNA, 639 nt, synthetic construct
  misc_feature 1..639: note = derived and/or modified sequence opt11 from CDS (LC) w/o signal peptide encoded by mRNA R3917, R4129, R5911
  source 1..639: mol_type = other RNA
caaatcgtactctcccaatcccccgctatcctctcagcctcccccggcgaaaaagtcaccatgacatgccgcgcatcatcctccgtctcctacatccactggttccaacaaaaacccggctcatcccccaaaccctggatctacgccacctccaacctagcatcaggcgtccccgtccgcttctccggctccggctccggcacatcctactcactcaccatctcccgcgtcgaagccgaagacgccgccacctactactgccaacaatggacctccaacccccccaccttcggcggcggcaccaaactagaaatcaaacgcaccgtagcagcaccctccgtcttcatcttccccccctccgacgaacaactcaaatcaggcaccgcctcagtcgtctgcctcctcaacaacttctaccccagagaagccaaagtccaatggaaagtcgacaacgctctccaatccggcaactcacaagaatccgtcaccgaacaagactcaaaagactcaacctactccctctcctccaccctcaccctatccaaagccgactacgaaaaacacaaagtatacgcatgcgaagtcacccaccaaggcctctcctcccccgtcaccaaatccttcaaccgcggcgaatgc

SEQ ID NO: 61332 - protein, 237 aa, synthetic construct
  REGION 1..237: note = Protein (LC) encoded by mRNA R3917, R4129, R5911
MAVMAPRTLVLLLSGALALTQTWAQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61333 - RNA, 714 nt, synthetic construct
  misc_feature 1..714: note = CDS (LC) encoded by mRNA R3917, R4129, R5911
  source 1..714: mol_type = other RNA
atggccgtgatggccccgcggaccctggtcctcctgctgagcggcgcgctcgccctgacccagacgtgggcccagatcgtgctgagccagtcccccgccatcctgagcgcgtccccgggggagaaggtgaccatgacctgccgggccagctccagcgtctcctacatccactggttccagcagaagcccggcagctcccccaagccctggatctacgccacgagcaacctcgcctccggggtgccggtgcgcttcagcggctccgggagcggcacctcctacagcctgaccatcagccgggtcgaggccgaggacgcggccacctactactgccagcagtggacgtccaacccgcccaccttcggcgggggcaccaagctggagatcaagcgcaccgtggccgcccccagcgtgttcatcttcccgccctccgacgagcagctcaagagcgggacggcgtccgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcctgcgaggtcacccaccaggggctgtccagccccgtgaccaagtccttcaaccgcggcgagtgctga

SEQ ID NO: 61334 - RNA, 918 nt, synthetic construct
  misc_feature 1..918: note = R4129
  source 1..918: mol_type = other RNA
gggagaaagcttaccatggccgtgatggccccgcggaccctggtcctcctgctgagcggcgcgctcgccctgacccagacgtgggcccagatcgtgctgagccagtcccccgccatcctgagcgcgtccccgggggagaaggtgaccatgacctgccgggccagctccagcgtctcctacatccactggttccagcagaagcccggcagctcccccaagccctggatctacgccacgagcaacctcgcctccggggtgccggtgcgcttcagcggctccgggagcggcacctcctacagcctgaccatcagccgggtcgaggccgaggacgcggccacctactactgccagcagtggacgtccaacccgcccaccttcggcgggggcaccaagctggagatcaagcgcaccgtggccgcccccagcgtgttcatcttcccgccctccgacgagcagctcaagagcgggacggcgtccgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcctgcgaggtcacccaccaggggctgtccagccccgtgaccaagtccttcaaccgcggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61335 - RNA, 1116 nt, synthetic construct
  misc_feature 1..1116: note = R5911
  source 1..1116: mol_type = other RNA
gggtcccgcagtcggcgtccagcggctctgcttgttcgtgtgtgtgtcgttgcaggccttattcaagcttaccatggccgtgatggccccgcggaccctggtcctcctgctgagcggcgcgctcgccctgacccagacgtgggcccagatcgtgctgagccagtcccccgccatcctgagcgcgtccccgggggagaaggtgaccatgacctgccgggccagctccagcgtctcctacatccactggttccagcagaagcccggcagctcccccaagccctggatctacgccacgagcaacctcgcctccggggtgccggtgcgcttcagcggctccgggagcggcacctcctacagcctgaccatcagccgggtcgaggccgaggacgcggccacctactactgccagcagtggacgtccaacccgcccaccttcggcgggggcaccaagctggagatcaagcgcaccgtggccgcccccagcgtgttcatcttcccgccctccgacgagcagctcaagagcgggacggcgtccgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcctgcgaggtcacccaccaggggctgtccagccccgtgaccaagtccttcaaccgcggcgagtgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61336 - RNA, 2819 nt, synthetic construct
  misc_feature 1..2819: note = CDS (HC)-IRES-CDS (LC) as RNA from mRNA R3917
  source 1..2819: mol_type = other RNA
atggccgtgatggccccgcggaccctggtcctcctgctgagcggcgcgctcgccctgacccagacgtgggcccaggtgcagctgcagcagcccggggcggagctggtcaagccgggcgccagcgtgaagatgtcctgcaaggccagcgggtacaccttcacgtcctacaacatgcactgggtgaagcagacccccggccgggggctcgagtggatcggcgccatctaccccggcaacggggacaccagctacaaccagaagttcaagggcaaggccaccctgacggcggacaagtccagctccaccgcctacatgcagctgagctccctcaccagcgaggactccgccgtctactactgcgcccgcagcacctactacgggggcgactggtacttcaacgtgtggggcgcggggacgaccgtgaccgtctccgccgccagcaccaagggcccctccgtgttcccgctggcccccagctccaagagcacgagcgggggcaccgccgcgctggggtgcctcgtgaaggactacttccccgagcccgtcaccgtgtcctggaacagcggcgccctgacctccggcgtgcacacgttcccggccgtcctgcagagctccgggctctacagcctgtccagcgtggtgaccgtcccctccagctccctgggcacccagacctacatctgcaacgtgaaccacaagcccagcaacacgaaggtggacaagaaggtggagcccaagtcctgcgacaagacccacacctgcccgccctgccccgccccggagctcctgggcgggccgagcgtcttcctgttcccgcccaagcccaaggacaccctcatgatctcccggacgcccgaggtgacctgcgtggtcgtggacgtcagccacgaggaccccgaggtgaagttcaactggtacgtggacggggtcgaggtgcacaacgcgaagaccaagccccgcgaggagcagtacaactccacctaccgggtggtcagcgtgctgacggtgctgcaccaggactggctcaacggcaaggagtacaagtgcaaggtctccaacaaggccctgcccgccccgatcgagaagaccatcagcaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggcgctccacaaccactacacgcagaagagcctgtccctgagccccgggaagtgaatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggcccagatcgtgctgagccagtcccccgccatcctgagcgcgtccccgggggagaaggtgaccatgacctgccgggccagctccagcgtctcctacatccactggttccagcagaagcccggcagctcccccaagccctggatctacgccacgagcaacctcgcctccggggtgccggtgcgcttcagcggctccgggagcggcacctcctacagcctgaccatcagccgggtcgaggccgaggacgcggccacctactactgccagcagtggacgtccaacccgcccaccttcggcgggggcaccaagctggagatcaagcgcaccgtggccgcccccagcgtgttcatcttcccgccctccgacgagcagctcaagagcgggacggcgtccgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcctgcgaggtcacccaccaggggctgtccagccccgtgaccaagtccttcaaccgcggcgagtgctga

SEQ ID NO: 61337 - RNA, 3023 nt, synthetic construct
  misc_feature 1..3023: note = R3917
  source 1..3023: mol_type = other RNA
gggagaaagcttaccatggccgtgatggccccgcggaccctggtcctcctgctgagcggcgcgctcgccctgacccagacgtgggcccaggtgcagctgcagcagcccggggcggagctggtcaagccgggcgccagcgtgaagatgtcctgcaaggccagcgggtacaccttcacgtcctacaacatgcactgggtgaagcagacccccggccgggggctcgagtggatcggcgccatctaccccggcaacggggacaccagctacaaccagaagttcaagggcaaggccaccctgacggcggacaagtccagctccaccgcctacatgcagctgagctccctcaccagcgaggactccgccgtctactactgcgcccgcagcacctactacgggggcgactggtacttcaacgtgtggggcgcggggacgaccgtgaccgtctccgccgccagcaccaagggcccctccgtgttcccgctggcccccagctccaagagcacgagcgggggcaccgccgcgctggggtgcctcgtgaaggactacttccccgagcccgtcaccgtgtcctggaacagcggcgccctgacctccggcgtgcacacgttcccggccgtcctgcagagctccgggctctacagcctgtccagcgtggtgaccgtcccctccagctccctgggcacccagacctacatctgcaacgtgaaccacaagcccagcaacacgaaggtggacaagaaggtggagcccaagtcctgcgacaagacccacacctgcccgccctgccccgccccggagctcctgggcgggccgagcgtcttcctgttcccgcccaagcccaaggacaccctcatgatctcccggacgcccgaggtgacctgcgtggtcgtggacgtcagccacgaggaccccgaggtgaagttcaactggtacgtggacggggtcgaggtgcacaacgcgaagaccaagccccgcgaggagcagtacaactccacctaccgggtggtcagcgtgctgacggtgctgcaccaggactggctcaacggcaaggagtacaagtgcaaggtctccaacaaggccctgcccgccccgatcgagaagaccatcagcaaggccaagggccagccccgcgagccccaggtgtacaccctgcccccgagccgggacgagctcaccaagaaccaggtgtccctgacgtgcctggtcaaggggttctaccccagcgacatcgccgtggagtgggagtccaacggccagcccgagaacaactacaagaccaccccgcccgtgctcgacagcgacgggtccttcttcctgtacagcaagctgaccgtcgacaagtcccgctggcagcagggcaacgtgttcagctgctccgtgatgcacgaggcgctccacaaccactacacgcagaagagcctgtccctgagccccgggaagtgaatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggcccagatcgtgctgagccagtcccccgccatcctgagcgcgtccccgggggagaaggtgaccatgacctgccgggccagctccagcgtctcctacatccactggttccagcagaagcccggcagctcccccaagccctggatctacgccacgagcaacctcgcctccggggtgccggtgcgcttcagcggctccgggagcggcacctcctacagcctgaccatcagccgggtcgaggccgaggacgcggccacctactactgccagcagtggacgtccaacccgcccaccttcggcgggggcaccaagctggagatcaagcgcaccgtggccgcccccagcgtgttcatcttcccgccctccgacgagcagctcaagagcgggacggcgtccgtcgtgtgcctgctgaacaacttctacccccgggaggccaaggtgcagtggaaggtcgacaacgccctccagagcggcaactcccaggagagcgtgaccgagcaggactccaaggacagcacctactccctgagctccaccctgacgctcagcaaggccgactacgagaagcacaaggtgtacgcctgcgaggtcacccaccaggggctgtccagccccgtgaccaagtccttcaaccgcggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61338 - protein, 451 aa, synthetic construct; identical to SEQ ID NO: 515
  REGION 1..451: note = Protein (HC) w/o signal peptide encoded by mRNA R4126, R3985

SEQ ID NO: 61339 - RNA, 1353 nt, synthetic construct
  misc_feature 1..1353: note = CDS (HC) w/o signal peptide encoded by mRNA R4126, R3985
  source 1..1353: mol_type = other RNA
gaggtgcagctggtccagagcggcgggggcgtggagcgccccgggggctccctccggctgagctgcgccgcctccgggttcaccttcgacgactacggcatgagctgggtgcgccaggcgccgggcaaggggctggagtgggtctccggcatcaactggaacgggggcagcaccgggtacgccgactccgtgaagggccgggtgacgatcagccgcgacaacgccaagaactccctctacctgcagatgaacagcctgcgggccgaggacaccgccgtctactactgcgcgaagatcctcggcgccgggcgcggctggtacttcgacctgtgggggaagggcaccaccgtgacggtgtccagcgcctccaccaagggccccagcgtcttccccctggccccctccagcaagtccaccagcgggggcaccgcggccctcgggtgcctggtgaaggactacttccccgagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagcgggtggagcccaagagctgcgacaagacccacacgtgcccgccctgcccggcccccgagctgctgggcgggccctccgtcttcctcttcccgccgaagcccaaggacaccctgatgatcagccgcacccccgaggtgacctgcgtggtcgtggacgtctcccacgaggaccccgaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccgcaggtgtacacgctcccgcccagccgcgaggagatgaccaagaaccaggtgtccctgacctgcctggtcaagggcttctaccccagcgacatcgccgtggagtgggagagcaacggccagccggagaacaactacaagaccacgccgcccgtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtccccggggaag

SEQ ID NO: 61340 - RNA, 1353 nt, synthetic construct; identical to SEQ ID NO: 15799
  misc_feature 1..1353: note = derived and/or modified sequence opt2 from CDS (HC) w/o signal peptide encoded by mRNA R4126, R3985
  source 1..1353: mol_type = other RNA

SEQ ID NO: 61341 - RNA, 1353 nt, synthetic construct; identical to SEQ ID NO: 23441
  misc_feature 1..1353: note = derived and/or modified sequence opt3 from CDS (HC) w/o signal peptide encoded by mRNA R4126, R3985
  source 1..1353: mol_type = other RNA

SEQ ID NO: 61342 - RNA, 1353 nt, synthetic construct; identical to SEQ ID NO: 31083
  misc_feature 1..1353: note = derived and/or modified sequence opt4 from CDS (HC) w/o signal peptide encoded by mRNA R4126, R3985
  source 1..1353: mol_type = other RNA

SEQ ID NO: 61343 - RNA, 1353 nt, synthetic construct; identical to SEQ ID NO: 38725
  misc_feature 1..1353: note = derived and/or modified sequence opt5 from CDS (HC) w/o signal peptide encoded by mRNA R4126, R3985
  source 1..1353: mol_type = other RNA

SEQ ID NO: 61344 - RNA, 1353 nt, synthetic construct
  misc_feature 1..1353: note = derived and/or modified sequence opt6 from CDS (HC) w/o signal peptide encoded by mRNA R4126, R3985
  source 1..1353: mol_type = other RNA
gaagtacaattagtacaatcaggaggaggagtagaaagacccggaggttcactacgattatcttgcgcagcaagtggattcacatttgatgactatggaatgtcctgggtaagacaagcaccaggaaaaggactcgaatgggtttctggaataaactggaatggaggatccacaggctacgcagactcagtaaaaggaagagtaacaatctcaagagataatgccaaaaacagcctatatttacaaatgaactcattacgagcagaagatacagcagtatattattgtgcaaaaattctaggtgcaggaagaggctggtactttgatctttggggaaaaggaacaacagtaacagtatcctcagcatcaacaaaaggcccaagtgtttttccattagcaccatcatcaaaatccacaagcggaggaacagcagctttaggctgcttagtgaaagactatttccctgaaccagtaacagtatcatggaatagcggagcattaacatcaggagtacacacattccctgcagtattacaatcaagcggactctattccctatctagcgtggtgacggtaccctcatctagcttaggaacacaaacctacatatgcaatgtaaatcacaaaccttcaaacacaaaagttgataaaagagtagaacccaaatcatgcgacaaaacacacacatgtcccccttgcccagcaccagaattactaggaggcccatccgtattcctatttccaccaaaaccaaaagatacactcatgattagtcgaacaccagaagtaacttgtgtagtagtagacgtatcacatgaagacccagaagtcaaatttaactggtacgtagacggagtagaagttcataacgcaaaaaccaaacctagagaagaacaatataatagcacctaccgagtcgtaagcgtattaacagtattacaccaagactggctaaatggaaaagaatataaatgtaaagtatcaaataaagcactaccagcaccaatagaaaaaactatttcaaaagcaaaaggacaaccaagagaaccacaagtatatacattaccaccatccagagaagaaatgaccaaaaatcaagtaagtttaacatgcttagttaaaggtttctatccatcagatatagcagtagaatgggaatctaacggacaaccagaaaataattacaaaacaactccaccagtattagatagcgatggatcattttttctatatagcaaattaactgtagataaatctagatggcaacaaggcaatgtattttcatgttcagtaatgcacgaagcccttcataatcattatacacaaaaatcattatctttatcacctggaaaa

SEQ ID NO: 61345 - RNA, 1353 nt, synthetic construct
  misc_feature 1..1353: note = derived and/or modified sequence opt11 from CDS (HC) w/o signal peptide encoded by mRNA R4126, R3985
  source 1..1353: mol_type = other RNA
gaagtccaactcgtccaatccggtggaggcgtcgaacgcccaggcggcagcctccgactatcctgcgcagcaagcggcttcacattcgatgactacggcatgagctgggtccgccaagccccaggaaaaggcctagaatgggtatcaggcataaactggaacggaggcagcaccggctacgcagactcagtcaaaggacgagttaccatctcacgcgacaacgccaaaaactccctatacctacaaatgaactccctccgagccgaagacaccgcagtctactactgcgccaaaatcctcggcgccggccgcggatggtacttcgacctctggggcaaaggcaccaccgtaacggtctcctccgcctcaacaaagggaccaagcgtctttcccctagccccctcaagcaaatcaacctcaggcggcaccgccgccctcggctgcctagtcaaagactacttcccagaacccgtcactgtatcctggaactccggagccctcacctcaggcgtccacacattcccagcagtcctccagtcatcaggactatattctctatcctcagtagtaaccgtcccatcaagcagcctaggcacacaaacttacatatgtaatgtaaaccacaaaccctctaacaccaaagtagacaaacgcgtcgaacccaaatcctgcgacaaaacacacacatgccctccctgccccgcccccgaactcttaggcggcccctccgtcttcctcttcccgcccaaacccaaagacaccctgatgatctcccgaacccccgaagtaacatgcgtcgtcgtagacgtctcacacgaagaccccgaagtcaaatttaactggtacgtcgacggcgtcgaagtacacaacgccaaaaccaaaccgagagaagaacagtacaactcaacctaccgcgtcgttagcgtactaaccgtgctccaccaagactggctcaacggaaaagaatacaaatgcaaagtcagcaacaaagccctccccgcccccatcgagaaaaccatctcaaaagcaaaaggtcaaccacgagaaccccaagtatacaccctaccaccctcacgcgaagaaatgactaaaaaccaggtctccctgacctgcctcgtcaagggcttctacccctcagacatcgccgtcgaatgggaatcaaacggccaacccgaaaacaactacaaaaccacacccccagtactcgactccgacggatccttcttcctctattccaagctaaccgtagacaaatcccgctggcaacaaggcaacgtttttagctgctcagtaatgcacgaagccctccataaccactacacccaaaaatccctctcactctcccctggcaaa

SEQ ID NO: 61346 - protein, 476 aa, synthetic construct
  REGION 1..476: note = Protein (HC) encoded by mRNA R4126, R3985
MAVMAPRTLVLLLSGALALTQTWAGEVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61347 - RNA, 1431 nt, synthetic construct
  misc_feature 1..1431: note = CDS (HC) encoded by mRNA R4126, R3985
  source 1..1431: mol_type = other RNA
atggccgtgatggccccgcggaccctggtcctcctgctgagcggcgcgctcgccctgacccagacgtgggccggggaggtgcagctggtccagagcggcgggggcgtggagcgccccgggggctccctccggctgagctgcgccgcctccgggttcaccttcgacgactacggcatgagctgggtgcgccaggcgccgggcaaggggctggagtgggtctccggcatcaactggaacgggggcagcaccgggtacgccgactccgtgaagggccgggtgacgatcagccgcgacaacgccaagaactccctctacctgcagatgaacagcctgcgggccgaggacaccgccgtctactactgcgcgaagatcctcggcgccgggcgcggctggtacttcgacctgtgggggaagggcaccaccgtgacggtgtccagcgcctccaccaagggccccagcgtcttccccctggccccctccagcaagtccaccagcgggggcaccgcggccctcgggtgcctggtgaaggactacttccccgagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagcgggtggagcccaagagctgcgacaagacccacacgtgcccgccctgcccggcccccgagctgctgggcgggccctccgtcttcctcttcccgccgaagcccaaggacaccctgatgatcagccgcacccccgaggtgacctgcgtggtcgtggacgtctcccacgaggaccccgaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccgcaggtgtacacgctcccgcccagccgcgaggagatgaccaagaaccaggtgtccctgacctgcctggtcaagggcttctaccccagcgacatcgccgtggagtgggagagcaacggccagccggagaacaactacaagaccacgccgcccgtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtccccggggaagtga

SEQ ID NO: 61348 - RNA, 1635 nt, synthetic construct
  misc_feature 1..1635: note = R4126
  source 1..1635: mol_type = other RNA
gggagaaagcttaccatggccgtgatggccccgcggaccctggtcctcctgctgagcggcgcgctcgccctgacccagacgtgggccggggaggtgcagctggtccagagcggcgggggcgtggagcgccccgggggctccctccggctgagctgcgccgcctccgggttcaccttcgacgactacggcatgagctgggtgcgccaggcgccgggcaaggggctggagtgggtctccggcatcaactggaacgggggcagcaccgggtacgccgactccgtgaagggccgggtgacgatcagccgcgacaacgccaagaactccctctacctgcagatgaacagcctgcgggccgaggacaccgccgtctactactgcgcgaagatcctcggcgccgggcgcggctggtacttcgacctgtgggggaagggcaccaccgtgacggtgtccagcgcctccaccaagggccccagcgtcttccccctggccccctccagcaagtccaccagcgggggcaccgcggccctcgggtgcctggtgaaggactacttccccgagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagcgggtggagcccaagagctgcgacaagacccacacgtgcccgccctgcccggcccccgagctgctgggcgggccctccgtcttcctcttcccgccgaagcccaaggacaccctgatgatcagccgcacccccgaggtgacctgcgtggtcgtggacgtctcccacgaggaccccgaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccgcaggtgtacacgctcccgcccagccgcgaggagatgaccaagaaccaggtgtccctgacctgcctggtcaagggcttctaccccagcgacatcgccgtggagtgggagagcaacggccagccggagaacaactacaagaccacgccgcccgtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtccccggggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61349 - protein, 214 aa, synthetic construct; identical to SEQ ID NO: 517
  REGION 1..214: note = Protein (LC) w/o signal peptide encoded by mRNA R4127, R3985

SEQ ID NO: 61350 - RNA, 642 nt, synthetic construct
  misc_feature 1..642: note = CDS (LC) w/o signal peptide encoded by mRNA R4127, R3985
  source 1..642: mol_type = other RNA
agctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagcgggaaccacgtggtgttcggcgggggcacgaagctgaccgtcctggggcagcccaaggccgccccgtccgtgaccctcttcccgcccagctccgaggagctgcaggccaacaaggcgaccctggtgtgcctcatcagcgacttctacccgggcgccgtcacggtggcctggaaggccgactccagccccgtgaaggccggcgtcgagaccaccacccccagcaagcagtccaacaacaagtacgcggccagctcctacctgagcctgacgcccgagcagtggaagtcccaccggagctactcctgccaggtgacccacgaggggagcaccgtggagaagaccgtcgccccgacggagtgctcc

SEQ ID NO: 61351 - RNA, 642 nt, synthetic construct; identical to SEQ ID NO: 15801
  misc_feature 1..642: note = derived and/or modified sequence opt2 from CDS (LC) w/o signal peptide encoded by mRNA R4127, R3985
  source 1..642: mol_type = other RNA

SEQ ID NO: 61352 - RNA, 642 nt, synthetic construct; identical to SEQ ID NO: 23443
  misc_feature 1..642: note = derived and/or modified sequence opt3 from CDS (LC) w/o signal peptide encoded by mRNA R4127, R3985
  source 1..642: mol_type = other RNA

SEQ ID NO: 61353 - RNA, 642 nt, synthetic construct; identical to SEQ ID NO: 31085
  misc_feature 1..642: note = derived and/or modified sequence opt4 from CDS (LC) w/o signal peptide encoded by mRNA R4127, R3985
  source 1..642: mol_type = other RNA

SEQ ID NO: 61354 - RNA, 642 nt, synthetic construct; identical to SEQ ID NO: 38727
  misc_feature 1..642: note = derived and/or modified sequence opt5 from CDS (LC) w/o signal peptide encoded by mRNA R4127, R3985
  source 1..642: mol_type = other RNA

SEQ ID NO: 61355 - RNA, 642 nt, synthetic construct
  misc_feature 1..642: note = derived and/or modified sequence opt6 from CDS (LC) w/o signal peptide encoded by mRNA R4127, R3985
  source 1..642: mol_type = other RNA
tcatcagaattaacacaagacccagcagtatcagtcgcactaggacaaacagtcagaataacatgccaaggagacagcttacgatcatactacgcctcatggtaccaacaaaaaccaggacaagcaccagtattagtaatatacggaaaaaacaacagaccatcaggaataccagacagattctcaggatcatcatcaggaaacacagcatcactaaccataaccggcgcacaagcagaagacgaagcagattactactgtaactcaagagactcatcaggaaaccacgtagtatttggaggaggaacaaaactaacagtactaggacaaccaaaagcagcaccatcagtaacactattcccaccatcctcagaagaattacaagcaaacaaagcaacactagtctgcttaatatcagacttctacccaggagcagtaacagtagcatggaaagcagacagctcaccagtaaaagcaggagtagaaaccacaacaccatcaaaacaatcaaacaacaaatacgcagcatctagctacctaagtttaaccccagaacaatggaaatcacacagatcatactcatgccaagtaacacacgaaggaagcacagtagaaaaaacagtagcaccaacagaatgctca

SEQ ID NO: 61356 - RNA, 642 nt, synthetic construct
  misc_feature 1..642: note = derived and/or modified sequence opt11 from CDS (LC) w/o signal peptide encoded by mRNA R4127, R3985
  source 1..642: mol_type = other RNA
tcctccgaactcacccaagaccccgcagtctccgtcgcactcggccaaaccgtccgcataacctgccaaggcgactccctccgctcctactacgcctcctggtaccaacaaaaacccggacaagcccccgtcctagtaatctacggcaaaaacaaccgaccctctggcatccccgaccgcttctctggcagctcatccggcaacaccgcctccctcaccatcacaggcgcccaagccgaagacgaagccgactactactgcaactcccgcgactcctccggcaaccacgtagtcttcggcggcggcaccaaactcacagtactcggacaacccaaagccgcaccctccgtcaccctattcccaccctcctcagaagaactccaagcaaacaaagccaccctagtctgcctcatctcagacttctaccccggcgcagtaaccgtcgcatggaaagccgactcatcccccgtcaaagccggcgtcgaaaccaccaccccctccaaacaatcaaacaacaaatacgccgcctcctcatacctctccctcacccccgaacaatggaaatcccaccgctcatacagctgccaagtcacacacgaaggctccaccgtcgagaaaacagtcgcacccacagaatgctcc

SEQ ID NO: 61357 - protein, 239 aa, synthetic construct
  REGION 1..239: note = Protein (LC) encoded by mRNA R4127, R3985
MAVMAPRTLVLLLSGALALTQTWAGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61358 - RNA, 720 nt, synthetic construct
  misc_feature 1..720: note = CDS (LC) encoded by mRNA R4127, R3985
  source 1..720: mol_type = other RNA
atggccgtgatggccccgcggaccctggtcctcctgctgagcggcgcgctcgccctgacccagacgtgggccgggagctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagcgggaaccacgtggtgttcggcgggggcacgaagctgaccgtcctggggcagcccaaggccgccccgtccgtgaccctcttcccgcccagctccgaggagctgcaggccaacaaggcgaccctggtgtgcctcatcagcgacttctacccgggcgccgtcacggtggcctggaaggccgactccagccccgtgaaggccggcgtcgagaccaccacccccagcaagcagtccaacaacaagtacgcggccagctcctacctgagcctgacgcccgagcagtggaagtcccaccggagctactcctgccaggtgacccacgaggggagcaccgtggagaagaccgtcgccccgacggagtgctcctga

SEQ ID NO: 61359 - RNA, 924 nt, synthetic construct
  misc_feature 1..924: note = R4127
  source 1..924: mol_type = other RNA
gggagaaagcttaccatggccgtgatggccccgcggaccctggtcctcctgctgagcggcgcgctcgccctgacccagacgtgggccgggagctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagcgggaaccacgtggtgttcggcgggggcacgaagctgaccgtcctggggcagcccaaggccgccccgtccgtgaccctcttcccgcccagctccgaggagctgcaggccaacaaggcgaccctggtgtgcctcatcagcgacttctacccgggcgccgtcacggtggcctggaaggccgactccagccccgtgaaggccggcgtcgagaccaccacccccagcaagcagtccaacaacaagtacgcggccagctcctacctgagcctgacgcccgagcagtggaagtcccaccggagctactcctgccaggtgacccacgaggggagcaccgtggagaagaccgtcgccccgacggagtgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61360 - RNA, 2828 nt, synthetic construct
  misc_feature 1..2828: note = CDS (HC)-IRES-CDS (LC) as RNA from mRNA R3985
  source 1..2828: mol_type = other RNA
atggccgtgatggccccgcggaccctggtcctcctgctgagcggcgcgctcgccctgacccagacgtgggccggggaggtgcagctggtccagagcggcgggggcgtggagcgccccgggggctccctccggctgagctgcgccgcctccgggttcaccttcgacgactacggcatgagctgggtgcgccaggcgccgggcaaggggctggagtgggtctccggcatcaactggaacgggggcagcaccgggtacgccgactccgtgaagggccgggtgacgatcagccgcgacaacgccaagaactccctctacctgcagatgaacagcctgcgggccgaggacaccgccgtctactactgcgcgaagatcctcggcgccgggcgcggctggtacttcgacctgtgggggaagggcaccaccgtgacggtgtccagcgcctccaccaagggccccagcgtcttccccctggccccctccagcaagtccaccagcgggggcaccgcggccctcgggtgcctggtgaaggactacttccccgagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagcgggtggagcccaagagctgcgacaagacccacacgtgcccgccctgcccggcccccgagctgctgggcgggccctccgtcttcctcttcccgccgaagcccaaggacaccctgatgatcagccgcacccccgaggtgacctgcgtggtcgtggacgtctcccacgaggaccccgaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccgcaggtgtacacgctcccgcccagccgcgaggagatgaccaagaaccaggtgtccctgacctgcctggtcaagggcttctaccccagcgacatcgccgtggagtgggagagcaacggccagccggagaacaactacaagaccacgccgcccgtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtccccggggaagtgaatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccgggagctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagcgggaaccacgtggtgttcggcgggggcacgaagctgaccgtcctggggcagcccaaggccgccccgtccgtgaccctcttcccgcccagctccgaggagctgcaggccaacaaggcgaccctggtgtgcctcatcagcgacttctacccgggcgccgtcacggtggcctggaaggccgactccagccccgtgaaggccggcgtcgagaccaccacccccagcaagcagtccaacaacaagtacgcggccagctcctacctgagcctgacgcccgagcagtggaagtcccaccggagctactcctgccaggtgacccacgaggggagcaccgtggagaagaccgtcgccccgacggagtgctcctga

SEQ ID NO: 61361 - RNA, 3020 nt, synthetic construct
  misc_feature 1..3020: note = R3985
  source 1..3020: mol_type = other RNA
gggagaaagcttaccatggccgtgatggccccgcggaccctggtcctcctgctgagcggcgcgctcgccctgacccagacgtgggccggggaggtgcagctggtccagagcggcgggggcgtggagcgccccgggggctccctccggctgagctgcgccgcctccgggttcaccttcgacgactacggcatgagctgggtgcgccaggcgccgggcaaggggctggagtgggtctccggcatcaactggaacgggggcagcaccgggtacgccgactccgtgaagggccgggtgacgatcagccgcgacaacgccaagaactccctctacctgcagatgaacagcctgcgggccgaggacaccgccgtctactactgcgcgaagatcctcggcgccgggcgcggctggtacttcgacctgtgggggaagggcaccaccgtgacggtgtccagcgcctccaccaagggccccagcgtcttccccctggccccctccagcaagtccaccagcgggggcaccgcggccctcgggtgcctggtgaaggactacttccccgagcccgtgacggtctcctggaacagcggcgccctgaccagcggggtgcacaccttccccgccgtgctccagtccagcggcctgtactccctgagctccgtcgtgaccgtgcccagctccagcctcggcacgcagacctacatctgcaacgtcaaccacaagccgtccaacaccaaggtggacaagcgggtggagcccaagagctgcgacaagacccacacgtgcccgccctgcccggcccccgagctgctgggcgggccctccgtcttcctcttcccgccgaagcccaaggacaccctgatgatcagccgcacccccgaggtgacctgcgtggtcgtggacgtctcccacgaggaccccgaggtgaagttcaactggtacgtggacggggtcgaggtgcacaacgcgaagacgaagccccgggaggagcagtacaacagcacctaccgcgtggtctccgtgctgaccgtgctccaccaggactggctgaacggcaaggagtacaagtgcaaggtcagcaacaaggccctgcccgcccccatcgagaagaccatctccaaggccaaggggcagccccgggagccgcaggtgtacacgctcccgcccagccgcgaggagatgaccaagaaccaggtgtccctgacctgcctggtcaagggcttctaccccagcgacatcgccgtggagtgggagagcaacggccagccggagaacaactacaagaccacgccgcccgtgctcgactccgacgggagcttcttcctgtactccaagctgaccgtcgacaagagccggtggcagcagggcaacgtgttctcctgcagcgtgatgcacgaggcgctccacaaccactacacccagaagtccctgagcctgtccccggggaagtgaatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccgggagctccgagctgacccaggaccccgccgtgagcgtcgccctcggccagaccgtgcgcatcacgtgccagggggactccctgcggagctactacgcgtcctggtaccagcagaagccgggccaggcccccgtgctggtcatctacgggaagaacaaccgccccagcggcatccccgaccggttctccgggagctccagcggcaacaccgcctccctcaccatcaccggcgcccaggccgaggacgaggcggactactactgcaacagccgcgactccagcgggaaccacgtggtgttcggcgggggcacgaagctgaccgtcctggggcagcccaaggccgccccgtccgtgaccctcttcccgcccagctccgaggagctgcaggccaacaaggcgaccctggtgtgcctcatcagcgacttctacccgggcgccgtcacggtggcctggaaggccgactccagccccgtgaaggccggcgtcgagaccaccacccccagcaagcagtccaacaacaagtacgcggccagctcctacctgagcctgacgcccgagcagtggaagtcccaccggagctactcctgccaggtgacccacgaggggagcaccgtggagaagaccgtcgccccgacggagtgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61362 - protein, 451 aa, synthetic construct
  REGION 1..451: note = Protein (HC) w/o signal peptide encoded by mRNA R5319
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61363 - RNA, 1353 nt, synthetic construct
  misc_feature 1..1353: note = CDS (HC) w/o signal peptide encoded by mRNA R5319
  source 1..1353: mol_type = other RNA
caggtccagctggtgcagtccggcgggcagatgaagaagcccggcgagagcatgcgcatctcctgccgggccagcgggtacgagttcatcgactgcaccctgaactggatccgcctcgcgccgggcaagcggcccgagtggatgggctggctgaagccccgcgggggcgccgtgaactacgcccggcccctgcaggggcgcgtcaccatgacgcgggacgtgtactccgacaccgccttcctcgagctgcgcagcctgaccgtggacgacaccgccgtctacttctgcacgcggggcaagaactgcgactacaactgggacttcgagcactgggggcgcggcaccccggtgatcgtgtccagcgcgtccaccaagggccccagcgtcttccccctcgccccctccagcaagtccaccagcgggggcacggccgccctggggtgcctggtgaaggactacttcccggagcccgtgaccgtctcctggaacagcggcgcgctcacctccggcgtgcacaccttccccgccgtgctgcagagctccgggctgtacagcctcagctccgtcgtgacggtgcccagctccagcctgggcacccagacctacatctgcaacgtcaaccacaagccctccaacaccaaggtggacaagaaggtggagcccaagagctgcgacaagacgcacacgtgcccgccctgcccggcccccgagctgctcgggggcccctccgtcttcctgttcccgcccaagcccaaggacaccctgatgatcagccggacccccgaggtgacgtgcgtggtcgtggacgtctcccacgaggaccccgaggtgaagttcaactggtacgtggacggggtcgaggtgcacaacgccaagaccaagccgcgcgaggagcagtacaacagcacctaccgggtggtctccgtgctcaccgtgctgcaccaggactggctgaacggcaaggagtacaagtgcaaggtcagcaacaaggccctccccgcgcccatcgagaagacgatctccaaggccaagggccagccccgcgagccgcaggtctacaccctgccgcccagccgggacgagctgaccaagaaccaggtgtccctgacctgcctggtcaaggggttctaccccagcgacatcgccgtggagtgggagtccaacggccagcccgagaacaactacaagacgaccccgcccgtgctggacagcgacgggtccttcttcctctacagcaagctgaccgtcgacaagagccgctggcagcagggcaacgtgttctcctgcagcgtgatgcacgaggccctgcacaaccactacacccagaagtccctcagcctgtcccccgggaag

SEQ ID NO: 61364 - RNA, 1353 nt, synthetic construct
  misc_feature 1..1353: note = derived and/or modified sequence opt2 from CDS (HC) w/o signal peptide encoded by mRNA R5319
  source 1..1353: mol_type = other RNA
caggtccagctcgtccagtccggcggccagatgaagaagcccggcgagtccatgcgcatctcctgccgcgcctccggctacgagttcatcgactgcaccctcaactggatccgcctcgcccccggcaagcgccccgagtggatgggctggctcaagccccgcggcggcgccgtcaactacgcccgccccctccagggccgcgtcaccatgacccgcgacgtctactccgacaccgccttcctcgagctccgctccctcaccgtcgacgacaccgccgtctacttctgcacccgcggcaagaactgcgactacaactgggacttcgagcactggggccgcggcacccccgtcatcgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61365 - RNA, 1353 nt, synthetic construct
  misc_feature 1..1353: note = derived and/or modified sequence opt3 from CDS (HC) w/o signal peptide encoded by mRNA R5319
  source 1..1353: mol_type = other RNA
caggtgcaactggtccagagcggcgggcagatgaagaaacccggagagtccatgagaatctcttgcagggcctcaggttacgagttcattgactgtaccctcaactggatacggcttgctcctggcaagcgcccagaatggatggggtggctgaaaccgcgaggaggcgcagttaattatgcccgtcccttgcagggtagagtgacaatgactagggatgtatacagtgacacggcgtttttagaactgcggagcctaaccgtggatgacacagctgtctatttctgcactcgcgggaagaactgtgattacaattgggactttgagcactggggaagaggcacccctgtgatcgtttcctctgcctcgacaaaaggcccatcagtgttccccctcgcacctagcagtaagtccacctctgggggaactgccgctctgggttgccttgtcaaggattattttccagaacccgtgacagtaagctggaactccggcgcactgacctcaggggttcatacgttccctgccgtgttgcaaagtagcggactctactctctgtcctcagtcgtgactgtgccaagcagttctctgggcacccagacatatatttgtaatgtcaaccacaaaccgtccaatactaaggttgacaaaaaggtggagcccaaaagctgcgataagacccatacatgtcctccatgccccgctcctgagctcttaggtgggccatcggtatttctgtttcccccgaagcctaaagacacccttatgatctctaggacgcccgaagtgacttgtgtcgtggttgatgtgtcccacgaggacccagaagtcaagttcaactggtacgtggatggagtagaggttcataatgccaaaacaaagcctcgggaggaacagtacaactcaacctatcgcgtggtcagtgtgttgactgtcctgcaccaggactggctaaatggcaaagagtacaagtgcaaagtgagcaacaaggcgctccccgcaccaattgaaaagacaatctccaaagccaagggccaaccccgagagcctcaggtttataccctgccaccgtctagagacgaacttacgaaaaatcaggtgagcctgacctgtttggtaaaggggttctacccctcagatatagctgtcgagtgggagagtaacggacagcctgaaaataactataaaacaactccacccgtgctcgactccgatggtagctttttcctgtactctaagttaaccgttgacaagtcaaggtggcaacagggcaacgtgtttagttgcagcgtcatgcacgaggccctgcataatcactatacacagaaatccctctctctttcgcctgggaag

SEQ ID NO: 61366 - RNA, 1353 nt, synthetic construct
  misc_feature 1..1353: note = derived and/or modified sequence opt4 from CDS (HC) w/o signal peptide encoded by mRNA R5319
  source 1..1353: mol_type = other RNA
caggtgcagctggtgcagagcggcggccagatgaagaagcccggcgagagcatgagaatcagctgcagagccagcggctacgagttcatcgactgcaccctgaactggatcagactggcccccggcaagagacccgagtggatgggctggctgaagcccagaggcggcgccgtgaactacgccagacccctgcagggcagagtgaccatgaccagagacgtgtacagcgacaccgccttcctggagctgagaagcctgaccgtggacgacaccgccgtgtacttctgcaccagaggcaagaactgcgactacaactgggacttcgagcactggggcagaggcacccccgtgatcgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61367 - RNA, 1353 nt, synthetic construct
  misc_feature 1..1353: note = derived and/or modified sequence opt5 from CDS (HC) w/o signal peptide encoded by mRNA R5319
  source 1..1353: mol_type = other RNA
caggtgcaactggtccagagcggcgggcagatgaagaaacccggagagtccatgagaatctcttgccgggccagcggctacgagttcattgactgtaccctcaactggatccgcctggctcctgggaagagaccggaatggatgggatggcttaaaccccggggcggggccgttaattatgcgcgccctctgcagggaagagtgacaatgacgcgggatgtgtactccgacaccgcttttctcgaactgcgctctcttacagtcgatgacaccgccgtgtatttctgcacaagaggcaagaactgtgattacaattgggactttgagcactggggccgggggacccccgttattgtgagctccgcctctacaaaaggacctagcgtcttccccctggctccttccagcaagtctacctccggcgggacggccgctctcggatgcctggtgaaggattattttccggaacccgttaccgtgagctggaactctggcgccctgacatccggggtccataccttccctgcggtgctccaaagctctggactgtactcccttagctccgtggtcacagttccctctagctccctgggcacccagacgtatatctgtaatgtgaaccacaaacctagcaatacaaaggtggacaaaaaggtcgagcccaaatcttgcgataagacccatacatgtccgccttgccccgcccctgagctcctgggcgggccctccgtgtttctttttccccctaagccgaaagacaccctgatgattagccgcacccccgaagttacatgtgtggtcgtggatgtttctcacgaggaccctgaagtgaagtttaactggtacgtcgatggagtggaggtccataatgctaaaacgaagcccagagaggaacagtacaacagcacctatcgggtggtttccgtgctcacagtcctgcaccaggactggctgaatggcaaagagtacaagtgcaaagtgtctaacaaggccctccctgctcccatcgaaaagaccatcagcaaagccaaggggcaaccgcgcgagcctcaggtttatacactgcccccttccagagacgaacttaccaaaaatcaggtgagcctgacgtgtctcgtcaagggattctacccctctgatattgcggtggagtgggagtccaacggccagcctgaaaataactataaaacaacacccccggtgctggacagcgatgggtctttcttcctttactccaagctgaccgttgacaagagccggtggcaacagggaaacgtcttttcctgctctgtgatgcacgaggccctccataatcactatacccagaaaagcctgtccctgtctcctggcaag

SEQ ID NO: 61368 - RNA, 1353 nt, synthetic construct
  misc_feature 1..1353: note = derived and/or modified sequence opt6 from CDS (HC) w/o signal peptide encoded by mRNA R5319
  source 1..1353: mol_type = other RNA
caagtccaactagtacaatccggaggacaaatgaaaaaaccaggagaatctatgcgaatatcttgcagagcctctggttatgaattcatagattgcacactaaattggataagactggccccaggaaaaagacctgaatggatgggatggctaaaaccccgaggtggcgctgtaaattatgcacgaccactacaaggaagagtaacaatgactagagacgtctattcagatacagcattcttagaattaagatctctaacagtagacgatactgcagtatacttctgcactagaggtaaaaactgcgattataattgggatttcgaacactggggaagaggcacgccagtaattgtatcctcagcaagcacaaaaggaccatcagttttccccctagcaccatcttcaaaatcaactagtggaggaactgcagcactaggatgtttagtaaaagactacttcccagaacctgtaacagtatcatggaattcaggagcactaacaagtggagtacacacattcccagcagttctacaatcatcaggattatattcattatcatcagtagtcacagtcccaagctcatcacttggaacacaaacatacatatgcaatgtcaatcacaaaccatctaacaccaaagtagacaaaaaagtagaaccaaaatcctgcgacaaaacccacacatgcccaccttgtccagctccagaactattaggaggtccatcagtctttttatttccaccaaaaccaaaagatacattaatgatttcacgtacaccagaagtaacttgtgtagtagtagatgtatcacacgaggatcctgaagttaaatttaactggtatgtagacggagtagaagtacataacgccaaaacaaaaccaagagaagaacaatataacagtacatacagagtcgtatcagtattaacagtcctacaccaagactggttaaatggcaaagaatataaatgtaaagttagcaataaagcattaccagcaccaatagaaaaaacaatatcaaaagcaaaaggacaaccccgagaaccacaagtatatacactaccacctagcagagatgaactaacaaaaaatcaagtaagcttaacatgcctagtaaaaggattttatccatccgacatagccgtagaatgggaatcaaatggacaaccggaaaacaattacaaaacaacaccaccagttttagattcagacggttcattctttttatatagtaaactaactgtagataaatcaagatggcaacaaggaaatgtatttagctgctcagtaatgcatgaagcactacataatcattacactcaaaaaagcctttcactatcacccggaaaa

SEQ ID NO: 61369 - RNA, 1353 nt, synthetic construct
  misc_feature 1..1353: note = derived and/or modified sequence opt11 from CDS (HC) w/o signal peptide encoded by mRNA R5319
  source 1..1353: mol_type = other RNA
caagtccaactcgtccaatccggcggccaaatgaaaaagcccggagagagcatgcgcatatcatgccgagcctcaggctacgagttcatcgactgcaccctcaactggatccgcctcgcccccggcaagcgacccgaatggatgggctggctaaaaccccgcggaggagccgtaaactacgcccgccccctacaaggcagagtaaccatgacccgcgatgtctactccgacacagccttcctcgaactccgctcactcaccgtagacgatacggccgtctatttctgcacccgcggcaaaaactgcgactataactgggacttcgaacactggggacgaggcacacccgtcatagtctcctccgcctccaccaaaggaccctccgtcttccccctcgcaccatcctctaaatccacctcaggaggcaccgccgcactaggctgcctcgtaaaagattacttccctgaacccgtaaccgtcagctggaactcaggcgctctaacatctggcgtacacaccttccccgccgtcctccaatcctccggactatactccctatcgtccgtagtcaccgtcccttcctcctcactcggcacccaaacctatatctgcaacgtaaaccacaaaccttccaacactaaagtagacaagaaagtcgaaccaaaatcctgcgacaaaacccacacatgcccaccctgccccgcccccgaactactaggcggcccaagcgtattcctcttcccgcccaaaccaaaagacaccttaatgatctcccgaacccccgaagtaacctgcgtcgtcgtcgacgtctcccacgaagaccccgaagtaaaattcaactggtacgtcgacggcgtcgaagtccacaacgctaaaaccaaaccccgcgaagaacaatataactcaacctaccgcgtagtatcagtactaaccgtactacaccaagactggctaaacggtaaagaatacaaatgcaaagtcagcaacaaagccctcccagcccctatcgaaaagaccatcagcaaagccaaaggacaaccccgcgaaccccaagtctacacacttcccccatcccgtgacgaactcaccaaaaaccaagtatccctcacatgcctcgtcaaaggcttctacccctctgacatcgccgtcgaatgggaatcaaacgggcaacccgaaaacaactacaaaacaacaccacccgtactcgactccgacggctcattcttcctctactcaaaactcacagtcgacaaatcccgctggcaacaaggcaatgtcttctcctgctcagtaatgcacgaagcccttcacaaccactacacacaaaaatcactaagcctcagccccggaaaa

SEQ ID NO: 61370 - protein, 470 aa, synthetic construct
  REGION 1..470: note = Protein (HC) encoded by mRNA R5319
MELGLSWIFLLAILKGVQCQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61371 - RNA, 1413 nt, synthetic construct
  misc_feature 1..1413: note = CDS (HC) encoded by mRNA R5319
  source 1..1413: mol_type = other RNA
atggagctgggcctcagctggatcttcctgctggccatcctcaagggggtgcagtgccaggtccagctggtgcagtccggcgggcagatgaagaagcccggcgagagcatgcgcatctcctgccgggccagcgggtacgagttcatcgactgcaccctgaactggatccgcctcgcgccgggcaagcggcccgagtggatgggctggctgaagccccgcgggggcgccgtgaactacgcccggcccctgcaggggcgcgtcaccatgacgcgggacgtgtactccgacaccgccttcctcgagctgcgcagcctgaccgtggacgacaccgccgtctacttctgcacgcggggcaagaactgcgactacaactgggacttcgagcactgggggcgcggcaccccggtgatcgtgtccagcgcgtccaccaagggccccagcgtcttccccctcgccccctccagcaagtccaccagcgggggcacggccgccctggggtgcctggtgaaggactacttcccggagcccgtgaccgtctcctggaacagcggcgcgctcacctccggcgtgcacaccttccccgccgtgctgcagagctccgggctgtacagcctcagctccgtcgtgacggtgcccagctccagcctgggcacccagacctacatctgcaacgtcaaccacaagccctccaacaccaaggtggacaagaaggtggagcccaagagctgcgacaagacgcacacgtgcccgccctgcccggcccccgagctgctcgggggcccctccgtcttcctgttcccgcccaagcccaaggacaccctgatgatcagccggacccccgaggtgacgtgcgtggtcgtggacgtctcccacgaggaccccgaggtgaagttcaactggtacgtggacggggtcgaggtgcacaacgccaagaccaagccgcgcgaggagcagtacaacagcacctaccgggtggtctccgtgctcaccgtgctgcaccaggactggctgaacggcaaggagtacaagtgcaaggtcagcaacaaggccctccccgcgcccatcgagaagacgatctccaaggccaagggccagccccgcgagccgcaggtctacaccctgccgcccagccgggacgagctgaccaagaaccaggtgtccctgacctgcctggtcaaggggttctaccccagcgacatcgccgtggagtgggagtccaacggccagcccgagaacaactacaagacgaccccgcccgtgctggacagcgacgggtccttcttcctctacagcaagctgaccgtcgacaagagccgctggcagcagggcaacgtgttctcctgcagcgtgatgcacgaggccctgcacaaccactacacccagaagtccctcagcctgtcccccgggaagtga

SEQ ID NO: 61372 - RNA, 1617 nt, synthetic construct
  misc_feature 1..1617: note = R5319
  source 1..1617: mol_type = other RNA
gggagaaagcttaccatggagctgggcctcagctggatcttcctgctggccatcctcaagggggtgcagtgccaggtccagctggtgcagtccggcgggcagatgaagaagcccggcgagagcatgcgcatctcctgccgggccagcgggtacgagttcatcgactgcaccctgaactggatccgcctcgcgccgggcaagcggcccgagtggatgggctggctgaagccccgcgggggcgccgtgaactacgcccggcccctgcaggggcgcgtcaccatgacgcgggacgtgtactccgacaccgccttcctcgagctgcgcagcctgaccgtggacgacaccgccgtctacttctgcacgcggggcaagaactgcgactacaactgggacttcgagcactgggggcgcggcaccccggtgatcgtgtccagcgcgtccaccaagggccccagcgtcttccccctcgccccctccagcaagtccaccagcgggggcacggccgccctggggtgcctggtgaaggactacttcccggagcccgtgaccgtctcctggaacagcggcgcgctcacctccggcgtgcacaccttccccgccgtgctgcagagctccgggctgtacagcctcagctccgtcgtgacggtgcccagctccagcctgggcacccagacctacatctgcaacgtcaaccacaagccctccaacaccaaggtggacaagaaggtggagcccaagagctgcgacaagacgcacacgtgcccgccctgcccggcccccgagctgctcgggggcccctccgtcttcctgttcccgcccaagcccaaggacaccctgatgatcagccggacccccgaggtgacgtgcgtggtcgtggacgtctcccacgaggaccccgaggtgaagttcaactggtacgtggacggggtcgaggtgcacaacgccaagaccaagccgcgcgaggagcagtacaacagcacctaccgggtggtctccgtgctcaccgtgctgcaccaggactggctgaacggcaaggagtacaagtgcaaggtcagcaacaaggccctccccgcgcccatcgagaagacgatctccaaggccaagggccagccccgcgagccgcaggtctacaccctgccgcccagccgggacgagctgaccaagaaccaggtgtccctgacctgcctggtcaaggggttctaccccagcgacatcgccgtggagtgggagtccaacggccagcccgagaacaactacaagacgaccccgcccgtgctggacagcgacgggtccttcttcctctacagcaagctgaccgtcgacaagagccgctggcagcagggcaacgtgttctcctgcagcgtgatgcacgaggccctgcacaaccactacacccagaagtccctcagcctgtcccccgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61373 - protein, 210 aa, synthetic construct
  REGION 1..210: note = Protein (LC) w/o signal peptide encoded by mRNA R5320
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61374 - RNA, 630 nt, synthetic construct
  misc_feature 1..630: note = CDS (LC) w/o signal peptide encoded by mRNA R5320
  source 1..630: mol_type = other RNA
gagatcgtgctcacccagagccccgggaccctgtccctgagccccggcgagaccgccatcatctcctgccgcacgagccagtacgggtccctcgcgtggtaccagcagcggcccggccaggccccgcgcctggtcatctacagcgggtccacccgggccgccggcatccccgaccgcttcagcggctcccggtgggggcccgactacaacctgaccatcagcaacctcgagtccggcgacttcggggtgtactactgccagcagtacgagttcttcggccaggggaccaaggtgcaggtcgacatcaagcgcacggtggccgcgcccagcgtgttcatcttcccgccctccgacgagcagctgaagagcggcaccgcctccgtcgtgtgcctgctcaacaacttctacccccgggaggccaaggtgcagtggaaggtcgacaacgccctgcagagcggcaactcccaggagagcgtgaccgagcaggactccaaggacagcacctacagcctgtccagcacgctcaccctgtccaaggcggactacgagaagcacaaggtgtacgcctgcgaggtcacccaccaggggctgagctcccccgtgaccaagagcttcaaccgcggcgagtgc

SEQ ID NO: 61375 - RNA, 630 nt, synthetic construct
  misc_feature 1..630: note = derived and/or modified sequence opt2 from CDS (LC) w/o signal peptide encoded by mRNA R5320
  source 1..630: mol_type = other RNA
gagatcgtcctcacccagtcccccggcaccctctccctctcccccggcgagaccgccatcatctcctgccgcacctcccagtacggctccctcgcctggtaccagcagcgccccggccaggccccccgcctcgtcatctactccggctccacccgcgccgccggcatccccgaccgcttctccggctcccgctggggccccgactacaacctcaccatctccaacctcgagtccggcgacttcggcgtctactactgccagcagtacgagttcttcggccagggcaccaaggtccaggtcgacatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61376 - RNA, 630 nt, synthetic construct
  misc_feature 1..630: note = derived and/or modified sequence opt3 from CDS (LC) w/o signal peptide encoded by mRNA R5320
  source 1..630: mol_type = other RNA
gagatcgtgctgacccagagccccggcacactctccctttctcctggggaaactgccattatatcatgcagaacgagtcaatacggaagcctggcttggtatcagcagaggccaggtcaggcaccgcggttggtcatctactccggctctacccgcgccgcggggattcccgaccgattctcgggatcacgttggggccctgattataacttaacaatcagcaatctggagagtggtgactttggggtttactattgtcaacagtacgagttctttggacagggcactaaggtgcaggtagatattaaaagaaccgtggctgccccatccgtcttcatctttcccccttctgacgaacaactaaagagcggcacagcatccgtggtttgcctcctgaacaatttctatccaagggaagccaaagtgcagtggaaggtcgataacgcacttcagtcagggaatagtcaggagagcgtgaccgagcaagactctaaagattccacttactcactgagcagtacattgaccctctctaaggctgactacgaaaagcacaaagtatatgcctgtgaggttacgcatcagggactgtccagccccgtgactaagtcgtttaaccggggtgaatgc

SEQ ID NO: 61377 - RNA, 630 nt, synthetic construct
  misc_feature 1..630: note = derived and/or modified sequence opt4 from CDS (LC) w/o signal peptide encoded by mRNA R5320
  source 1..630: mol_type = other RNA
gagatcgtgctgacccagagccccggcaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggccccgactacaacctgaccatcagcaacctggagagcggcgacttcggcgtgtactactgccagcagtacgagttcttcggccagggcaccaaggtgcaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61378 - RNA, 630 nt, synthetic construct
  misc_feature 1..630: note = derived and/or modified sequence opt5 from CDS (LC) w/o signal peptide encoded by mRNA R5320
  source 1..630: mol_type = other RNA
gagatcgtgctgacccagagccccggcacactctccctgtctcctggggaaacggccattatcagctgcagaacctcccaatacggatctcttgcttggtatcagcagcggccgggccaggcgccccgcctggtcatttacagcgggtccacaagagccgctggaatccctgaccggttctctggcagccgctgggggcccgattataacctcaccatttccaatctggagagcggagactttggcgtttactattgtcaacagtacgagttctttggccaggggacaaaggtccaggtggatatcaaaagaaccgtggccgccccttctgtgttcatctttcccccttccgacgaacaacttaagagcggaacagcttctgttgtgtgcctgctcaacaatttctatccgcgggaagccaaagtccagtggaaggtggataacgctctgcagtccggcaatagccaggagtctgttaccgagcaagactccaaagatagcacgtactccctgtctagcaccctcacactgtccaaggccgactacgaaaagcacaaagtgtatgcgtgtgaggtcacccatcaggggcttagctctcccgtgacaaagtcctttaaccgcggagaatgc

SEQ ID NO: 61379 - RNA, 630 nt, synthetic construct
  misc_feature 1..630: note = derived and/or modified sequence opt6 from CDS (LC) w/o signal peptide encoded by mRNA R5320
  source 1..630: mol_type = other RNA
gaaatagtactaacacaatcaccaggaacattaagcctatcaccaggagaaacagcaataatatcatgtagaacaagccaatacggaagtttagcatggtaccaacaacgacccggacaagcaccaagattagtaatatatagcggatcaacaagagcagcaggaataccagacagattctcaggatcaagatggggaccagactataacctaacaatatcaaatttagaatcaggagacttcggagtatactattgccaacaatatgaatttttcggacaaggaacaaaagtacaagtcgatataaaaagaacagtagcagcaccaagcgtatttatattcccaccatcagacgaacaattaaaatcaggaacagcctcagtagtatgcttactaaataacttttacccaagagaagccaaagtacaatggaaagtcgataacgcactacaaagcggaaactcacaagaaagcgtaacagaacaagactcaaaagactcaacatacagcttatcctcaacattaaccttaagtaaagcagactacgaaaaacacaaagtatacgcatgcgaagtaacacaccaaggattaagctcaccagtaactaaatcatttaacagaggagaatgc

SEQ ID NO: 61380 - RNA, 630 nt, synthetic construct
  misc_feature 1..630: note = derived and/or modified sequence opt11 from CDS (LC) w/o signal peptide encoded by mRNA R5320
  source 1..630: mol_type = other RNA
gaaatcgtcctcacccaatcccccggcaccctctccctctcccccggcgaaacagccattatctcctgccgcacatcccaatacggctcactcgcctggtaccaacaacgtcccggccaagccccccgcttagtaatatactccggatccacccgcgctgccggaatccccgaccgcttctccggctcccgctggggccccgactacaacctaaccatctccaacctagaatccggagacttcggcgtctactactgccaacaatacgaattcttcggacaaggcaccaaagtccaagtcgacatcaaacgcaccgtcgccgccccctccgtattcatcttccccccctccgacgaacaactaaaatccggcaccgcctccgtcgtctgcctcctaaacaacttctacccccgagaagccaaagtccaatggaaagtcgacaacgcactccaatccggcaactcccaagaatccgtcaccgaacaagactccaaagactcaacctactcactttcatccaccctaaccctctccaaagccgactacgaaaaacacaaagtatacgcctgcgaagtcacccaccaaggcctctcctcccccgtcacaaaatcattcaaccgcggagaatgc

SEQ ID NO: 61381 - protein, 230 aa, synthetic construct
  REGION 1..230: note = Protein (LC) encoded by mRNA R5320
METPAQLLFLLLLWLPDTTGEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61382 - RNA, 693 nt, synthetic construct
  misc_feature 1..693: note = CDS (LC) encoded by mRNA R5320
  source 1..693: mol_type = other RNA
atggagacccccgcccagctgctcttcctgctgctcctgtggctgccggacaccacgggcgagatcgtgctcacccagagccccgggaccctgtccctgagccccggcgagaccgccatcatctcctgccgcacgagccagtacgggtccctcgcgtggtaccagcagcggcccggccaggccccgcgcctggtcatctacagcgggtccacccgggccgccggcatccccgaccgcttcagcggctcccggtgggggcccgactacaacctgaccatcagcaacctcgagtccggcgacttcggggtgtactactgccagcagtacgagttcttcggccaggggaccaaggtgcaggtcgacatcaagcgcacggtggccgcgcccagcgtgttcatcttcccgccctccgacgagcagctgaagagcggcaccgcctccgtcgtgtgcctgctcaacaacttctacccccgggaggccaaggtgcagtggaaggtcgacaacgccctgcagagcggcaactcccaggagagcgtgaccgagcaggactccaaggacagcacctacagcctgtccagcacgctcaccctgtccaaggcggactacgagaagcacaaggtgtacgcctgcgaggtcacccaccaggggctgagctcccccgtgaccaagagcttcaaccgcggcgagtgctga

SEQ ID NO: 61383 - RNA, 897 nt, synthetic construct
  misc_feature 1..897: note = R5320
  source 1..897: mol_type = other RNA
gggagaaagcttaccatggagacccccgcccagctgctcttcctgctgctcctgtggctgccggacaccacgggcgagatcgtgctcacccagagccccgggaccctgtccctgagccccggcgagaccgccatcatctcctgccgcacgagccagtacgggtccctcgcgtggtaccagcagcggcccggccaggccccgcgcctggtcatctacagcgggtccacccgggccgccggcatccccgaccgcttcagcggctcccggtgggggcccgactacaacctgaccatcagcaacctcgagtccggcgacttcggggtgtactactgccagcagtacgagttcttcggccaggggaccaaggtgcaggtcgacatcaagcgcacggtggccgcgcccagcgtgttcatcttcccgccctccgacgagcagctgaagagcggcaccgcctccgtcgtgtgcctgctcaacaacttctacccccgggaggccaaggtgcagtggaaggtcgacaacgccctgcagagcggcaactcccaggagagcgtgaccgagcaggactccaaggacagcacctacagcctgtccagcacgctcaccctgtccaaggcggactacgagaagcacaaggtgtacgcctgcgaggtcacccaccaggggctgagctcccccgtgaccaagagcttcaaccgcggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61384 - protein, 457 aa, synthetic construct
  REGION 1..457: note = Protein (HC) w/o signal peptide encoded by mRNA R3059, R3061, R4116, R4634, R4635, R4640
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61385 - protein, 221 aa, synthetic construct
  REGION 1..221: note = Protein (LC) w/o signal peptide encoded by mRNA R3059, R3061, R4116, R4634, R4635, R4640
SWAQSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61386 - RNA, 1371 nt, synthetic construct
  misc_feature 1..1371: note = CDS (HC) w/o signal peptide as RNA from mRNA R3059, R3061, R4118, R4634, R4636, R4640
  source 1..1371: mol_type = other RNA
caggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaag

SEQ ID NO: 61387 - RNA, 663 nt, synthetic construct
  misc_feature 1..663: note = CDS (LC) w/o signal peptide as RNA from mRNA R3059, R3061, R4118, R4634, R4636, R4640
  source 1..663: mol_type = other RNA
agctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcc

SEQ ID NO: 61388 - RNA, 1371 nt, synthetic construct
  misc_feature 1..1371: note = derived and/or modified sequence opt2 from CDS (HC) w/o signal peptide as RNA from mRNA R3059, R3061, R4118, R4634, R4636, R4640
  source 1..1371: mol_type = other RNA
caggtccagctcgtccagtccggcgccgaggtcaagaagcccggctcctccgtcaaggtctcctgcaaggcctccggcggcaccttcaaccgctacaccgtcaactgggtccgccaggcccccggccagggcctcgagtggatgggcggcatcatccccatcttcggcaccgccaactacgcccagcgcttccagggccgcctcaccatcaccgccgacgagtccacctccaccgcctacatggagctctcctccctccgctccgacgacaccgccgtctacttctgcgcccgcgagaacctcgacaactccggcacctactactacttctccggctggttcgacccctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagcgcgtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgaggagatgaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61389 - RNA, 663 nt, synthetic construct
  misc_feature 1..663: note = derived and/or modified sequence opt2 from CDS (LC) w/o signal peptide as RNA from mRNA R3059, R3061, R4118, R4634, R4636, R4640
  source 1..663: mol_type = other RNA
tcctgggcccagtccgccctcacccagccccgctccgtctccggctcccccggccagtccgtcaccatctcctgcaccggcacctcctccgacatcggcggctacaacttcgtctcctggtaccagcagcaccccggcaaggcccccaagctcatgatctacgacgccaccaagcgcccctccggcgtccccgaccgcttctccggctccaagtccggcaacaccgcctccctcaccatctccggcctccaggccgaggacgaggccgactactactgctgctcctacgccggcgactacacccccggcgtcgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 61390 - RNA, 1371 nt, synthetic construct
  misc_feature 1..1371: note = derived and/or modified sequence opt3 from CDS (HC) w/o signal peptide as RNA from mRNA R3059, R3061, R4118, R4634, R4636, R4640
  source 1..1371: mol_type = other RNA
caggtgcaactggtccagagcggcgccgaggttaagaaacccgggtcctctgtgaaggtatcatgcaaagctagtggaggtaccttcaacagatacacagtgaattgggtcaggcaggcacctggccaggggctcgaatggatgggaggcatcattccaatatttggtactgccaactatgcgcaacggttccaggggcgccttacgatcaccgctgacgagagcacatccactgcctacatggaactgtcttcgttgcgatcagatgacaccgcagtgtatttttgtgcccgtgagaatttagataacagcggaacatactattacttcagtggctggtttgacccgtggggccaggggaccctggttactgtgtcctctgctagcacaaagggaccctccgtcttccctctagcaccatcaagtaaaagcacctctggtggcacggccgctctcgggtgcctggtgaaggattattttcccgaacctgtaactgtttcctggaactcaggagcccttaccagcggcgtgcacacattcccagcggtcctgcagagttctggtttgtactccctcagctcggtggtgactgtcccctcttcctcactggggacccaaacatacatttgtaatgttaatcataagcctagtaacaccaaagtggacaagagagtagagccaaaaagctgcgataagacgcacacttgtccgccctgccctgcaccagagctgctcggaggcccctccgtgtttttattccctccaaaacccaaggacacactgatgatctctaggaccccggaagtcacttgtgtggttgtggatgtcagccatgaggaccctgaagtgaagtttaattggtatgtagatggcgttgaggtgcacaacgccaaaacaaagccccgggaggaacagtacaattcaacctatcgcgtcgtgagtgtccttacggtgttgcatcaggactggctgaacgggaaagagtacaagtgcaaagtttccaataaggctctaccagcccctattgagaaaaccatcagcaaggcaaagggacagcccagagaaccacaagtgtatacactgcccccttctagggaagagatgactaaaaaccaggtatcactcacctgtcttgtcaagggtttctacccaagtgatatagctgtggagtgggaaagcaatggccagccggagaacaactataaaacaactccccctgttctggactccgacgggtcgtttttcttgtactctaagctcaccgtggataaaagccggtggcaacagggaaatgtcttctcctgctcagtgatgcacgaagccctgcacaaccattacacacagaagagtttatctctgagcccaggcaag

SEQ ID NO: 61391 - RNA, 663 nt, synthetic construct
  misc_feature 1..663: note = derived and/or modified sequence opt3 from CDS (LC) w/o signal peptide as RNA from mRNA R3059, R3061, R4118, R4634, R4636, R4640
  source 1..663: mol_type = other RNA
agctgggcccagtccgctctgacccaacccagatctgtgtcaggcagtcctgggcagagcgtcacaatctcctgcactggaacgtcttcggacattggtggctacaacttcgtttcatggtatcagcagcacccagggaaggcaccgaaactcatgatatacgatgccaccaagaggcccagcggagtgcctgaccggtttagtggctccaaatctggtaatacagcgagccttactatctccgggctgcaagctgaggatgaagccgactattactgttgctcatatgcaggagattacaccccaggcgtagtgttcggcgggggaacaaagttgaccgtcttaggtcagcccaaagccgctcctagtgtgactctgtttccacccagctctgaggaactacaggcaaacaaggccacactcgtttgtctgatttccgacttctatcctggcgctgtgaccgtcgcctggaaggcggattcaagcccagtgaaagcaggggtagagacgactaccccgagtaagcagtctaataacaaatacgccgcttccagctacctttcgctgacacccgaacaatggaagtctcatcgctcctattcatgccaggttactcacgagggaagtaccgtggagaaaacagtcgcccctaccgaatgtagc

SEQ ID NO: 61392 - RNA, 1371 nt, synthetic construct
  misc_feature 1..1371: note = derived and/or modified sequence opt4 from CDS (HC) w/o signal peptide as RNA from mRNA R3059, R3061, R4118, R4634, R4636, R4640
  source 1..1371: mol_type = other RNA
caggtgcagctggtgcagagcggcgccgaggtgaagaagcccggcagcagcgtgaaggtgagctgcaaggccagcggcggcaccttcaacagatacaccgtgaactgggtgagacaggcccccggccagggcctggagtggatgggcggcatcatccccatcttcggcaccgccaactacgcccagagattccagggcagactgaccatcaccgccgacgagagcaccagcaccgcctacatggagctgagcagcctgagaagcgacgacaccgccgtgtacttctgcgccagagagaacctggacaacagcggcacctactactacttcagcggctggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61393 - RNA, 663 nt, synthetic construct
  misc_feature 1..663: note = derived and/or modified sequence opt4 from CDS (LC) w/o signal peptide as RNA from mRNA R3059, R3061, R4118, R4634, R4636, R4640
  source 1..663: mol_type = other RNA
agctgggcccagagcgccctgacccagcccagaagcgtgagcggcagccccggccagagcgtgaccatcagctgcaccggcaccagcagcgacatcggcggctacaacttcgtgagctggtaccagcagcaccccggcaaggcccccaagctgatgatctacgacgccaccaagagacccagcggcgtgcccgacagattcagcggcagcaagagcggcaacaccgccagcctgaccatcagcggcctgcaggccgaggacgaggccgactactactgctgcagctacgccggcgactacacccccggcgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 61394 - RNA, 1371 nt, synthetic construct
  misc_feature 1..1371: note = derived and/or modified sequence opt5 from CDS (HC) w/o signal peptide as RNA from mRNA R3059, R3061, R4118, R4634, R4636, R4640
  source 1..1371: mol_type = other RNA
caggtgcaactggtccagagcggcgctgaggttaagaaacccgggtcctctgtgaaggtgagctgcaaggcttccggaggcaccttcaacagatacacagtcaattgggtgcggcaggcccctgggcagggactcgaatggatgggcgggatcattccgatctttggaacggcgaactatgctcaacgcttccagggcagactgaccattacagccgacgagtctaccagcacagcctacatggaactttcctctctgcggagcgatgacaccgctgtttatttttgtgcccgcgagaatctcgataactccggcacatactattacttcagcgggtggtttgacccctggggacagggcaccctggtgacggtctcttccgctagcaccaaagggccttctgtgttcccccttgccccttccagcaaatctacatccggaggcaccgcggccctggggtgcctcgttaaggattattttcccgaacctgtgacagtcagctggaactccggagctctgacctctggcgtgcacacgttcccggccgtgctgcagagctccggcctctacagcctgtcttccgtcgttacagtgcccagctctagccttgggacccaaacatacatctgtaatgtgaatcataagccttccaacaccaaagtcgacaagagagtggagcccaaatcttgcgataagacccacacatgtcctccctgcccggctcctgagctgctcggaggccccagcgtttttctgttccctcccaaacccaaggacacgcttatgatttcccggacccctgaagtgacatgtgtcgtggttgatgtgagccatgaggacccggaagtcaagtttaattggtatgtggatggggtcgaggtgcacaacgccaaaaccaagccccgcgaggaacagtacaattctacatatagagttgtgtccgtcctgaccgtgctccatcaggactggctgaacggaaaagagtacaagtgcaaagttagcaataaggcgctgcctgcccccatcgagaaaacgatctctaaggctaagggccagcctcgggaaccccaagtgtatacactcccgccttcccgcgaagagatgaccaaaaaccaggtcagcctgacctgtcttgtgaaggggttctacccctccgatattgccgtggagtgggaatctaatggacagcctgagaacaactataaaacaacaccccctgttctggacagcgacggctcctttttcctctactctaagctgaccgtcgataaaagcagatggcaacagggcaatgtgttctcctgcagcgtgatgcacgaagcccttcacaaccattacacgcagaagtctctgtccctcagccccgggaag

SEQ ID NO: 61395 - RNA, 663 nt, synthetic construct
  misc_feature 1..663: note = derived and/or modified sequence opt5 from CDS (LC) w/o signal peptide as RNA from mRNA R3059, R3061, R4118, R4634, R4636, R4640
  source 1..663: mol_type = other RNA
agctgggcccagtccgctctgacccaacccagatctgtgagcggctcccctgggcagtctgtcacaatcagctgcacgggaacctcctctgacattggcgggtacaacttcgttagctggtatcagcagcacccgggaaaggcccccaaactcatgatctacgatgcgacaaagcggccttccggcgtgcccgaccgctttagcgggtctaaatccggaaataccgctagcctgacaatttctggccttcaagccgaggatgaagccgactattactgttgctcctatgctggcgattacacccctggggtggtcttcggaggcgggacaaagctgaccgtgctcggacagcccaaagccgctcctagcgttacgctgtttccgccctcttccgaggaacttcaggccaacaaggcgaccctggtgtgtctcatcagcgacttctatcctggcgccgtcacagtggcttggaaggccgattcctctcccgttaaagctggggtggagaccacaacccctagcaagcagtccaataacaaatacgccgcgagctcttacctgtccctgacgcccgaacaatggaaaagccatagatcttatagctgccaggtcacacacgagggatccaccgtggagaagacagtggccccgaccgaatgttct

SEQ ID NO: 61396 - RNA, 1371 nt, synthetic construct
  misc_feature 1..1371: note = derived and/or modified sequence opt6 from CDS (HC) w/o signal peptide as RNA from mRNA R3059, R3061, R4118, R4634, R4636, R4640
  source 1..1371: mol_type = other RNA
caagtacaattagtacaatctggagccgaagtaaaaaaacccggatcatctgttaaagtgtcatgtaaagcatccggtggaacattcaacagatatacagtaaattgggtacgtcaagccccaggtcaaggactagaatggatgggaggcataataccaatatttggaacagcaaactacgcacaaagattccaaggaagactaacaataacagcagacgaatcaacatcaacagcctacatggaactaagctcacttcgaagtgacgacacagcagtatacttctgcgcaagagaaaacttagataactcaggtacatactactacttttcaggctggttcgatccatggggtcaaggaaccttagtaaccgtatccagcgcatcaactaaaggaccatccgtatttccactagcaccatcttcaaaatcaacaagcggaggaacagcagcactaggatgcttagtaaaagattattttccagaacccgtaacagtaagctggaactcaggagcactcacatcaggagtacataccttcccagcagtactacaatcttcaggcttatattccttatcatctgttgtaacagtaccatcatcatcactaggcacacaaacatacatatgcaatgtaaatcataaaccatcaaacacaaaagtagacaaaagagtagaaccaaaatcatgcgacaaaacacacacatgccccccctgccccgcccccgaactactcggcggaccttctgtcttcctattcccaccaaaaccaaaagacacactaatgataagtagaacccctgaagtcacatgcgtcgtagtagacgtatcacatgaagaccctgaagtcaaattcaattggtacgtggacggagtagaagtacacaacgcaaaaacaaaaccaagagaagaacaatataattccacataccgagttgtatcagtcctaacagttttacaccaagactggctaaatggaaaagaatataaatgcaaagtatctaacaaagcattaccagcaccaatagaaaaaacaatatcaaaagcaaaaggacaaccaagagaaccacaagtttacaccctcccaccatcaagagaagaaatgacaaaaaaccaagtatcattaacatgccttgttaaaggattttatccatccgatatagcagttgaatgggaatcaaacggtcaaccagaaaacaactacaaaacaaccccaccagtactagattcagacggatcattcttcctatactcaaaattaacagtagataaatccagatggcaacaaggaaatgttttcagttgttccgtaatgcacgaagcactacacaatcactatacacaaaaatcactatctctatccccaggaaaa

SEQ ID NO: 61397 - RNA, 663 nt, synthetic construct
  misc_feature 1..663: note = derived and/or modified sequence opt6 from CDS (LC) w/o signal peptide as RNA from mRNA R3059, R3061, R4118, R4634, R4636, R4640
  source 1..663: mol_type = other RNA
tcatgggcacaatcagcattaacacaaccacgatcagtatcaggatcaccaggacaatcagtaacaatatcatgtacaggcacatcatcagacataggaggatacaactttgtaagctggtaccaacaacatccaggaaaagcaccaaaactaatgatatacgacgccacaaaaagaccatcaggagtcccagacagattctccggatcaaaatcaggaaacaccgcatcactaacaatttcaggattacaagcagaagacgaagcagattactactgctgcagctatgcaggagactacacaccaggagtagtcttcggaggaggaacaaaattaacagtactaggacaaccaaaagcagcaccatcagtaacactattcccaccatcaagtgaagaattacaagcaaacaaagcaacactagtatgcctaatatcagacttctaccccggcgcagtaacagtagcatggaaagcagactcatcaccagtaaaagcaggagtagaaaccacaacaccatcaaaacaatcaaacaacaaatatgcagcatcatcatatttatctctaacaccagaacaatggaaatcacacagatcatattcatgccaagtaacacacgaaggatcaacagtagaaaaaacagtagcaccaacagaatgttcc

SEQ ID NO: 61398 - RNA, 1371 nt, synthetic construct
  misc_feature 1..1371: note = derived and/or modified sequence opt11 from CDS (HC) w/o signal peptide as RNA from mRNA R3059, R3061, R4118, R4634, R4636, R4640
  source 1..1371: mol_type = other RNA
caggtccaactcgtccaatcaggagccgaggtaaagaaacccggctcatccgtaaaagtctcatgcaaagcatccggcggcaccttcaaccgctacaccgtcaactgggtccgccaagccccaggccaaggactagaatggatgggaggcatcataccaatcttcggcaccgccaactacgcacaacgcttccaaggccgcctcactataaccgcagacgagagcacatcgactgcctacatggagctctcatccctccgctctgacgacaccgccgtctacttctgcgcaagagaaaacctcgacaactccggcacctactactacttctccggctggttcgacccatggggccaaggcaccctcgtaaccgtatccagcgcctccaccaaaggcccctctgtattccccctcgccccatcctcaaaatccacctccggcggaaccgccgcactcggctgccttgtaaaagactacttccccgaaccagtcacagtctcctggaactccggcgccctcacttcaggagtccacaccttccccgcagtcctccaatccagcggtctctactccctctcctctgtcgtaaccgtaccctcttcatccttaggcacccaaacatacatctgcaacgtaaaccacaagccctctaacaccaaagtcgacaaacgagtcgaaccaaaaagctgcgacaagacccatacctgcccaccctgccccgcacccgaactcctaggcggaccctccgtatttctcttcccacccaaacccaaagacacactcatgatctcccgcacccccgaagtaacctgcgtcgtagtagacgtgtcacacgaagaccccgaagtcaaattcaactggtacgtcgacggcgtcgaagtccacaacgcaaagacaaaaccccgcgaagaacaatataactcaacgtaccgagtagtctccgtcctcaccgtcctccaccaagactggctaaacggcaaagagtacaaatgcaaagtatccaacaaagctctccccgctcccatagagaaaacaatctcaaaagccaaaggccaaccccgcgaaccacaagtatacaccctgccaccctcccgcgaagaaatgaccaaaaaccaagtctcactaacatgccttgtcaaaggcttctacccctccgatatagcggtcgaatgggaatccaacggccaacccgaaaacaactacaaaaccaccccacccgtcctcgactcggacggatccttctttctctactccaaactaaccgtcgacaaatccagatggcaacaaggaaacgtcttctcctgctccgtcatgcacgaagccctacataatcactacacccaaaaatcactatccctctcccccggaaaa

SEQ ID NO: 61399 - RNA, 663 nt, synthetic construct
  misc_feature 1..663: note = derived and/or modified sequence opt11 from CDS (LC) w/o signal peptide as RNA from mRNA R3059, R3061, R4118, R4634, R4636, R4640
  source 1..663: mol_type = other RNA
tcctgggcccaatccgccctcacccaaccacgctccgtctccggctcccccggccaatcagtcacaatctcctgcacaggaacctcctccgacatcggcggctacaacttcgtctcctggtaccaacaacaccccggcaaagcccccaaactcatgatctacgacgccaccaaacgcccatccggcgtccccgaccgcttctccggctccaaatcaggcaacacagcctccctcaccatctccggcctccaagccgaagacgaagccgactactactgctgctcctacgcaggcgactacacaccaggcgtcgtcttcggcggaggcaccaaactcaccgtcctcggccaacccaaagcagccccctccgtcaccctattccccccctcatccgaagaactacaagccaacaaagccaccctcgtctgcctcatctcagacttctaccccggcgccgtaaccgtagcctggaaagccgactcctcccccgtcaaagccggcgtcgaaaccaccaccccctccaaacaatccaacaacaaatacgccgcctcttcctacctctccctcacccccgaacaatggaaatcccaccgatcctactcatgccaagtcacccacgaaggttccaccgtagaaaaaaccgtcgcccccaccgaatgctca

SEQ ID NO: 61400 - protein, 476 aa, synthetic construct [sequence omitted]

SEQ ID NO: 61401 - protein, 242 aa, synthetic construct [sequence omitted]

SEQ ID NO: 61402 - RNA, 1431 nt, synthetic construct
  misc_feature 1..1431: note = CDS 1 (HC) as RNA from mRNA R3059, R3061, R4634
  source 1..1431: mol_type = other RNA
atggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtga

SEQ ID NO: 61403 - RNA, 729 nt, synthetic construct
  misc_feature 1..729: note = CDS 2 (LC) as RNA from mRNA R3059, R3061, R4634
  source 1..729: mol_type = other RNA
atgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctga

SEQ ID NO: 61404 - RNA, 2839 nt, synthetic construct
  misc_feature 1..2839: note = CDS 1-IRES-CDS 2 as RNA from mRNA R3059, R3061, R4634
  source 1..2839: mol_type = other RNA
atggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctga

SEQ ID NO: 61405 - RNA, 3031 nt, synthetic construct
  misc_feature 1..3031: note = R3059
  source 1..3031: mol_type = other RNA
gggagaaagcttaccatggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61406 - RNA, 3221 nt, synthetic construct
  misc_feature 1..3221: note = R3061
  source 1..3221: mol_type = other RNA
ggggcgctgcctacggaggtggcagccatctccttctcggcatcaagcttaccatggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61407 - RNA, 3241 nt, synthetic construct
  misc_feature 1..3241: note = R4634
  source 1..3241: mol_type = other RNA
gggtcccgcagtcggcgtccagcggctctgcttgttcgtgtgtgtgtcgttgcaggccttattcaagcttaccatggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61408 - protein, 476 aa, synthetic construct [sequence omitted]

SEQ ID NO: 61409 - RNA, 1431 nt, synthetic construct; identical to SEQ ID NO: 61402
  misc_feature 1..1431: note = CDS (HC) as RNA from mRNA R4116, R4635
  source 1..1431: mol_type = other RNA

SEQ ID NO: 61410 - RNA, 1635 nt, synthetic construct
  misc_feature 1..1635: note = R4116
  source 1..1635: mol_type = other RNA
gggagaaagcttaccatggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61411 - RNA, 1833 nt, synthetic construct
  misc_feature 1..1833: note = R4635
  source 1..1833: mol_type = other RNA
gggtcccgcagtcggcgtccagcggctctgcttgttcgtgtgtgtgtcgttgcaggccttattcaagcttaccatggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61412 - protein, 242 aa, synthetic construct [sequence omitted]

SEQ ID NO: 61413 - RNA, 729 nt, synthetic construct; identical to SEQ ID NO: 61403
  misc_feature 1..729: note = CDS (LC) as RNA from mRNA R4118, R4636
  source 1..729: mol_type = other RNA

SEQ ID NO: 61414 - RNA, 933 nt, synthetic construct
  misc_feature 1..933: note = R4118
  source 1..933: mol_type = other RNA
gggagaaagcttaccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61415 - RNA, 1131 nt, synthetic construct
  misc_feature 1..1131: note = R4636
  source 1..1131: mol_type = other RNA
gggtcccgcagtcggcgtccagcggctctgcttgttcgtgtgtgtgtcgttgcaggccttattcaagcttaccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61416 - RNA, 2223 nt, synthetic construct
  misc_feature 1..2223: note = CDS (HC)-F2A-CDS (LC) as RNA from mRNA R4640
  source 1..2223: mol_type = other RNA
atggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaaggtgaagcagacactcaatttcgaccttctgaagttggctggagatgttgagtctaacccaggccccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctga

SEQ ID NO: 61417 - RNA, 2625 nt, synthetic construct
  misc_feature 1..2625: note = R4640
  source 1..2625: mol_type = other RNA
gggtcccgcagtcggcgtccagcggctctgcttgttcgtgtgtgtgtcgttgcaggccttattcaagcttaccatggactggacctggcgcttcctgttcgtggtcgccgccgcgaccggcgtgcagagccaggtgcagctcgtccagtccggggccgaggtgaagaagcccggcagctccgtgaaggtcagctgcaaggcctccgggggcacgttcaaccggtacaccgtgaactgggtgcgccaggccccggggcagggcctggagtggatgggcgggatcatccccatcttcggcaccgccaactacgcgcagcggttccaggggcgcctgaccatcacggccgacgagagcacctccaccgcctacatggagctcagctccctgcggagcgacgacaccgccgtctacttctgcgcgcgcgagaacctggacaactccggcacgtactactacttcagcgggtggttcgacccctggggccagggcaccctcgtgaccgtgtccagcgcctccaccaaggggcccagcgtcttcccgctggccccctccagcaagtccacgagcggcgggaccgccgccctgggctgcctcgtgaaggactacttccccgagcccgtgaccgtcagctggaactccggcgcgctgaccagcggggtgcacacgttcccggccgtgctgcagtccagcggcctctactccctgagctccgtcgtgaccgtgcccagctccagcctggggacccagacctacatctgcaacgtcaaccacaagccctccaacacgaaggtggacaagcgggtggagcccaagagctgcgacaagacccacacctgcccgccctgccccgccccggagctcctgggcgggccgtccgtcttcctgttccctcccaagcccaaggacaccctcatgatcagccgcacgccggaggtgacctgcgtcgtggtggacgtgtcccacgaggaccccgaggtgaagttcaactggtacgtggacggcgtcgaggtgcacaacgccaagaccaagccccgggaggagcagtacaacagcacctaccgcgtggtctccgtgctgacggtgctgcaccaggactggctcaacggcaaggagtacaagtgcaaggtcagcaacaaggccctgcccgcgccgatcgagaagaccatctccaaggccaaggggcagccccgggagccccaggtgtacaccctgcccccgagccgcgaggagatgaccaagaaccaggtgagcctcacgtgcctggtcaagggcttctacccctccgacatcgccgtggagtgggagagcaacgggcagcccgagaacaactacaagaccaccccgcccgtgctggactccgacggcagcttcttcctctactccaagctgaccgtcgacaagagccggtggcagcaggggaacgtgttctcctgcagcgtgatgcacgaggccctgcacaaccactacacgcagaagtccctcagcctgtcccccggcaaggtgaagcagacactcaatttcgaccttctgaagttggctggagatgttgagtctaacccaggccccatgagcgtgcccaccatggcctgggccctgctcctgctgtccctcctgacccagggcacggggagctgggcgcagtccgccctgacccagccgcgcagcgtctccggcagccccgggcagtccgtgaccatcagctgcaccggcacgtccagcgacatcgggggctacaacttcgtgtcctggtaccagcagcaccccggcaaggcccccaagctcatgatctacgacgccaccaagcggccgagcggggtccccgaccgcttctccggcagcaagtccgggaacaccgccagcctgaccatctccggcctgcaggcggaggacgaggccgactactactgctgcagctacgccggggactacacgcccggcgtggtgttcggcgggggcaccaagctcaccgtcctggggcagccgaaggccgcgccgtccgtgaccctgttccctcccagcagcgaggagctccaggccaacaaggccacgctggtgtgcctgatctccgacttctaccccggcgccgtcaccgtggcctggaaggcggacagctccccggtgaaggccggcgtcgagaccaccacgcccagcaagcagtccaacaacaagtacgccgccagctcctacctcagcctgacccccgagcagtggaagtcccaccggagctactcctgccaggtgacccacgaggggagcaccgtggagaagacggtcgcccccaccgagtgctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61418 - protein, 457 aa, synthetic construct
  REGION 1..457: note = Protein (HC) w/o signal peptide encoded by mRNA R5230
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 61419 - RNA, 1371 nt, synthetic construct
  misc_feature 1..1371: note = CDS (HC) w/o signal peptide encoded by mRNA R5230
  source 1..1371: mol_type = other RNA
caggtccagctcgtgcagagcggggccgaggtgaagaagcccggctccagcgtcaaggtgtcctgcaaggcgagcgggggcaccttcaaccgctacacggtgaactgggtccggcaggccccggggcagggcctggagtggatgggcgggatcatccccatcttcggcaccgccaactacgcccagcgcttccaggggcggctgaccatcaccgccgacgagtccacgagcaccgcgtacatggagctctccagcctgcgctccgacgacaccgccgtgtacttctgcgcccgggagaacctggacaacagcggcacctactactacttctccgggtggttcgacccctggggccagggcacgctcgtgaccgtcagctccgccaagaccaccgcgcccagcgtgtacccgctggcccccgtgtgcggggacacgaccggctccagcgtcaccctggggtgcctcgtgaagggctacttccccgagcccgtgaccctgacgtggaactccggcagcctgagctccggggtccacaccttcccggccgtgctccagagcgacctgtacaccctgtccagctccgtgaccgtcacgagctccacctggcccagccagtccatcacgtgcaacgtggcccaccccgccagctccaccaaggtggacaagaagatcgagccccgcggcccgacgatcaagccctgcccgccctgcaagtgcccggcgcccaacctcctgggcgggcccagcgtcttcatcttcccgccgaagatcaaggacgtgctgatgatctccctcagccccatcgtgacctgcgtggtggtcgacgtgtccgaggacgaccccgacgtgcagatcagctggttcgtcaacaacgtggaggtgcacaccgcccagacccagacgcaccgggaggactacaactccaccctgcgcgtcgtgagcgccctgcccatccagcaccaggactggatgtccgggaaggagttcaagtgcaaggtgaacaacaaggacctcccggcccccatcgagcggaccatcagcaagccgaagggcagcgtccgcgcgccccaggtgtacgtgctgccgccgcccgaggaggagatgaccaagaagcaggtcacgctgacctgcatggtgaccgacttcatgccggaggacatctacgtggagtggaccaacaacggcaagacggagctcaactacaagaacaccgagcccgtcctggactccgacgggagctacttcatgtactccaagctgcgggtggagaagaagaactgggtggagcgcaacagctactcctgcagcgtcgtgcacgagggcctccacaaccaccacaccaccaagtccttcagccggacccccgggaag

SEQ ID NO: 61420 - RNA, 1371 nt, synthetic construct
  misc_feature 1..1371: note = derived and/or modified sequence opt2 from CDS (HC) w/o signal peptide encoded by mRNA R5230
  source 1..1371: mol_type = other RNA
caggtccagctcgtccagtccggcgccgaggtcaagaagcccggctcctccgtcaaggtctcctgcaaggcctccggcggcaccttcaaccgctacaccgtcaactgggtccgccaggcccccggccagggcctcgagtggatgggcggcatcatccccatcttcggcaccgccaactacgcccagcgcttccagggccgcctcaccatcaccgccgacgagtccacctccaccgcctacatggagctctcctccctccgctccgacgacaccgccgtctacttctgcgcccgcgagaacctcgacaactccggcacctactactacttctccggctggttcgacccctggggccagggcaccctcgtcaccgtctcctccgccaagaccaccgccccctccgtctaccccctcgcccccgtctgcggcgacaccaccggctcctccgtcaccctcggctgcctcgtcaagggctacttccccgagcccgtcaccctcacctggaactccggctccctctcctccggcgtccacaccttccccgccgtcctccagtccgacctctacaccctctcctcctccgtcaccgtcacctcctccacctggccctcccagtccatcacctgcaacgtcgcccaccccgcctcctccaccaaggtcgacaagaagatcgagccccgcggccccaccatcaagccctgccccccctgcaagtgccccgcccccaacctcctcggcggcccctccgtcttcatcttcccccccaagatcaaggacgtcctcatgatctccctctcccccatcgtcacctgcgtcgtcgtcgacgtctccgaggacgaccccgacgtccagatctcctggttcgtcaacaacgtcgaggtccacaccgcccagacccagacccaccgcgaggactacaactccaccctccgcgtcgtctccgccctccccatccagcaccaggactggatgtccggcaaggagttcaagtgcaaggtcaacaacaaggacctccccgcccccatcgagcgcaccatctccaagcccaagggctccgtccgcgccccccaggtctacgtcctccccccccccgaggaggagatgaccaagaagcaggtcaccctcacctgcatggtcaccgacttcatgcccgaggacatctacgtcgagtggaccaacaacggcaagaccgagctcaactacaagaacaccgagcccgtcctcgactccgacggctcctacttcatgtactccaagctccgcgtcgagaagaagaactgggtcgagcgcaactcctactcctgctccgtcgtccacgagggcctccacaaccaccacaccaccaagtccttctcccgcacccccggcaag

SEQ ID NO: 61421 - RNA, 1371 nt, synthetic construct
  misc_feature 1..1371: note = derived and/or modified sequence opt3 from CDS (HC) w/o signal peptide encoded by mRNA R5230
  source 1..1371: mol_type = other RNA
caggtgcaactggtccagagcggcgccgaggttaagaaacccgggtcctctgtgaaggtatcatgcaaagctagtggaggtaccttcaacagatacacagtgaattgggtcaggcaggcacctggccaggggctcgaatggatgggaggcatcattccaatatttggtactgccaactatgcgcaacggttccaggggcgccttacgatcaccgctgacgagagcacatccactgcctacatggaactgtcttcgttgcgatcagatgacaccgcagtgtatttttgtgcccgtgagaatttagataacagcggaacatactattacttcagtggctggtttgacccgtggggccaggggaccctggttactgtgtcctctgctaagacaaccgcacccagcgtctatcctctagccccagtgtgcggagatacgactggttcctcagtaaccctcggctgtctggttaaagggtacttccccgaacctgtgacacttacttggaatagtggaagcctgtcttccggcgtccacacctttccagctgtgttgcagtcagacctctacacactgagcagttctgtgaccgtcacgtccagcacttggccctcgcaatctattacatgcaacgttgcccatcctgcgtcctcaaccaaggtggataagaaaatcgagccaagaggtccgactattaagccctgtcctccatgcaaatgtcccgcacctaatctgctcgggggaccaagtgtattcatctttcccccgaagataaaagacgtgttaatgatcagcctgtcccctattgtcacatgcgtggttgtggatgtctctgaggacgatcccgacgtgcagatcagctggttcgtaaacaatgttgaagtgcacaccgcccagacgcagacccatagggaggattataactcaacacttcgggtcgtgagtgctttgccaattcaacaccaggactggatgtccggcaaggaatttaagtgtaaagtcaataacaaggacctgcctgcccccatcgagcgcactataagcaaaccaaagggctctgtgagagcaccccaggtttacgtgctacctccaccggaggaagagatgaccaaaaagcaagtaacactcacttgcatggtcaccgatttcatgcccgaagacatttatgtggagtggacaaataacgggaaaaccgaactgaattacaagaacactgagcctgttcttgattcagacggaagttattttatgtacagcaagctgagggtggagaaaaagaactgggtcgaacggaatagctattcttgttcggtggtacatgagggtttgcacaaccaccatacgacaaaatccttctcccgcaccccaggcaag

SEQ ID NO: 61422 - RNA, 1371 nt, synthetic construct
  misc_feature 1..1371: note = derived and/or modified sequence opt4 from CDS (HC) w/o signal peptide encoded by mRNA R5230
  source 1..1371: mol_type = other RNA
caggtgcagctggtgcagagcggcgccgaggtgaagaagcccggcagcagcgtgaaggtgagctgcaaggccagcggcggcaccttcaacagatacaccgtgaactgggtgagacaggcccccggccagggcctggagtggatgggcggcatcatccccatcttcggcaccgccaactacgcccagagattccagggcagactgaccatcaccgccgacgagagcaccagcaccgcctacatggagctgagcagcctgagaagcgacgacaccgccgtgtacttctgcgccagagagaacctggacaacagcggcacctactactacttcagcggctggttcgacccctggggccagggcaccctggtgaccgtgagcagcgccaagaccaccgcccccagcgtgtaccccctggcccccgtgtgcggcgacaccaccggcagcagcgtgaccctgggctgcctggtgaagggctacttccccgagcccgtgaccctgacctggaacagcggcagcctgagcagcggcgtgcacaccttccccgccgtgctgcagagcgacctgtacaccctgagcagcagcgtgaccgtgaccagcagcacctggcccagccagagcatcacctgcaacgtggcccaccccgccagcagcaccaaggtggacaagaagatcgagcccagaggccccaccatcaagccctgccccccctgcaagtgccccgcccccaacctgctgggcggccccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccacagagaggactacaacagcaccctgagagtggtgagcgccctgcccatccagcaccaggactggatgagcggcaaggagttcaagtgcaaggtgaacaacaaggacctgcccgcccccatcgagagaaccatcagcaagcccaagggcagcgtgagagccccccaggtgtacgtgctgcccccccccgaggaggagatgaccaagaagcaggtgaccctgacctgcatggtgaccgacttcatgcccgaggacatctacgtggagtggaccaacaacggcaagaccgagctgaactacaagaacaccgagcccgtgctggacagcgacggcagctacttcatgtacagcaagctgagagtggagaagaagaactgggtggagagaaacagctacagctgcagcgtggtgcacgagggcctgcacaaccaccacaccaccaagagcttcagcagaacccccggcaag

SEQ ID NO: 61423 - RNA, 1371 nt, synthetic construct
  misc_feature 1..1371: note = derived and/or modified sequence opt5 from CDS (HC) w/o signal peptide encoded by mRNA R5230
  source 1..1371: mol_type = other RNA
caggtgcaactggtccagagcggcgccgaggttaagaaacccgggtcctctgtgaaggtgagctgcaaagctagcggaggcaccttcaacagatacacagtcaattgggtgcggcaggcccctgggcagggactcgaatggatgggcgggatcattccgatctttggaacggcgaactatgctcaacgcttccagggcagactgaccattacagccgacgagtctaccagcacagcctacatggaactttcctctctgcggagcgatgacaccgctgtttatttttgtgcccgcgagaatctcgataactccggcacatactattacttcagcgggtggtttgacccctggggacagggcaccctggtgacggtctcttccgctaagaccacagcccctagcgtgtatccccttgcgcctgtttgcggggataccacaggatcttccgtgaccctgggctgtctcgtcaaagggtacttccccgaacctgtgacgctgacatggaatagcggatctctgtccagcggcgtgcacacctttccggccgtcctccagtccgacctgtacacactttctagctccgttaccgtgaccagctctacatggccctcccaaagcatcacgtgcaacgtggctcatcctgcctctagcaccaaggtcgataagaaaattgagcccagaggccctacaatcaagccctgtccgccttgcaaatgtcccgctcctaatctgctcgggggaccctccgtgttcatctttccccctaagattaaagacgttctgatgatctctcttagcccgattgtgacctgcgtcgtggttgatgtgtccgaggacgatcccgacgtccagatcagctggttcgtgaacaatgtcgaagtgcacacagcccagacccagacgcatcgggaggattataactctacactgcgcgttgtgtccgcgctccctattcaacaccaggactggatgagcggcaaggaatttaagtgtaaagtcaataacaaggacctgcccgcccctatcgagagaaccatttctaaacccaaggggtccgtgcgggctccgcaggtttacgtgctgcctccccctgaggaagagatgaccaaaaagcaagtcacactgacctgcatggtgacagatttcatgcccgaagacatctatgtggagtggacgaataacggaaaaaccgaactcaattacaagaacacagagcctgttcttgatagcgacggctcctattttatgtactctaagctgcgcgtcgagaaaaagaactgggtggaaagaaatagctattcctgttctgtggtccatgaggggctccacaaccaccataccacaaaatccttctcccggacccccggaaag

SEQ ID NO: 61424 - RNA, 1371 nt, synthetic construct
  misc_feature 1..1371: note = derived and/or modified sequence opt6 from CDS (HC) w/o signal peptide encoded by mRNA R5230
  source 1..1371: mol_type = other RNA
caagtacaattagttcaatcaggtgcagaagtaaaaaaaccaggttcctccgttaaagtatcgtgcaaagctagtggaggtacattcaacagatacacagtaaactgggtcagacaagcacctggacaaggactagaatggatgggaggaataatacccatatttggaactgctaattacgcacaaagattccaaggaagattaaccatcacagcagatgaatctacatctacagcctacatggaacttagcagcctaagatcagacgatacagctgtatacttttgcgcacgtgaaaacctagataattcaggaacatattactatttctccggatggtttgacccatggggccaaggtacattagttactgtatcatccgcaaaaacaacagctccttcagtatacccattagctcccgtatgcggagatacaaccggatccagtgtaacactaggatgcctagtcaaaggatacttcccagaaccagtaactctaacctggaactccggatctttatcctccggagttcacacattcccagcagttctacaatcagatttatatacattatcctcatcagtgacagtaacatctagtacatggccatcacaatcaataacatgcaacgtcgcacacccagcatcatcaacaaaagtagataaaaaaatagaaccacgaggaccaacaattaaaccatgcccaccatgtaaatgccccgccccaaatctattaggaggtccatcagtattcatattccctccaaaaataaaagacgtccttatgatatcattaagtccaatagtaacatgcgtagtagtagatgtttcagaagatgacccagacgtacaaatatcatggttcgtcaacaatgtagaagttcatacagcacaaacacaaactcaccgagaagattacaacagcacactaagagtcgtatcagcacttccaatacaacaccaagattggatgtccggaaaagaattcaaatgcaaagtcaacaacaaagatctaccagcaccaatcgaaagaacaatatcaaaaccaaaaggatccgtacgtgctccacaagtttatgtactaccaccaccagaagaagaaatgaccaaaaaacaagtcacacttacatgtatggtaacagacttcatgcccgaagacatatatgtagaatggacaaataacggcaaaactgaattaaactataaaaacacagaaccagtcttagactcagacggatcatatttcatgtattcaaaactaagagtagaaaaaaaaaattgggtcgaaagaaactcatactcatgttcagtagtacatgaaggccttcacaatcatcatacaacaaaaagcttctcaagaactccaggaaaa

SEQ ID NO: 61425 - RNA, 1371 nt, synthetic construct
  misc_feature 1..1371: note = derived and/or modified sequence opt11 from CDS (HC) w/o signal peptide encoded by mRNA R5230
  source 1..1371: mol_type = other RNA
caagtacagctcgtacaatcaggcgccgaagtcaagaaacccggcagctccgtcaaagtctcctgcaaagcctctggaggtacattcaaccgatacacagtcaactgggtccgacaagcccccggccaaggcctcgaatggatgggcggcatcatccccatcttcggaaccgcaaactacgcccaacgattccaaggcagacttaccatcaccgcagacgaatccacctccaccgcttacatggagctatcctccctacgctccgacgacaccgccgtttacttctgcgcccgcgagaacctcgacaactcaggcacctactactacttctccggatggttcgacccctggggacaaggcaccctagtcaccgtcagcagcgccaaaaccaccgccccatcggtctacccactagcccccgtctgcggcgacaccaccggatccagcgtaaccctcggctgcctcgtcaaaggctacttccccgaacccgtcacactaacatggaactctggatcactatcctccggagtccacacctttccagccgtactccaatccgacctctataccctatcatcgtccgtaaccgtcaccagctccacctggccatcccaatccataacctgcaacgtcgcacaccccgcatcctcaaccaaggtcgacaagaaaatcgaaccacgcggcccaacaatcaaaccctgcccaccctgcaaatgccccgcccccaacctcttaggaggcccctccgtcttcatcttcccacccaaaataaaagacgttctaatgatatccctcagccccatcgtcacatgcgtggtagtcgacgtctccgaagacgaccccgatgtacaaatatcctggttcgtaaacaacgtcgaagtccacaccgcccaaacccaaacccaccgtgaggattacaactccaccctgcgagtcgtatccgctctcccaatacaacaccaagactggatgtccggaaaagagttcaaatgcaaagtcaacaacaaagacctccccgcccccatagaacgcaccatctccaaaccaaaaggatccgtccgtgccccacaagtctacgtcctacccccacccgaagaagaaatgacaaagaaacaggtaaccctaacctgcatggtaaccgacttcatgcccgaagacatctacgtcgaatggaccaacaacggaaaaactgaactcaattacaaaaacacggaacccgtactcgactccgacggctcctacttcatgtactccaaactccgcgtagaaaagaaaaactgggtcgaacgcaactcctactcttgcagcgtcgtacacgaaggcttacacaaccaccacacgaccaaatcattctccagaaccccaggcaaa

SEQ ID NO: 61426 - protein, 476 aa, synthetic construct
  REGION 1..476: note = Protein (HC) encoded by mRNA R5230
MKCSWVIFFLMAVVTGVNSQVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 61427 - RNA, 1431 nt, synthetic construct
  misc_feature 1..1431: note = CDS (HC) encoded by mRNA R5230
  source 1..1431: mol_type = other RNA
atgaagtgcagctgggtgatcttcttcctgatggccgtcgtgaccggcgtgaactcccaggtccagctcgtgcagagcggggccgaggtgaagaagcccggctccagcgtcaaggtgtcctgcaaggcgagcgggggcaccttcaaccgctacacggtgaactgggtccggcaggccccggggcagggcctggagtggatgggcgggatcatccccatcttcggcaccgccaactacgcccagcgcttccaggggcggctgaccatcaccgccgacgagtccacgagcaccgcgtacatggagctctccagcctgcgctccgacgacaccgccgtgtacttctgcgcccgggagaacctggacaacagcggcacctactactacttctccgggtggttcgacccctggggccagggcacgctcgtgaccgtcagctccgccaagaccaccgcgcccagcgtgtacccgctggcccccgtgtgcggggacacgaccggctccagcgtcaccctggggtgcctcgtgaagggctacttccccgagcccgtgaccctgacgtggaactccggcagcctgagctccggggtccacaccttcccggccgtgctccagagcgacctgtacaccctgtccagctccgtgaccgtcacgagctccacctggcccagccagtccatcacgtgcaacgtggcccaccccgccagctccaccaaggtggacaagaagatcgagccccgcggcccgacgatcaagccctgcccgccctgcaagtgcccggcgcccaacctcctgggcgggcccagcgtcttcatcttcccgccgaagatcaaggacgtgctgatgatctccctcagccccatcgtgacctgcgtggtggtcgacgtgtccgaggacgaccccgacgtgcagatcagctggttcgtcaacaacgtggaggtgcacaccgcccagacccagacgcaccgggaggactacaactccaccctgcgcgtcgtgagcgccctgcccatccagcaccaggactggatgtccgggaaggagttcaagtgcaaggtgaacaacaaggacctcccggcccccatcgagcggaccatcagcaagccgaagggcagcgtccgcgcgccccaggtgtacgtgctgccgccgcccgaggaggagatgaccaagaagcaggtcacgctgacctgcatggtgaccgacttcatgccggaggacatctacgtggagtggaccaacaacggcaagacggagctcaactacaagaacaccgagcccgtcctggactccgacgggagctacttcatgtactccaagctgcgggtggagaagaagaactgggtggagcgcaacagctactcctgcagcgtcgtgcacgagggcctccacaaccaccacaccaccaagtccttcagccggacccccgggaagtga

SEQ ID NO: 61428 - RNA, 1833 nt, synthetic construct
  misc_feature 1..1833: note = R5230
  source 1..1833: mol_type = other RNA
gggtcccgcagtcggcgtccagcggctctgcttgttcgtgtgtgtgtcgttgcaggccttattcaagcttaccatgaagtgcagctgggtgatcttcttcctgatggccgtcgtgaccggcgtgaactcccaggtccagctcgtgcagagcggggccgaggtgaagaagcccggctccagcgtcaaggtgtcctgcaaggcgagcgggggcaccttcaaccgctacacggtgaactgggtccggcaggccccggggcagggcctggagtggatgggcgggatcatccccatcttcggcaccgccaactacgcccagcgcttccaggggcggctgaccatcaccgccgacgagtccacgagcaccgcgtacatggagctctccagcctgcgctccgacgacaccgccgtgtacttctgcgcccgggagaacctggacaacagcggcacctactactacttctccgggtggttcgacccctggggccagggcacgctcgtgaccgtcagctccgccaagaccaccgcgcccagcgtgtacccgctggcccccgtgtgcggggacacgaccggctccagcgtcaccctggggtgcctcgtgaagggctacttccccgagcccgtgaccctgacgtggaactccggcagcctgagctccggggtccacaccttcccggccgtgctccagagcgacctgtacaccctgtccagctccgtgaccgtcacgagctccacctggcccagccagtccatcacgtgcaacgtggcccaccccgccagctccaccaaggtggacaagaagatcgagccccgcggcccgacgatcaagccctgcccgccctgcaagtgcccggcgcccaacctcctgggcgggcccagcgtcttcatcttcccgccgaagatcaaggacgtgctgatgatctccctcagccccatcgtgacctgcgtggtggtcgacgtgtccgaggacgaccccgacgtgcagatcagctggttcgtcaacaacgtggaggtgcacaccgcccagacccagacgcaccgggaggactacaactccaccctgcgcgtcgtgagcgccctgcccatccagcaccaggactggatgtccgggaaggagttcaagtgcaaggtgaacaacaaggacctcccggcccccatcgagcggaccatcagcaagccgaagggcagcgtccgcgcgccccaggtgtacgtgctgccgccgcccgaggaggagatgaccaagaagcaggtcacgctgacctgcatggtgaccgacttcatgccggaggacatctacgtggagtggaccaacaacggcaagacggagctcaactacaagaacaccgagcccgtcctggactccgacgggagctacttcatgtactccaagctgcgggtggagaagaagaactgggtggagcgcaacagctactcctgcagcgtcgtgcacgagggcctccacaaccaccacaccaccaagtccttcagccggacccccgggaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61429 - protein, 217 aa, synthetic construct
  REGION 1..217: note = Protein (LC) w/o signal peptide encoded by mRNA R5231
QSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKSTPTLTVFPPSSEELKENKATLVCLISNFSPSGVTVAWKANGTPITQGVDTSNPTKEGNKFMASSFLHLTSDQWRSHNSFTCQVTHEGDTVEKSLSPAECL

SEQ ID NO: 61430 - RNA, 651 nt, synthetic construct
  misc_feature 1..651: note = CDS (LC) w/o signal peptide encoded by mRNA R5231
  source 1..651: mol_type = other RNA
cagtccgccctgacccagccccgcagcgtgtccgggagcccgggccagtccgtcaccatcagctgcacggggacctccagcgacatcggcgggtacaacttcgtgtcctggtaccagcagcaccccggcaaggcccccaagctgatgatctacgacgccaccaagcggcccagcggcgtgccggaccgcttctccgggagcaagtccggcaacaccgccagcctcacgatctccgggctgcaggcggaggacgaggccgactactactgctgcagctacgccggcgactacacccccggggtcgtgttcggcggcgggaccaagctgaccgtgctcggccagcccaagagcacgcccaccctgaccgtcttcccgccctccagcgaggagctgaaggagaacaaggccaccctcgtgtgcctgatctccaacttcagcccctccggggtgacggtcgcgtggaaggccaacggcacccccatcacccagggcgtggacaccagcaacccgacgaaggaggggaacaagttcatggcctccagcttcctgcacctcacctccgaccagtggcggagccacaactccttcacgtgccaggtgacccacgagggcgacacggtcgagaagagcctgtcccccgccgagtgcctg

SEQ ID NO: 61431 - RNA, 651 nt, synthetic construct
  misc_feature 1..651: note = derived and/or modified sequence opt2 from CDS (LC) w/o signal peptide encoded by mRNA R5231
  source 1..651: mol_type = other RNA
cagtccgccctcacccagccccgctccgtctccggctcccccggccagtccgtcaccatctcctgcaccggcacctcctccgacatcggcggctacaacttcgtctcctggtaccagcagcaccccggcaaggcccccaagctcatgatctacgacgccaccaagcgcccctccggcgtccccgaccgcttctccggctccaagtccggcaacaccgcctccctcaccatctccggcctccaggccgaggacgaggccgactactactgctgctcctacgccggcgactacacccccggcgtcgtcttcggcggcggcaccaagctcaccgtcctcggccagcccaagtccacccccaccctcaccgtcttccccccctcctccgaggagctcaaggagaacaaggccaccctcgtctgcctcatctccaacttctccccctccggcgtcaccgtcgcctggaaggccaacggcacccccatcacccagggcgtcgacacctccaaccccaccaaggagggcaacaagttcatggcctcctccttcctccacctcacctccgaccagtggcgctcccacaactccttcacctgccaggtcacccacgagggcgacaccgtcgagaagtccctctcccccgccgagtgcctc

SEQ ID NO: 61432 - RNA, 651 nt, synthetic construct
  misc_feature 1..651: note = derived and/or modified sequence opt3 from CDS (LC) w/o signal peptide encoded by mRNA R5231
  source 1..651: mol_type = other RNA
cagagcgccctgacccaacccagatccgtgtctggctcacctgggcagagtgtcacaatcagctgcactggaacgtcctctgacattggtggctacaacttcgtttcgtggtatcagcagcacccagggaaggctccgaaactcatgatatacgatgcaaccaagaggccctcaggagtgcctgaccggtttagcggcagtaaatccggtaatacagcctctcttactatcagcgggctgcaagcggaggatgaagctgactattactgttgctcctatgccggagattacaccccaggcgtagtgttcggcgggggaacaaagttgaccgtcttaggtcagcccaaatcaactcctacactgaccgtgtttccacccagtagcgaggaactaaaggagaacaaggcaacgctcgtttgtctgatttctaatttctccccttcaggcgtgactgtcgcctggaaagctaacgggaccccaatcacacagggagtggacactagcaatccgaccaaggaaggcaacaaatttatggcaagttctttccttcatctgacatccgatcagtggcgcagccacaattcgtttacctgccaagtaacgcatgagggtgacactgttgagaagtctttgtcccccgccgaatgtctc

SEQ ID NO: 61433 - RNA, 651 nt, synthetic construct
  misc_feature 1..651: note = derived and/or modified sequence opt4 from CDS (LC) w/o signal peptide encoded by mRNA R5231
  source 1..651: mol_type = other RNA
cagagcgccctgacccagcccagaagcgtgagcggcagccccggccagagcgtgaccatcagctgcaccggcaccagcagcgacatcggcggctacaacttcgtgagctggtaccagcagcaccccggcaaggcccccaagctgatgatctacgacgccaccaagagacccagcggcgtgcccgacagattcagcggcagcaagagcggcaacaccgccagcctgaccatcagcggcctgcaggccgaggacgaggccgactactactgctgcagctacgccggcgactacacccccggcgtggtgttcggcggcggcaccaagctgaccgtgctgggccagcccaagagcacccccaccctgaccgtgttcccccccagcagcgaggagctgaaggagaacaaggccaccctggtgtgcctgatcagcaacttcagccccagcggcgtgaccgtggcctggaaggccaacggcacccccatcacccagggcgtggacaccagcaaccccaccaaggagggcaacaagttcatggccagcagcttcctgcacctgaccagcgaccagtggagaagccacaacagcttcacctgccaggtgacccacgagggcgacaccgtggagaagagcctgagccccgccgagtgcctg

SEQ ID NO: 61434 - RNA, 651 nt, synthetic construct
  misc_feature 1..651: note = derived and/or modified sequence opt5 from CDS (LC) w/o signal peptide encoded by mRNA R5231
  source 1..651: mol_type = other RNA
cagagcgccctgacccaacccagatccgtgtctggcagccctgggcagtccgtcacaatctcttgcacgggaaccagctccgacattggcgggtacaacttcgtttcttggtatcagcagcacccgggaaaggctcccaaactcatgatctacgatgccacaaagcggcctagcggcgtgcccgaccgcttttccgggagcaaatctggaaataccgcgtccctgacaattagcggccttcaagctgaggatgaagccgactattactgttgctcttatgccggcgattacacccctggggtggtcttcggaggcgggacaaagctgaccgtgctcggacagcccaaatccacgcctaccctgacagtttttccgcccagctctgaggaacttaaggagaacaaggctaccctggtgtgtctcatctccaatttcagcccttccggcgtcacagtggcctggaaagctaacgggacccccattacgcagggagttgacacatctaatcctaccaaggaaggcaacaaatttatggccagctccttcctgcatctgacaagcgatcagtggagatctcacaattcctttacctgccaagtgacccatgagggcgacacagtcgaaaagagcctctctcccgcggagtgtctg

SEQ ID NO: 61435 - RNA, 651 nt, synthetic construct
  misc_feature 1..651: note = derived and/or modified sequence opt6 from CDS (LC) w/o signal peptide encoded by mRNA R5231
  source 1..651: mol_type = other RNA
caatcagcactaacacaaccaagatcagtatcaggatcaccaggacaatccgttacaatatcatgcacaggaacatcatcagacataggaggatacaacttcgtatcatggtaccaacaacacccaggaaaagcaccaaaattaatgatctacgacgcaaccaaaagaccatcaggagtaccagacagattttccggatcaaaatcaggaaacacagcatcactaacaatatccggactacaagcagaagacgaagcagactattactgctgctcatacgcaggagactacaccccaggagtagtattcggaggaggcacaaaactaacagtactaggacaaccaaaatctactccaaccctaacagtattcccaccatcttccgaagaactaaaagaaaataaagcaacattagtatgcttaatctcaaacttctcaccatctggagtaacagtagcatggaaagcaaacggaaccccaataacacaaggagtagacacatccaacccaacaaaagaaggaaacaaattcatggcatcatcattcctacacctaacatcagaccaatggagatcacacaactcattcacatgccaagtaacacacgaaggcgacacagtagaaaaatcattatcaccagcagaatgccta

SEQ ID NO: 61436 - RNA, 651 nt, synthetic construct
  misc_feature 1..651: note = derived and/or modified sequence opt11 from CDS (LC) w/o signal peptide encoded by mRNA R5231
  source 1..651: mol_type = other RNA
caatccgccctcacccaaccccgctccgtctccggctcacccggacaatccgtaaccatctcctgcaccggaacctcctccgacatcggcggatacaacttcgtctcctggtaccaacaacaccccggcaaagcccccaaactcatgatctacgacgccaccaaacgcccctccggcgtccccgaccgattctccggctcaaaatccggcaacaccgcctcactaaccatctccggcctccaagcagaagacgaagccgactattactgctgctcctacgccggcgactacacccccggagtagtcttcggaggcggcaccaaactcacagtcttaggccaacccaaatcaacccccaccctcaccgtcttccccccctcctccgaagaactcaaagaaaacaaagccaccctcgtctgcctcatctccaacttctccccctccggcgtcacagtcgcctggaaagcaaacggtacacccataacccaaggcgtcgacacctccaaccccaccaaagaaggcaacaaattcatggcctcctccttcctccacctcacctccgaccaatggcgctcacacaactccttcacctgccaagtcacccacgaaggcgacaccgtagaaaaatctctctcccccgccgaatgccta

SEQ ID NO: 61437 - protein, 236 aa, synthetic construct
  REGION 1..236: note = Protein (LC) encoded by mRNA R5231
MAWISLILSLLALSSGAISQSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKSTPTLTVFPPSSEELKENKATLVCLISNFSPSGVTVAWKANGTPITQGVDTSNPTKEGNKFMASSFLHLTSDQWRSHNSFTCQVTHEGDTVEKSLSPAECL

SEQ ID NO: 61438 - RNA, 711 nt, synthetic construct
  misc_feature 1..711: note = CDS (LC) encoded by mRNA R5231
  source 1..711: mol_type = other RNA
atggcctggatcagcctgatcctctccctgctggccctcagctccggcgcgatcagccagtccgccctgacccagccccgcagcgtgtccgggagcccgggccagtccgtcaccatcagctgcacggggacctccagcgacatcggcgggtacaacttcgtgtcctggtaccagcagcaccccggcaaggcccccaagctgatgatctacgacgccaccaagcggcccagcggcgtgccggaccgcttctccgggagcaagtccggcaacaccgccagcctcacgatctccgggctgcaggcggaggacgaggccgactactactgctgcagctacgccggcgactacacccccggggtcgtgttcggcggcgggaccaagctgaccgtgctcggccagcccaagagcacgcccaccctgaccgtcttcccgccctccagcgaggagctgaaggagaacaaggccaccctcgtgtgcctgatctccaacttcagcccctccggggtgacggtcgcgtggaaggccaacggcacccccatcacccagggcgtggacaccagcaacccgacgaaggaggggaacaagttcatggcctccagcttcctgcacctcacctccgaccagtggcggagccacaactccttcacgtgccaggtgacccacgagggcgacacggtcgagaagagcctgtcccccgccgagtgcctgtga

SEQ ID NO: 61439 - RNA, 1113 nt, synthetic construct
  misc_feature 1..1113: note = R5231
  source 1..1113: mol_type = other RNA
gggtcccgcagtcggcgtccagcggctctgcttgttcgtgtgtgtgtcgttgcaggccttattcaagcttaccatggcctggatcagcctgatcctctccctgctggccctcagctccggcgcgatcagccagtccgccctgacccagccccgcagcgtgtccgggagcccgggccagtccgtcaccatcagctgcacggggacctccagcgacatcggcgggtacaacttcgtgtcctggtaccagcagcaccccggcaaggcccccaagctgatgatctacgacgccaccaagcggcccagcggcgtgccggaccgcttctccgggagcaagtccggcaacaccgccagcctcacgatctccgggctgcaggcggaggacgaggccgactactactgctgcagctacgccggcgactacacccccggggtcgtgttcggcggcgggaccaagctgaccgtgctcggccagcccaagagcacgcccaccctgaccgtcttcccgccctccagcgaggagctgaaggagaacaaggccaccctcgtgtgcctgatctccaacttcagcccctccggggtgacggtcgcgtggaaggccaacggcacccccatcacccagggcgtggacaccagcaacccgacgaaggaggggaacaagttcatggcctccagcttcctgcacctcacctccgaccagtggcggagccacaactccttcacgtgccaggtgacccacgagggcgacacggtcgagaagagcctgtcccccgccgagtgcctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61440 - protein, 457 aa, synthetic construct
  REGION 1..457: note = Protein (HC) w/o signal peptide encoded by mRNA R3996, R3998, R4000, R4002, R4004, R4012, R4112, R4114, R4530, R4531, R4633, R4639
EVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61441 - protein, 215 aa, synthetic construct
  REGION 1..215: note = Protein (LC) w/o signal peptide encoded by mRNA R3996, R3998, R4000, R4002, R4004, R4012, R4112, R4114, R4530, R4531, R4633, R4639
EIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61442 - RNA, 1371 nt, synthetic construct
  misc_feature 1..1371: note = CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaag

SEQ ID NO: 61443 - RNA, 645 nt, synthetic construct
  misc_feature 1..645: note = CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgc

SEQ ID NO: 61444 - RNA, 1371 nt, synthetic construct
  misc_feature 1..1371: note = derived and/or modified sequence opt2 from CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaggtccagctcgtcgagaccggcggcggcctcgtccagcccggccgctccctccgcctctcctgcgccgcctccggcttctccttcgacgagtacaccatgcactgggtccgccaggcccccggcaagggcctcgagtgggtcgccggcatcaactggaagggcaacttcatgggctacgccgactccgtccagggccgcttcaccatctcccgcgacaacggcaagaactccctctacctccagatgaactccctccgcgccgaggacaccgccctctactactgcgccaaggaccgcctcgagtcctccgccatggacatcctcgagggcggcaccttcgacatctggggccagggcaccatggtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61445 - RNA, 645 nt, synthetic construct
  misc_feature 1..645: note = derived and/or modified sequence opt2 from CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gagatcgtcctcacccagtcccccggcaccctctccctctcccccggcgagcgcgccaccctctcctgccgcgcctcccagtccgtctcctcctcctacctcgcctggtaccagcagaagcccggccaggccccccgcctcctcatctacggcgcctccacccgcgccaccggcatccccgcccgcttctccggctccggctccggcaccgacttcaccctcaccatctcccgcctcgagcccgaggacctcgccgtctactactgccagcagtacggctcctccccctggaccttcggccagggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61446 - RNA, 1371 nt, synthetic construct
  misc_feature 1..1371: note = derived and/or modified sequence opt3 from CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaggtgcagctggtcgaaaccggcgggggactcgttcaacccggtagaagccttaggctgtcctgcgccgcttctggcttctcatttgacgagtacacaatgcactgggtgcggcaggcacctgggaagggattggaatgggtagccggcatcaactggaaaggtaatttcatggggtatgcggatagtgtgcagggacgctttactattagccgagacaacggcaaaaattccttatacctgcagatgaactctctacgtgctgaggatacggccctctattactgtgcaaaggacagactggaatcgtcagccatggatatacttgagggcgggaccttcgacatctggggacaaggtacaatggtcactgtgagcagtgcttccaccaagggcccatctgtttttccgctggcacccagctccaaatcaacaagtgggggaaccgccgctttgggctgcctcgtgaaggattatttccctgagccagtcactgtgagctggaactctggtgccctgacatccggggtacatacctttcccgcggttctgcagtcaagcggactctacagtttatcttccgtggtcacggtgcctagctcgtctctgggcactcagacctatatttgtaatgtgaatcacaagccatccaacacaaaagtcgacaagaaagttgaacccaagtcatgcgataaaactcatacctgtcctccatgcccggcacccgagcttttgggcgggcctagtgtgttcctgtttccacccaagcctaaggacacactaatgatcagcaggaccccagaagtaacgtgtgtggtcgtggatgtttcccacgaggaccccgaggtgaaattcaattggtacgtcgatggagtggaagtacataacgccaagactaaaccgcgggaggaacagtacaattctacatatcgcgttgtgagcgtcctcaccgtgctgcaccaagactggcttaacggtaaggagtacaaatgcaaggtctcaaataaagctctgcctgcccccattgaaaagactatcagtaaggcaaaaggccagccaagagagcctcaggtgtatacattgcccccatccagggacgagctcaccaagaaccaggttagcctgacgtgtttagtgaaagggttttacccctctgatatagctgtagaatgggagtcaaatggacaacctgaaaacaactataagaccacaccaccggtcctggacagtgatggcagcttctttctctactccaaacttactgtggacaagtctcggtggcagcagggtaatgttttctcgtgcagcgtgatgcacgaggccctgcataaccactatacccaaaagtccttgtcactaagtcccgggaaa

SEQ ID NO: 61447 - RNA, 645 nt, synthetic construct
  misc_feature 1..645: note = derived and/or modified sequence opt3 from CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gagatcgtgctgacccagagccccggcacactctccctttctcctggggaaagagccactctgtcatgcagggctagtcaaagcgtctcctcttcgtacttggcatggtatcagcagaagccaggacaggccccgcggttactgatttacggtgcgtcaacgcgcgctaccggcatacccgcccgattcagcgggagtggatccggcacagactttactctaaccatctctcgtctcgagcctgaagatctggcagtttattactgtcaacagtatggtagctccccatggacattcgggcagggaaccaaagtggagattaagagaactgtagccgctccctcagtgtttatcttccctccaagtgacgaacagcttaaaagcggcacagcatctgtcgtgtgcctgttgaacaatttttaccccagggaggccaaggttcaatggaaagtggataacgctctccagtccggcaattcacaggagagcgtcaccgaacaggacagtaaggattctacgtattccctgagctcgactctgaccctctctaaggccgactacgagaaacacaaggtgtacgcgtgtgaagtaacacatcaagggttatcctcacctgttactaaaagtttcaaccggggagagtgc

SEQ ID NO: 61448 - RNA, 1371 nt, synthetic construct
  misc_feature 1..1371: note = derived and/or modified sequence opt4 from CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaggtgcagctggtggagaccggcggcggcctggtgcagcccggcagaagcctgagactgagctgcgccgccagcggcttcagcttcgacgagtacaccatgcactgggtgagacaggcccccggcaagggcctggagtgggtggccggcatcaactggaagggcaacttcatgggctacgccgacagcgtgcagggcagattcaccatcagcagagacaacggcaagaacagcctgtacctgcagatgaacagcctgagagccgaggacaccgccctgtactactgcgccaaggacagactggagagcagcgccatggacatcctggagggcggcaccttcgacatctggggccagggcaccatggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61449 - RNA, 645 nt, synthetic construct
  misc_feature 1..645: note = derived and/or modified sequence opt4 from CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcaccagagccaccggcatccccgccagattcagcggcagcggcagcggcaccgacttcaccctgaccatcagcagactggagcccgaggacctggccgtgtactactgccagcagtacggcagcagcccctggaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61450 - RNA, 1371 nt, synthetic construct
  misc_feature 1..1371: note = derived and/or modified sequence opt5 from CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaggtgcagctggtcgaaaccggcgggggactcgttcaacccggcagaagcctgcggctttcctgcgccgcttctgggttcagctttgacgagtacacaatgcactgggtgcgccaggcccctggaaagggcctggaatgggtggcggggatcaactggaaaggaaatttcatgggctatgctgattccgtccagggcagatttacgatttctcgggacaacgggaagaatagcctctacctgcagatgaactcccttcgcgccgaggataccgccctgtattactgtgctaaagacagactcgaatctagcgccatggatatcctggagggaggcacattcgacatttgggggcaaggaaccatggtgacagtttccagcgcttctaccaagggcccgtccgtgtttcccctggcccctagctctaaatccacaagcgggggaaccgcggccctcggctgcctggtcaaggattatttccccgagcctgtgacggtttcttggaactccggcgctcttaccagcggggtgcatacatttcccgccgtcctgcagtcctctggactctacagcctgtccagcgtggtgaccgtcccttcttccagccttggcacacagacctatatctgtaatgttaatcacaagccgtctaacacgaaagtggacaagaaagtggaacccaagagctgcgataaaacacatacctgtcctccctgccctgctcccgagctgctcgggggaccgtccgtcttcctgtttcctcccaagcctaaggacacactgatgatttctcggacccccgaagtgacctgtgttgtggtcgatgtgagccacgaggaccccgaggttaaattcaattggtacgtggatggcgtcgaagtgcataacgccaagacaaaacctcgcgaggaacagtacaattccacgtatagagtcgtgagcgttctcaccgtgctgcaccaagactggcttaacgggaaggagtacaaatgcaaggtctctaataaagcgctgccggcccccatcgaaaagacaatctccaaggctaaaggacagcctcgggagccccaggtgtataccctccctcccagccgcgacgagctgacaaagaaccaggtttctcttacctgtctggtgaaaggcttttacccgtccgatattgccgtcgaatgggagagcaatggccaacctgaaaacaactataagacgacaccccctgtgctcgactccgatgggtctttctttctgtacagcaaactgaccgtggacaagtccagatggcagcagggaaatgttttctcttgcagcgtcatgcacgaggctctccataaccactatacccaaaagtccctgagcctttctcccggcaaa

SEQ ID NO: 61451 - RNA, 645 nt, synthetic construct
  misc_feature 1..645: note = derived and/or modified sequence opt5 from CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagcaccagagccacagggatccctgcccggttctccggaagcggctctgggaccgactttacacttaccatttcccgcctggagcccgaagatctcgctgtttattactgtcaacagtatggaagctctccttggacattcggccagggcaccaaagtggagatcaagagaacggtggccgctccctccgtctttattttccctccgagcgacgaacagctgaaatctgggaccgcctccgtggtttgcctgctcaacaatttttacccccgggaggcgaaggtgcaatggaaagtcgataacgccctgcagagcggaaattcccaggagtctgtgacagaacaggacagcaaggattccacctatagcctttcttccacactgaccctcagcaaggctgactacgagaaacacaaggtttacgcctgtgaagtgacgcatcaaggcctgtctagccctgtcacaaaatccttcaaccgcggggagtgc

SEQ ID NO: 61452 - RNA, 1371 nt, synthetic construct
  misc_feature 1..1371: note = derived and/or modified sequence opt6 from CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaagtacaacttgtagaaacaggaggtggacttgtccaaccaggcagaagtctaagactttcttgcgcagcatctggattttcatttgatgaatacacaatgcactgggttagacaagcacccggaaaaggactagaatgggttgctggaataaactggaaaggaaattttatgggatatgcagactcagtacaaggccgtttcaccatttccagagataatggaaaaaacagtctttacttacaaatgaattcactaagagccgaagacacagcattatattactgtgcaaaagatagactagaatcaagcgctatggacatactagaaggaggaacatttgacatatggggacaaggaacaatggtaacagtcagttcagcatcaacaaaaggaccatcagtatttcctttagccccatcctcaaaatctacatccggaggaaccgcagcattaggttgtctagtaaaagattactttccagaaccagtaacagtatcctggaatagtggcgcattaacatccggtgtacatacatttccagcagtactacaatcatcagggttgtactcactatcatcagttgtaacagttccatcatcatccctaggaacacaaacatacatatgtaacgtaaaccataaaccatcaaatacaaaagtcgataaaaaagtcgaaccaaaatcatgtgataaaacacacacttgtcccccatgtccagcaccagaactcttaggaggaccatcagtattcctatttcctccaaaaccaaaagacacattaatgatctcaagaacaccagaagtaacatgtgtagtcgttgacgtctcacatgaagatccagaagtaaaatttaactggtatgtcgatggtgtcgaagttcataatgcaaaaactaaaccaagagaagaacaatataactcaacttaccgtgttgtatcagtattaactgtcctacatcaagactggttaaacggtaaagaatacaaatgcaaagtaagcaataaagcactaccagcaccaattgaaaaaaccatttcaaaagcaaaaggacaaccaagagaaccgcaagtatatacattacctccatcacgagatgaattaacaaaaaatcaagtaagtctaacatgcctagtaaaaggattttatccatccgacatagctgtagaatgggaaagcaatggccaaccagaaaacaattataaaacaaccccacccgtattagattccgatggatcattttttttatattctaaactcacggttgataaatcacgatggcaacaaggaaacgtattttcatgctctgtaatgcacgaagcattacacaaccactatacacaaaaatctctatcactatcaccaggtaaa

SEQ ID NO: 61453 - RNA, 645 nt, synthetic construct
  misc_feature 1..645: note = derived and/or modified sequence opt6 from CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gaaatagtactaacacaatcaccaggaacactatcactatcaccaggagaaagagcaacactatcatgcagagcatcacaatcagtatcttcatcatacctagcatggtaccaacaaaaaccaggacaagccccaagactactaatctacggagcatctacaagagcaacaggaataccagcaagattctcaggttcaggatcaggaacagactttacactaacaatatcaagattagaaccagaagacctagcagtatactactgccaacaatatggatcatcaccatggacatttggacaaggaacaaaagtagaaataaaaagaacagtagcagcaccatcagtattcatattcccaccatcagacgaacaactaaaatctggaacagcatcagtagtatgtttactaaacaacttctacccaagagaagcaaaagtacaatggaaagtagacaacgcactccaatcaggaaactcccaagaatcagtaacagaacaagactccaaagactcaacatactcactaagctcaacactaacattatccaaagcagactacgaaaaacacaaagtatacgcatgcgaagtaactcaccaaggactctcatcaccagtaactaaatcattcaacagaggagaatgc

SEQ ID NO: 61454 - RNA, 1371 nt, synthetic construct
  misc_feature 1..1371: note = derived and/or modified sequence opt11 from CDS (HC) w/o signal peptide as RNA from mRNA R3996, R3998, R4000, R4002, R4004, R4012, R4112, R4114, R4530, R4531, R4633, R4639
  source 1..1371: mol_type = other RNA
gaagttcaactcgtcgaaaccggcggaggacttgtccaacccggacgcagcctccgcctctcctgcgccgcctcaggattctccttcgacgagtacaccatgcactgggtccgccaagcccccggcaaaggcctagaatgggttgccggcatcaactggaaaggcaacttcatgggatacgccgactcagtacaaggccgcttcaccataagccgcgacaacggcaaaaactcactatatctacaaatgaactccctacgcgctgaagacaccgccctctactactgcgccaaagaccgactcgaatcctccgcaatggacatcctcgaaggcggcacattcgacatatggggacaaggaaccatggtcaccgtctcctcagcctcgaccaagggcccatccgtcttccccctagccccgtcctctaaatcaacctccggcggaaccgccgccctgggctgcctcgtcaaagactacttccccgaacccgtaaccgtcagctggaactccggagcactcacctccggcgtccacaccttcccagccgtgctccaatcaagcggcctctactcgctctcatcagtcgtaaccgtcccctcctcgtcactcggcacccaaacctacatctgcaacgtaaaccacaaaccctccaacacaaaagtcgacaagaaagtcgaaccaaaatcctgcgacaaaacccacacatgcccaccctgccccgcacccgaactccttggcggcccctccgtattcctctttcccccaaaacccaaagacactctcatgataagccgaacccccgaagtaacctgcgtcgtcgtcgacgtctcccatgaagaccccgaagtcaaattcaactggtacgtcgacggcgtcgaagtccacaacgccaaaaccaagccccgcgaagaacaatacaactccacctaccgcgtagtctcagtcctcaccgtcctccaccaagactggctcaacggcaaagaatacaaatgcaaagtctccaacaaagccctccccgccccaatcgagaaaaccatatccaaagcaaaaggccaaccacgcgaaccacaagtctacaccctaccacccagccgcgacgaactcaccaaaaaccaagtctccctaacgtgcctagtcaaaggcttctacccctccgacatcgccgtcgaatgggaatcaaatggacaacccgaaaataactacaaaacaactcccccagttctagacagcgacggctcattcttcctctacagcaaactcaccgtcgacaaaagccgctggcaacaaggcaacgtcttctcctgctccgtcatgcacgaagcactccataaccactacacccagaaaagcctatcactctccccaggaaaa

SEQ ID NO: 61455 - RNA, 645 nt, synthetic construct
  misc_feature 1..645: note = derived and/or modified sequence opt11 from CDS (LC) w/o signal peptide as RNA from mRNA R3996, R3998, R4000, R4002, R4004, R4012, R4112, R4114, R4530, R4531, R4633, R4639
  source 1..645: mol_type = other RNA
gaaatagtcctcacccaatcccccggcaccctctccctctcccccggcgaacgcgccaccctttcctgccgcgcatcccaatccgtctcatcctcctacctcgcctggtaccaacaaaaacccggccaagccccccgcctcctaatctacggcgcctccacccgcgcaaccggcatccccgcccgcttctccggctcaggctccggcacagacttcactctaaccatctcccgcctcgaacccgaagacctcgccgtctactactgccaacaatacggctcctcaccctggaccttcggccaaggcaccaaagtcgaaatcaaacgcacagtcgccgccccctccgtcttcatattccccccctccgacgaacaactcaaatccggaaccgcctccgtcgtctgcctactcaacaacttctacccccgcgaagcaaaagtacaatggaaagtcgacaacgcactccaatccggcaactcccaagaatctgtcaccgaacaagactcaaaagactccacctactccctatcctccacactcaccctctcaaaagcagactacgaaaaacacaaagtctacgcctgcgaagtcacccaccaaggcctatcctcccccgtcaccaaatctttcaaccgcggagaatgc

SEQ ID NO: 61456 - protein, 476 aa, synthetic construct
  REGION 1..476: note = Protein 1 (HC) encoded by mRNA R3996, R4112, R4530, R4633, R4639
MELGLSWIFLLAILKGVQCEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61457 - protein, 235 aa, synthetic construct
  REGION 1..235: note = Protein 2 (LC) encoded by mRNA R3996, R4114, R4531, R4633, R4639
METPAQLLFLLLLWLPDTTGEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61458 - RNA, 1431 nt, synthetic construct
  misc_feature 1..1431: note = CDS 1 (HC) as RNA from mRNA R3996, R4112, R4530, R4633, R4639
  source 1..1431: mol_type = other RNA
atggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtga

SEQ ID NO: 61459 - RNA, 708 nt, synthetic construct
  misc_feature 1..708: note = CDS 2 (LC) as RNA from mRNA R3996, R4114, R4531, R4633, R4639
  source 1..708: mol_type = other RNA
atggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61460 - RNA, 1635 nt, synthetic construct
  misc_feature 1..1635: note = R4112
  source 1..1635: mol_type = other RNA
gggagaaagcttaccatggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61461 - RNA, 1833 nt, synthetic construct
  misc_feature 1..1833: note = R4530
  source 1..1833: mol_type = other RNA
gggtcccgcagtcggcgtccagcggctctgcttgttcgtgtgtgtgtcgttgcaggccttattcaagcttaccatggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61462 - RNA, 912 nt, synthetic construct
  misc_feature 1..912: note = R4114
  source 1..912: mol_type = other RNA
gggagaaagcttaccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61463 - RNA, 1110 nt, synthetic construct
  misc_feature 1..1110: note = R4531
  source 1..1110: mol_type = other RNA
gggtcccgcagtcggcgtccagcggctctgcttgttcgtgtgtgtgtcgttgcaggccttattcaagcttaccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61464 - RNA, 2810 nt, synthetic construct
  misc_feature 1..2810: note = CDS (HC)-IRES-CDS (LC) as RNA from mRNA R3996, R4633
  source 1..2810: mol_type = other RNA
atggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61465 - RNA, 3002 nt, synthetic construct
  misc_feature 1..3002: note = R3996
  source 1..3002: mol_type = other RNA
gggagaaagcttaccatggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61466 - RNA, 3212 nt, synthetic construct
  misc_feature 1..3212: note = R4633
  source 1..3212: mol_type = other RNA
gggtcccgcagtcggcgtccagcggctctgcttgttcgtgtgtgtgtcgttgcaggccttattcaagcttaccatggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61467 - RNA, 2202 nt, synthetic construct
  misc_feature 1..2202: note = CDS (HC)-F2A-CDS (LC) as RNA from mRNA R4639
  source 1..2202: mol_type = other RNA
atggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaaggtgaagcagacactcaatttcgaccttctgaagttggctggagatgttgagtctaacccaggccccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61468 - RNA, 2604 nt, synthetic construct
  misc_feature 1..2604: note = R4639
  source 1..2604: mol_type = other RNA
gggtcccgcagtcggcgtccagcggctctgcttgttcgtgtgtgtgtcgttgcaggccttattcaagcttaccatggagctgggcctcagctggatcttcctgctggccatcctcaagggggtgcagtgcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaaggtgaagcagacactcaatttcgaccttctgaagttggctggagatgttgagtctaacccaggccccatggagacccccgcccagctgctcttcctgctgctcctgtggctgccggacaccacgggcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61469 - protein, 478 aa, synthetic construct
  REGION 1..478: note = Protein 1 (HC) encoded by mRNA R3998
MDAMKRGLCCVLLLCGAVFVSEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61470 - protein, 236 aa, synthetic construct
  REGION 1..236: note = Protein 2 (LC) encoded by mRNA R3998
MDAMKRGLCCVLLLCGAVFVSEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61471 - RNA, 1437 nt, synthetic construct
  misc_feature 1..1437: note = CDS 1 (HC) as RNA from mRNA R3998
  source 1..1437: mol_type = other RNA
atggacgccatgaagcgcggcctgtgctgcgtgctcctgctgtgcggggccgtcttcgtgagcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtga

SEQ ID NO: 61472 - RNA, 711 nt, synthetic construct
  misc_feature 1..711: note = CDS 2 (LC) as RNA from mRNA R3998
  source 1..711: mol_type = other RNA
atggacgccatgaagcgcggcctgtgctgcgtgctcctgctgtgcggggccgtcttcgtgagcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61473 - RNA, 2819 nt, synthetic construct
  misc_feature 1..2819: note = CDS (HC)-IRES-CDS (LC) as RNA from mRNA R3998
  source 1..2819: mol_type = other RNA
atggacgccatgaagcgcggcctgtgctgcgtgctcctgctgtgcggggccgtcttcgtgagcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggacgccatgaagcgcggcctgtgctgcgtgctcctgctgtgcggggccgtcttcgtgagcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61474 - RNA, 3011 nt, synthetic construct
  misc_feature 1..3011: note = R3998
  source 1..3011: mol_type = other RNA
gggagaaagcttaccatggacgccatgaagcgcggcctgtgctgcgtgctcctgctgtgcggggccgtcttcgtgagcgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggacgccatgaagcgcggcctgtgctgcgtgctcctgctgtgcggggccgtcttcgtgagcgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61475 - protein, 475 aa, synthetic construct
  REGION 1..475: note = Protein 1 (HC) encoded by mRNA R4000
MKWVTFISLLFLFSSAYSEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61476 - protein, 233 aa, synthetic construct
  REGION 1..233: note = Protein 2 (LC) encoded by mRNA R4000
MKWVTFISLLFLFSSAYSEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61477 - RNA, 1428 nt, synthetic construct
  misc_feature 1..1428: note = CDS 1 (HC) as RNA from mRNA R4000
  source 1..1428: mol_type = other RNA
atgaagtgggtgaccttcatcagcctgctcttcctgttctccagcgcctactccgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtga

SEQ ID NO: 61478 - RNA, 702 nt, synthetic construct
  misc_feature 1..702: note = CDS 2 (LC) as RNA from mRNA R4000
  source 1..702: mol_type = other RNA
atgaagtgggtgaccttcatcagcctgctcttcctgttctccagcgcctactccgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61479 - RNA, 2801 nt, synthetic construct
  misc_feature 1..2801: note = CDS (HC)-IRES-CDS (LC) as RNA from mRNA R4000
  source 1..2801: mol_type = other RNA
atgaagtgggtgaccttcatcagcctgctcttcctgttctccagcgcctactccgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatgaagtgggtgaccttcatcagcctgctcttcctgttctccagcgcctactccgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61480 - RNA, 2993 nt, synthetic construct
  misc_feature 1..2993: note = R4000
  source 1..2993: mol_type = other RNA
gggagaaagcttaccatgaagtgggtgaccttcatcagcctgctcttcctgttctccagcgcctactccgaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatgaagtgggtgaccttcatcagcctgctcttcctgttctccagcgcctactccgagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61481 - protein, 482 aa, synthetic construct
  REGION 1..482: note = Protein 1 (HC) encoded by mRNA R4002
MAVMAPRTLVLLLSGALALTQTWAGEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61482 - protein, 240 aa, synthetic construct
  REGION 1..240: note = Protein 2 (LC) encoded by mRNA R4002
MAVMAPRTLVLLLSGALALTQTWAGEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61483 - RNA, 1449 nt, synthetic construct
  misc_feature 1..1449: note = CDS 1 (HC) as RNA from mRNA R4002
  source 1..1449: mol_type = other RNA
atggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtga

SEQ ID NO: 61484 - RNA, 723 nt, synthetic construct
  misc_feature 1..723: note = CDS 2 (LC) as RNA from mRNA R4002
  source 1..723: mol_type = other RNA
atggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61485 - RNA, 2633 nt, synthetic construct
  misc_feature 1..2633: note = CDS (HC)-IRES-CDS (LC) as RNA from mRNA R4002
  source 1..2633: mol_type = other RNA
atggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgaagcaggtttccccaactgacacaaaacgtgcaacttgaaactccgcctggtctttccaggtctagaggggtaacactttgtactgcgtttggctccacgctcgatccactggcgagtgttagtaacagcactgttgcttcgtagcggagcatgacggccgtgggaactcctccttggtaacaaggacccacggggccaaaagccacgcccacacgggcccgtcatgtgtgcaaccccagcacggcgactttactgcgaaacccactttaaagtgacattgaaactggtacccacacactggtgacaggctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaaagaccctatggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61486 - RNA, 2837 nt, synthetic construct
  misc_feature 1..2837: note = R4002
  source 1..2837: mol_type = other RNA
gggagaaagcttaccatggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgaagcaggtttccccaactgacacaaaacgtgcaacttgaaactccgcctggtctttccaggtctagaggggtaacactttgtactgcgtttggctccacgctcgatccactggcgagtgttagtaacagcactgttgcttcgtagcggagcatgacggccgtgggaactcctccttggtaacaaggacccacggggccaaaagccacgcccacacgggcccgtcatgtgtgcaaccccagcacggcgactttactgcgaaacccactttaaagtgacattgaaactggtacccacacactggtgacaggctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaaagaccctatggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61487 - protein, 240 aa, synthetic construct; identical to SEQ ID NO: 61482
  REGION 1..240: note = Protein 1 (LC) encoded by mRNA R4004

SEQ ID NO: 61488 - protein, 482 aa, synthetic construct; identical to SEQ ID NO: 61481
  REGION 1..482: note = Protein 2 (HC) encoded by mRNA R4004

SEQ ID NO: 61489 - RNA, 723 nt, synthetic construct; identical to SEQ ID NO: 61484
  misc_feature 1..723: note = CDS 1 (LC) as RNA from mRNA R4004
  source 1..723: mol_type = other RNA

SEQ ID NO: 61490 - RNA, 1449 nt, synthetic construct; identical to SEQ ID NO: 61483
  misc_feature 1..1449: note = CDS 2 (HC) as RNA from mRNA R4004
  source 1..1449: mol_type = other RNA

SEQ ID NO: 61491 - RNA, 2843 nt, synthetic construct
  misc_feature 1..2843: note = CDS (LC)-IRES-CDS (HC) as RNA from mRNA R4004
  source 1..2843: mol_type = other RNA
atggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtga

SEQ ID NO: 61492 - RNA, 3035 nt, synthetic construct
  misc_feature 1..3035: note = R4004
  source 1..3035: mol_type = other RNA
gggagaaagcttaccatggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61493 - protein, 482 aa, synthetic construct; identical to SEQ ID NO: 61481
  REGION 1..482: note = Protein 1 (HC) encoded by mRNA R4012

SEQ ID NO: 61494 - protein, 240 aa, synthetic construct; identical to SEQ ID NO: 61482
  REGION 1..240: note = Protein 2 (LC) encoded by mRNA R4012

SEQ ID NO: 61495 - RNA, 1449 nt, synthetic construct; identical to SEQ ID NO: 61483
  misc_feature 1..1449: note = CDS 1 (HC) as RNA from mRNA R4012
  source 1..1449: mol_type = other RNA

SEQ ID NO: 61496 - RNA, 723 nt, synthetic construct; identical to SEQ ID NO: 61484
  misc_feature 1..723: note = CDS 2 (LC) as RNA from mRNA R4012
  source 1..723: mol_type = other RNA

SEQ ID NO: 61497 - RNA, 2843 nt, synthetic construct
  misc_feature 1..2843: note = CDS (HC)-IRES-CDS (LC) as RNA from mRNA R4004
  source 1..2843: mol_type = other RNA
atggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctga

SEQ ID NO: 61498 - RNA, 3035 nt, synthetic construct
  misc_feature 1..3035: note = R4012
  source 1..3035: mol_type = other RNA
gggagaaagcttaccatggccgtgatggccccgcggaccctggtcctcctgctgagcggcgcgctcgccctgacccagacgtgggccggggaggtccagctggtggagaccggcgggggcctggtgcagcccgggcgctccctccggctgagctgcgccgcgtccggcttcagcttcgacgagtacaccatgcactgggtccgccaggccccgggcaaggggctggagtgggtggccggcatcaactggaaggggaacttcatgggctacgccgactccgtgcaggggcggttcacgatcagccgcgacaacggcaagaactccctctacctgcagatgaacagcctgcgggccgaggacaccgcgctctactactgcgccaaggaccgcctggagtccagcgccatggacatcctggagggcgggaccttcgacatctggggccaggggaccatggtcacggtgtccagcgcctccaccaagggccccagcgtgttccccctcgcgccctccagcaagtccaccagcggcgggaccgccgccctgggctgcctggtcaaggactacttcccggagcccgtgacggtgtcctggaacagcggggccctcaccagcggcgtccacaccttccccgccgtgctgcagtccagcgggctgtactccctcagctccgtggtcaccgtgcccagctccagcctgggcacgcagacctacatctgcaacgtgaaccacaagccctccaacaccaaggtcgacaagaaggtggagcccaagagctgcgacaagacccacacgtgcccgccctgcccggcgcccgagctgctcggcgggccctccgtgttcctgttcccgccgaagcccaaggacaccctgatgatcagccggacccccgaggtcacctgcgtggtggtcgacgtgtcccacgaggaccccgaggtcaagttcaactggtacgtggacggcgtggaggtccacaacgccaagacgaagccccgcgaggagcagtacaacagcacctaccgggtggtgtccgtcctcaccgtgctgcaccaggactggctgaacgggaaggagtacaagtgcaaggtgagcaacaaggccctccccgcccccatcgagaagaccatctccaaggccaagggccagccccgcgagccgcaggtctacacgctgccgcccagccgggacgagctgaccaagaaccaggtgtccctcacctgcctggtgaaggggttctaccccagcgacatcgcggtcgagtgggagagcaacggccagcccgagaacaactacaagaccacgccgcccgtgctggactccgacggcagcttcttcctctactccaagctgaccgtggacaagagccgctggcagcaggggaacgtcttctcctgcagcgtgatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggagatcgtgctcacccagagccccgggaccctgtccctgagccccggcgagcgcgccaccctctcctgccgggcgagccagtccgtcagctccagctacctggcctggtaccagcagaagcccgggcaggccccgcgcctgctcatctacggcgcctccacgcgggccaccgggatccccgcgcgcttcagcggctccggcagcgggaccgacttcaccctgacgatctcccggctggagcccgaggacctcgccgtgtactactgccagcagtacggcagctccccgtggaccttcgggcagggcaccaaggtggagatcaagcgcaccgtcgccgcccccagcgtgttcatcttcccgccctccgacgagcagctgaagagcgggacggcgtccgtggtctgcctgctcaacaacttctacccccgggaggccaaggtgcagtggaaggtggacaacgccctgcagagcggcaacagccaggagtccgtcaccgagcaggacagcaaggactccacctacagcctgtccagcaccctcacgctgtccaaggccgactacgagaagcacaaggtgtacgcctgcgaggtgacccaccagggcctgagctccccggtcaccaagagcttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61499 - protein, 454 aa, synthetic construct
  REGION 1..454: note = Protein (HC) w/o signal peptide encoded by mRNA R4007
EVQLVESGPGLVKPSDILSLTCAVSGYSISSNYYWGWIRQPPGKGLEWIGSIYHSGSTYYKPSLESRLGISVDTSKNQFSLKLSFVSAADTAVYYCARHVRSGYPDTAYYFDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61500 - protein, 214 aa, synthetic construct
  REGION 1..214: note = Protein (LC) w/o signal peptide encoded by mRNA R4007
SYVLTQPPSVSVAPGETARISCGGNNIGTKVLHWYQQTPGQAPVLVVYDDSDRPSGIPERFSGSNSGNTATLTISRVEVGDEADYYCQVWDISTDQAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61501 - RNA, 1362 nt, synthetic construct
  misc_feature 1..1362: note = CDS (HC) w/o signal peptide encoded by mRNA R4007
  source 1..1362: mol_type = other RNA
gaggtccagctggtggagtccgggcccggcctcgtgaagcccagcgacatcctgtccctgacctgcgccgtcagcgggtactccatcagctccaactactactggggctggatccgccagccgcccgggaagggcctcgagtggatcggcagcatctaccactccgggagcacctactacaagccctccctggagagccggctgggcatctccgtggacacgagcaagaaccagttctccctcaagctgagcttcgtgtccgcggccgacaccgccgtctactactgcgcccgccacgtgcggagcgggtacccggacaccgcctactacttcgacaagtggggccaggggaccctggtgacggtctccagcgcgagcaccaagggcccctccgtgttccccctcgcccccagctccaagagcacctccggcgggaccgccgccctgggctgcctggtgaaggactacttcccggagcccgtcacggtgagctggaactccggggcgctcaccagcggcgtgcacaccttccccgccgtcctgcagtccagcggcctgtactccctcagctccgtggtgaccgtccccagctccagcctggggacgcagacctacatctgcaacgtgaaccacaagccctccaacaccaaggtggacaagaaggtcgagcccaagagctgcgacaagacccacacgtgcccgccctgcccggcccccgagctgctcggcgggccctccgtgttcctgttcccgccgaagcccaaggacaccctgatgatcagccgcacccccgaggtcacctgcgtggtggtcgacgtgagccacgaggaccccgaggtgaagttcaactggtacgtcgacggcgtggaggtgcacaacgccaagacgaagccgcgggaggagcagtacaactccacctaccgcgtcgtgagcgtgctcaccgtcctgcaccaggactggctgaacgggaaggagtacaagtgcaaggtgtccaacaaggccctccccgcgcccatcgagaagaccatcagcaaggccaagggccagccccgggagccccaggtgtacacgctgccgccctcccgcgacgagctgaccaagaaccaggtcagcctcacctgcctggtgaagggcttctacccctccgacatcgccgtggagtgggagagcaacgggcagcccgagaacaactacaagaccacgccgcccgtcctggactccgacggcagcttcttcctctactccaagctgaccgtggacaagagccggtggcagcaggggaacgtgttctcctgcagcgtcatgcacgaggccctgcacaaccactacacccagaagtccctcagcctgtccccgggcaag

SEQ ID NO: 61502 - RNA, 642 nt, synthetic construct
  misc_feature 1..642: note = CDS (LC) w/o signal peptide encoded by mRNA R4007
  source 1..642: mol_type = other RNA
agctacgtcctgacgcagcccccgtccgtgagcgtggcgcccggcgagaccgcccgcatctcctgcgggggcaacaacatcgggaccaaggtcctccactggtaccagcagacccccggccaggcccccgtgctggtggtctacgacgacagcgaccggccgtccggcatccccgagcgcttcagcgggtccaacagcggcaacacggccaccctgaccatctcccgggtggaggtgggggacgaggccgactactactgccaggtctgggacatcagcaccgaccaggcggtgttcggcgggggcacgaagctcaccgtgctgggccagcccaaggccgccccctccgtcaccctgttcccgcccagctccgaggagctccaggccaacaaggcgaccctggtgtgcctgatcagcgacttctaccccggggccgtgacggtcgcctggaaggccgactccagccccgtgaaggccggcgtggagaccaccaccccgtccaagcagagcaacaacaagtacgcggccagctcctacctcagcctgacgcccgagcagtggaagtcccaccgcagctactcctgccaggtcacccacgaggggagcaccgtggagaagaccgtggcccccacggagtgctcc

SEQ ID NO: 61503 - RNA, 1362 nt, synthetic construct
  misc_feature 1..1362: note = derived and/or modified sequence opt2 from CDS (HC) w/o signal peptide encoded by mRNA R4007
  source 1..1362: mol_type = other RNA
gaggtccagctcgtcgagtccggccccggcctcgtcaagccctccgacatcctctccctcacctgcgccgtctccggctactccatctcctccaactactactggggctggatccgccagccccccggcaagggcctcgagtggatcggctccatctaccactccggctccacctactacaagccctccctcgagtcccgcctcggcatctccgtcgacacctccaagaaccagttctccctcaagctctccttcgtctccgccgccgacaccgccgtctactactgcgcccgccacgtccgctccggctaccccgacaccgcctactacttcgacaagtggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61504 - RNA, 642 nt, synthetic construct
  misc_feature 1..642: note = derived and/or modified sequence opt2 from CDS (LC) w/o signal peptide encoded by mRNA R4007
  source 1..642: mol_type = other RNA
tcctacgtcctcacccagcccccctccgtctccgtcgcccccggcgagaccgcccgcatctcctgcggcggcaacaacatcggcaccaaggtcctccactggtaccagcagacccccggccaggcccccgtcctcgtcgtctacgacgactccgaccgcccctccggcatccccgagcgcttctccggctccaactccggcaacaccgccaccctcaccatctcccgcgtcgaggtcggcgacgaggccgactactactgccaggtctgggacatctccaccgaccaggccgtcttcggcggcggcaccaagctcaccgtcctcggccagcccaaggccgccccctccgtcaccctcttccccccctcctccgaggagctccaggccaacaaggccaccctcgtctgcctcatctccgacttctaccccggcgccgtcaccgtcgcctggaaggccgactcctcccccgtcaaggccggcgtcgagaccaccaccccctccaagcagtccaacaacaagtacgccgcctcctcctacctctccctcacccccgagcagtggaagtcccaccgctcctactcctgccaggtcacccacgagggctccaccgtcgagaagaccgtcgcccccaccgagtgctcc

SEQ ID NO: 61505 - RNA, 1362 nt, synthetic construct
  misc_feature 1..1362: note = derived and/or modified sequence opt3 from CDS (HC) w/o signal peptide encoded by mRNA R4007
  source 1..1362: mol_type = other RNA
gaggtgcagctggtcgaaagcggccccgggctcgttaagccttccgacatcctttctctgacctgcgccgtgtcaggatacagtattagctccaactattactggggttggataagacaaccaccgggcaaagggttggagtggatcggatctatttatcactcgggctcaacatactataagcccagcttagaaagtaggctgggtatctccgtagatacttctaaaaatcagttcagcctaaagctctcctttgtgtcagctgcagacacggccgtctactattgtgcgcggcatgtgcgcagtgggtaccctgataccgcttactatttcgacaaatggggacagggcacactggttactgtgagctctgcctccaccaagggcccatcagtctttccccttgcacctagcagtaagtctacatccgggggaaccgccgctctgggttgcttggtgaaagattacttcccagagcccgtaactgttagctggaactcgggcgcactcacatctggggtgcacacctttcctgccgtcctgcagtcctcaggactgtatagtctcagctccgtggtgacggtcccatctagctcattaggcactcaaacctacatttgtaatgttaaccataagccgagtaatacaaaagtggacaagaaagtagaacccaagtcctgcgataagactcacacctgtcctccatgccccgctcctgagctgcttggtgggccaagcgtgttcttgtttcccccgaaacctaaggacacactgatgatctctcgaacccccgaggtcacgtgtgtggttgtggatgtctcacatgaagacccagaggtgaaattcaactggtatgtagatggagttgaagtgcacaatgccaagactaaacctcgtgaggagcagtacaacagtacatatagagtcgtgagcgtcctaaccgtgctccaccaggactggctgaatggcaaggaatacaaatgcaaggtttccaacaaggcgcttcccgcaccaatagagaaaactatctctaaggccaaaggccagcccagggaacctcaagtgtacacactgccaccgtcgcgggatgagttgaccaagaatcaggtaagcctcacgtgtctggtcaaagggttttatccctccgacattgctgtggaatgggagtcaaacggacagcctgagaataactacaagaccacaccacccgttttagacagtgatggttctttctttctgtatagcaagctcactgtggacaaatcccgctggcagcaaggcaatgtcttctcatgcagcgtgatgcatgaagcccttcacaaccattacacccagaagtctctgtccttgagtcctgggaaa

SEQ ID NO: 61506 - RNA, 642 nt, synthetic construct
  misc_feature 1..642: note = derived and/or modified sequence opt3 from CDS (LC) w/o signal peptide encoded by mRNA R4007
  source 1..642: mol_type = other RNA
agctacgtgctgacccagcccccttccgtctctgttgccccaggcgagacagctagaatctcatgcgggggaaacaatattggtactaaggtgctccactggtatcaacagacgccgggccaggcacccgtacttgtggtctacgacgatagtgacaggcctagcgggataccagaacggttctccggatctaactcgggcaataccgccacactgactatctcacgcgtggaggttggtgatgaagcggactattactgtcaggtgtgggatattagcaccgaccaagctgtctttgggggaggcacaaaattgaccgtgttaggccagcccaaggccgcacctagtgtaactctgttcccaccctcctctgaggaactacaggccaacaaagctacactcgtttgcctgatcagcgatttttatcctggggcagtgaccgtcgcctggaaggctgactcctcaccagtgaaagccggagtggagacgactaccccgagtaagcagagcaataacaagtacgcggcatcttcctatctttcactgacacccgagcaatggaaaagccatcgaagttactcttgtcaggtcactcacgaaggttccaccgttgagaagacagtggcccctaccgaatgcagc

SEQ ID NO: 61507 - RNA, 1362 nt, synthetic construct
  misc_feature 1..1362: note = derived and/or modified sequence opt4 from CDS (HC) w/o signal peptide encoded by mRNA R4007
  source 1..1362: mol_type = other RNA
gaggtgcagctggtggagagcggccccggcctggtgaagcccagcgacatcctgagcctgacctgcgccgtgagcggctacagcatcagcagcaactactactggggctggatcagacagccccccggcaagggcctggagtggatcggcagcatctaccacagcggcagcacctactacaagcccagcctggagagcagactgggcatcagcgtggacaccagcaagaaccagttcagcctgaagctgagcttcgtgagcgccgccgacaccgccgtgtactactgcgccagacacgtgagaagcggctaccccgacaccgcctactacttcgacaagtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61508 - RNA, 642 nt, synthetic construct
  misc_feature 1..642: note = derived and/or modified sequence opt4 from CDS (LC) w/o signal peptide encoded by mRNA R4007
  source 1..642: mol_type = other RNA
agctacgtgctgacccagccccccagcgtgagcgtggcccccggcgagaccgccagaatcagctgcggcggcaacaacatcggcaccaaggtgctgcactggtaccagcagacccccggccaggcccccgtgctggtggtgtacgacgacagcgacagacccagcggcatccccgagagattcagcggcagcaacagcggcaacaccgccaccctgaccatcagcagagtggaggtgggcgacgaggccgactactactgccaggtgtgggacatcagcaccgaccaggccgtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 61509 - RNA, 1362 nt, synthetic construct
  misc_feature 1..1362: note = derived and/or modified sequence opt5 from CDS (HC) w/o signal peptide encoded by mRNA R4007
  source 1..1362: mol_type = other RNA
gaggtgcagctggtcgaaagcggccccgggctcgttaagccttccgacatcctgtctcttacctgcgccgtgagcggatactccatttctagcaactattactggggctggatcagacaaccgcccgggaaaggactggagtggattggctccatctatcactctgggagcacatactataagccttccctcgaaagccggctgggaatttctgtggatacgtccaaaaatcagttcagccttaagctgtcttttgtctccgctgccgacaccgcggtgtactattgtgctcgccatgttagaagcggctaccccgatacagcctactatttcgacaaatggggccaggggaccctcgtgacagtctcttccgccagcaccaagggaccttccgtgtttcccctggctccttctagcaagtccacaagcggcgggaccgccgctctgggatgcctcgttaaagattacttcccggagcccgtgacggtctcttggaactccggcgccctgaccagcggggtgcacacatttcctgcggtgcttcagtctagcggactgtattccctctctagcgtcgttaccgtgccctccagctctctgggcacacaaacctacatctgtaatgtgaaccataagccttccaatacgaaagtcgacaagaaagtggaacccaagagctgcgataagacacacacctgtccgccttgccccgcccctgagcttctgggcgggccctctgttttcctctttccccctaaaccgaaggacacactgatgatctcccggacccccgaggtgacctgtgtcgtggttgatgtgagccatgaagaccctgaggtcaaattcaactggtatgtggatggagtcgaagtgcacaatgctaagacaaaaccccgcgaggagcagtacaactccacgtatagagttgtgtctgtcctgaccgtgctccaccaggactggctgaatggcaaggaatacaaatgcaaggttagcaacaaggcccttcctgctcccattgagaaaacaatctccaaggccaaagggcagccgcgggaacctcaagtgtacaccctgcccccttctcgcgatgagctcacaaagaatcaggtcagcctgacctgtcttgtgaaaggattttatccctccgacattgcggtggaatgggagagcaacggccagcctgagaataactacaagacgacacccccggttctggactctgatgggtccttctttctctatagcaagctgaccgtcgacaaatctagatggcagcaaggaaatgtgttctcctgcagcgtgatgcatgaagccctgcacaaccattacacccagaagtctctcagcctgtcccctggcaaa

SEQ ID NO: 61510 - RNA, 642 nt, synthetic construct
  misc_feature 1..642: note = derived and/or modified sequence opt5 from CDS (LC) w/o signal peptide encoded by mRNA R4007
  source 1..642: mol_type = other RNA
agctacgtgctgacccagcccccttccgtctctgttgccccgggcgagacagctagaatcagctgcgggggaaacaatattggcacgaaggtgctccactggtatcaacagacccccgggcaggcccctgtgctggtcgtgtacgacgattccgaccggccctctggaatccctgaacgcttcagcggctccaactctgggaatacagcgacccttacaattagcagagttgaggtgggagatgaagctgactattactgtcaggtctgggatatctccaccgaccaagccgtgtttggcggcgggacaaaactgaccgttctcggacagcccaaggccgctcctagcgtgacgctgttcccgccctcttccgaggaacttcaggccaacaaagctaccctggtctgcctcattagcgatttttatcctggcgccgtgacagtggcgtggaaggccgactcttcccccgtcaaagctggggttgagaccacaacccctagcaagcagtctaataacaagtacgccgcttccagctatctgtccctgacgcccgagcaatggaaatctcatcggagctactcctgtcaggtgacacacgaaggaagcaccgtggagaagacagtcgccccgaccgaatgctct

SEQ ID NO: 61511 - RNA, 1362 nt, synthetic construct
  misc_feature 1..1362: note = derived and/or modified sequence opt6 from CDS (HC) w/o signal peptide encoded by mRNA R4007
  source 1..1362: mol_type = other RNA
gaagtccaactagtagaaagcggacctggcctagtaaaaccatcagacatactatcactaacatgcgcagtatcaggatactccatatcaagtaactattactggggttggataagacaaccaccaggaaaaggcctagaatggatagggtccatataccactccggatcaacatactataaaccttccttagaatctcgattaggaatatctgtagataccagcaaaaaccaattctctcttaaattaagttttgtatcagcagcagacacagcagtttattattgcgcaagacacgtacgatcaggttacccagacactgcatactacttcgataaatggggacaaggaacactagtaacagtatcttcagcatcaacaaaaggaccctcagtattcccactagccccatcatcaaaatcaacaagtggaggtacagcagcattaggttgcctagtaaaagactactttcccgaacccgtaacagtgtcatggaactcaggagccctaacatcaggagtgcacacatttccagcagtactacaatcatcaggactatactccctcagcagcgtagtcactgtcccatcttcatcattaggtacacaaacctatatatgcaatgtaaaccacaaaccatcaaacacaaaagtagataaaaaagtagaaccaaaatcatgtgataaaacacatacatgccctccatgcccagcaccagaactcctaggaggaccatcagtattcttattcccaccaaaaccaaaagacacactaatgatatctagaacaccagaagttacttgcgtcgtagtagacgtatcccacgaagacccagaagtaaaattcaactggtatgttgacggagtcgaagtacacaacgcaaaaacaaaaccaagagaagaacaatacaactcaacataccgagtagtatcagtattaacagtactacaccaagactggctaaatggaaaagaatataaatgtaaagtatcaaacaaagctcttcctgcaccaattgaaaaaacaatctccaaagctaaaggccaaccacgagaaccacaagtatacacactcccaccatccagagacgaattaacaaaaaaccaagtaagtctaacttgtctagttaaaggattttacccatcagacatagcagtcgaatgggaaagcaacggtcaacctgaaaataactataaaacaacccctccagtacttgactctgacggctccttcttcctttatagcaaattaacagtcgacaaatcaagatggcaacaaggcaacgtattttcatgctcagtaatgcacgaagcacttcataaccactacacacaaaaatccctctcactatcaccaggaaaa

SEQ ID NO: 61512 - RNA, 642 nt, synthetic construct
  misc_feature 1..642: note = derived and/or modified sequence opt6 from CDS (LC) w/o signal peptide encoded by mRNA R4007
  source 1..642: mol_type = other RNA
tcatatgtactaacacaaccaccatctgtatctgtagcaccaggagaaacagcaagaatatcatgcggaggaaacaacataggaacaaaagtactacactggtaccaacaaacaccaggacaagcaccagtcctagtagtttacgacgactcagacagaccatcaggaataccagaaagattctcaggatcaaattcaggaaatacagcaacactaacaatatcaagagtagaagtaggagacgaagcagactactactgccaagtatgggacatatcaacagaccaagccgtattcggaggaggaacaaaactaacagtactaggccaaccaaaagcagcaccatcagtaacactattcccaccatcatcagaagaactacaagcaaacaaagccacactagtatgcctaataagtgacttttacccaggagcagtaacagtagcatggaaagcagactcatcaccagtaaaagcaggagtagaaacaacaacaccatcaaaacaatcaaacaacaaatacgcagcatcctcatacttatcactaactccagaacaatggaaatcacacagatcatactcatgccaagtaacacacgaaggaagcacagtagaaaaaacagtagcaccaacagaatgcagc

SEQ ID NO: 61513 - RNA, 1362 nt, synthetic construct
  misc_feature 1..1362: note = derived and/or modified sequence opt11 from CDS (HC) w/o signal peptide encoded by mRNA R4007
  source 1..1362: mol_type = other RNA
gaagtccagctagtagaatccggacccggcctagtcaaaccctccgacatactatccctaacttgcgcagtctccggatactccatctccagcaactactactggggctggatccgacaaccccctggaaaaggccttgaatggatcggctccatctaccactcaggctcaacctactacaaaccctccctcgaatcacgcctaggcatctcagtcgacacgtcgaaaaaccaattcagcctaaaactctccttcgtcagcgcagcagacaccgccgtatactactgcgcacgacacgtacgatccggctacccagacacagcatactatttcgacaaatggggccaaggaaccctcgtcaccgtctcctccgctagcaccaaaggaccctccgtcttccccctcgccccatcctccaagtcaacctccggcggcaccgccgcactcggctgcctcgtcaaagactacttcccagaacctgttaccgtctcatggaactccggcgccctcacatccggagtccacaccttccccgccgtcctacaatcatccggactctacagcctgtcctccgtcgtcacggtccccagctcctcactcggcacccaaacctacatctgcaacgtcaaccacaaaccaagcaataccaaggtcgacaaaaaggtagaacccaaatcctgcgacaaaacccatacctgcccaccctgcccagcccccgaactcctaggcggcccatcagtcttcctgttcccacccaaacccaaagacactctcatgatctcacggacccccgaagtaacctgcgtcgtagtagacgtatcccacgaagaccccgaagtaaaatttaactggtacgtcgacggggtagaagtccacaacgcaaaaaccaaaccccgcgaagaacaatacaactccacctaccgagtagtctcagtactaacagtactccaccaagactggctaaacggcaaggaatacaaatgcaaagtctcaaataaagcgctccccgcccccatcgagaaaacaatctccaaagccaaaggccaaccccgcgaaccccaagtctacaccctcccaccctcacgagacgaactcactaaaaaccaagtctcccttacatgcctggtcaaaggtttctacccctccgacatcgccgtcgaatgggaatcaaacggacaacccgaaaacaactataaaaccacccctcccgtactcgactccgacggctccttcttcctatacagcaaactgaccgtcgacaaaagcagatggcaacagggcaacgtcttctcatgctccgtcatgcacgaagccctccacaaccactacacccaaaaatccctatccctcagtcccggaaaa

SEQ ID NO: 61514 - RNA, 642 nt, synthetic construct
  misc_feature 1..642: note = derived and/or modified sequence opt11 from CDS (LC) w/o signal peptide encoded by mRNA R4007
  source 1..642: mol_type = other RNA
tcctacgtcctaactcaacccccctctgtctccgtcgccccaggcgaaaccgcccgcatctcctgcggaggcaacaacatcggcacaaaagtcctccactggtaccaacaaacacccggacaagcccccgtcctcgtcgtctacgacgacagcgaccgcccatccggcatccccgaacgattctccggctccaactccggaaacaccgcaaccctcaccatctcccgcgtcgaagtcggcgacgaagccgactactactgccaagtctgggacatctccaccgaccaagccgtcttcggcggcggcaccaaactcaccgtcctcggtcaacccaaagccgccccctccgtcaccctattccccccctcatccgaagaacttcaagccaacaaagcaaccctcgtctgcctcatatccgacttctaccccggagccgtcaccgtcgcctggaaagcagactcctcccccgtcaaagccggcgtcgaaacaaccaccccatccaaacaatccaacaacaaatacgccgcatcctcctacctatcactaacacccgaacagtggaaatcccaccgctcctactcctgccaagtcacacacgaaggctccacagtcgaaaaaaccgtcgcccccaccgaatgctcc

SEQ ID NO: 61515 - protein, 479 aa, synthetic construct
  REGION 1..479: note = Protein (HC) encoded by mRNA R4007
MAVMAPRTLVLLLSGALALTQTWAGEVQLVESGPGLVKPSDILSLTCAVSGYSISSNYYWGWIRQPPGKGLEWIGSIYHSGSTYYKPSLESRLGISVDTSKNQFSLKLSFVSAADTAVYYCARHVRSGYPDTAYYFDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61516 - protein, 239 aa, synthetic construct
  REGION 1..239: note = Protein (LC) encoded by mRNA R4008
MAVMAPRTLVLLLSGALALTQTWAGSYVLTQPPSVSVAPGETARISCGGNNIGTKVLHWYQQTPGQAPVLVVYDDSDRPSGIPERFSGSNSGNTATLTISRVEVGDEADYYCQVWDISTDQAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61517 - RNA, 1440 nt, synthetic construct
  misc_feature 1..1440: note = CDS (HC) encoded by mRNA R4007
  source 1..1440: mol_type = other RNA
atggccgtgatggccccgcggaccctggtcctcctgctgagcggcgcgctcgccctgacccagacgtgggccggggaggtccagctggtggagtccgggcccggcctcgtgaagcccagcgacatcctgtccctgacctgcgccgtcagcgggtactccatcagctccaactactactggggctggatccgccagccgcccgggaagggcctcgagtggatcggcagcatctaccactccgggagcacctactacaagccctccctggagagccggctgggcatctccgtggacacgagcaagaaccagttctccctcaagctgagcttcgtgtccgcggccgacaccgccgtctactactgcgcccgccacgtgcggagcgggtacccggacaccgcctactacttcgacaagtggggccaggggaccctggtgacggtctccagcgcgagcaccaagggcccctccgtgttccccctcgcccccagctccaagagcacctccggcgggaccgccgccctgggctgcctggtgaaggactacttcccggagcccgtcacggtgagctggaactccggggcgctcaccagcggcgtgcacaccttccccgccgtcctgcagtccagcggcctgtactccctcagctccgtggtgaccgtccccagctccagcctggggacgcagacctacatctgcaacgtgaaccacaagccctccaacaccaaggtggacaagaaggtcgagcccaagagctgcgacaagacccacacgtgcccgccctgcccggcccccgagctgctcggcgggccctccgtgttcctgttcccgccgaagcccaaggacaccctgatgatcagccgcacccccgaggtcacctgcgtggtggtcgacgtgagccacgaggaccccgaggtgaagttcaactggtacgtcgacggcgtggaggtgcacaacgccaagacgaagccgcgggaggagcagtacaactccacctaccgcgtcgtgagcgtgctcaccgtcctgcaccaggactggctgaacgggaaggagtacaagtgcaaggtgtccaacaaggccctccccgcgcccatcgagaagaccatcagcaaggccaagggccagccccgggagccccaggtgtacacgctgccgccctcccgcgacgagctgaccaagaaccaggtcagcctcacctgcctggtgaagggcttctacccctccgacatcgccgtggagtgggagagcaacgggcagcccgagaacaactacaagaccacgccgcccgtcctggactccgacggcagcttcttcctctactccaagctgaccgtggacaagagccggtggcagcaggggaacgtgttctcctgcagcgtcatgcacgaggccctgcacaaccactacacccagaagtccctcagcctgtccccgggcaagtga

SEQ ID NO: 61518 - RNA, 720 nt, synthetic construct
  misc_feature 1..720: note = CDS (LC) encoded by mRNA R4007
  source 1..720: mol_type = other RNA
atggccgtgatggccccgcggaccctggtcctcctgctgagcggcgcgctcgccctgacccagacgtgggccgggagctacgtcctgacgcagcccccgtccgtgagcgtggcgcccggcgagaccgcccgcatctcctgcgggggcaacaacatcgggaccaaggtcctccactggtaccagcagacccccggccaggcccccgtgctggtggtctacgacgacagcgaccggccgtccggcatccccgagcgcttcagcgggtccaacagcggcaacacggccaccctgaccatctcccgggtggaggtgggggacgaggccgactactactgccaggtctgggacatcagcaccgaccaggcggtgttcggcgggggcacgaagctcaccgtgctgggccagcccaaggccgccccctccgtcaccctgttcccgcccagctccgaggagctccaggccaacaaggcgaccctggtgtgcctgatcagcgacttctaccccggggccgtgacggtcgcctggaaggccgactccagccccgtgaaggccggcgtggagaccaccaccccgtccaagcagagcaacaacaagtacgcggccagctcctacctcagcctgacgcccgagcagtggaagtcccaccgcagctactcctgccaggtcacccacgaggggagcaccgtggagaagaccgtggcccccacggagtgctcctga

SEQ ID NO: 61519 - RNA, 2831 nt, synthetic construct
  misc_feature 1..2831: note = CDS (HC)-IRES-CDS (LC) as RNA from mRNA R4007
  source 1..2831: mol_type = other RNA
atggccgtgatggccccgcggaccctggtcctcctgctgagcggcgcgctcgccctgacccagacgtgggccggggaggtccagctggtggagtccgggcccggcctcgtgaagcccagcgacatcctgtccctgacctgcgccgtcagcgggtactccatcagctccaactactactggggctggatccgccagccgcccgggaagggcctcgagtggatcggcagcatctaccactccgggagcacctactacaagccctccctggagagccggctgggcatctccgtggacacgagcaagaaccagttctccctcaagctgagcttcgtgtccgcggccgacaccgccgtctactactgcgcccgccacgtgcggagcgggtacccggacaccgcctactacttcgacaagtggggccaggggaccctggtgacggtctccagcgcgagcaccaagggcccctccgtgttccccctcgcccccagctccaagagcacctccggcgggaccgccgccctgggctgcctggtgaaggactacttcccggagcccgtcacggtgagctggaactccggggcgctcaccagcggcgtgcacaccttccccgccgtcctgcagtccagcggcctgtactccctcagctccgtggtgaccgtccccagctccagcctggggacgcagacctacatctgcaacgtgaaccacaagccctccaacaccaaggtggacaagaaggtcgagcccaagagctgcgacaagacccacacgtgcccgccctgcccggcccccgagctgctcggcgggccctccgtgttcctgttcccgccgaagcccaaggacaccctgatgatcagccgcacccccgaggtcacctgcgtggtggtcgacgtgagccacgaggaccccgaggtgaagttcaactggtacgtcgacggcgtggaggtgcacaacgccaagacgaagccgcgggaggagcagtacaactccacctaccgcgtcgtgagcgtgctcaccgtcctgcaccaggactggctgaacgggaaggagtacaagtgcaaggtgtccaacaaggccctccccgcgcccatcgagaagaccatcagcaaggccaagggccagccccgggagccccaggtgtacacgctgccgccctcccgcgacgagctgaccaagaaccaggtcagcctcacctgcctggtgaagggcttctacccctccgacatcgccgtggagtgggagagcaacgggcagcccgagaacaactacaagaccacgccgcccgtcctggactccgacggcagcttcttcctctactccaagctgaccgtggacaagagccggtggcagcaggggaacgtgttctcctgcagcgtcatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccgggagctacgtcctgacgcagcccccgtccgtgagcgtggcgcccggcgagaccgcccgcatctcctgcgggggcaacaacatcgggaccaaggtcctccactggtaccagcagacccccggccaggcccccgtgctggtggtctacgacgacagcgaccggccgtccggcatccccgagcgcttcagcgggtccaacagcggcaacacggccaccctgaccatctcccgggtggaggtgggggacgaggccgactactactgccaggtctgggacatcagcaccgaccaggcggtgttcggcgggggcacgaagctcaccgtgctgggccagcccaaggccgccccctccgtcaccctgttcccgcccagctccgaggagctccaggccaacaaggcgaccctggtgtgcctgatcagcgacttctaccccggggccgtgacggtcgcctggaaggccgactccagccccgtgaaggccggcgtggagaccaccaccccgtccaagcagagcaacaacaagtacgcggccagctcctacctcagcctgacgcccgagcagtggaagtcccaccgcagctactcctgccaggtcacccacgaggggagcaccgtggagaagaccgtggcccccacggagtgctcctga

SEQ ID NO: 61520 - RNA, 3023 nt, synthetic construct
  misc_feature 1..3023: note = R4007
  source 1..3023: mol_type = other RNA
gggagaaagcttaccatggccgtgatggccccgcggaccctggtcctcctgctgagcggcgcgctcgccctgacccagacgtgggccggggaggtccagctggtggagtccgggcccggcctcgtgaagcccagcgacatcctgtccctgacctgcgccgtcagcgggtactccatcagctccaactactactggggctggatccgccagccgcccgggaagggcctcgagtggatcggcagcatctaccactccgggagcacctactacaagccctccctggagagccggctgggcatctccgtggacacgagcaagaaccagttctccctcaagctgagcttcgtgtccgcggccgacaccgccgtctactactgcgcccgccacgtgcggagcgggtacccggacaccgcctactacttcgacaagtggggccaggggaccctggtgacggtctccagcgcgagcaccaagggcccctccgtgttccccctcgcccccagctccaagagcacctccggcgggaccgccgccctgggctgcctggtgaaggactacttcccggagcccgtcacggtgagctggaactccggggcgctcaccagcggcgtgcacaccttccccgccgtcctgcagtccagcggcctgtactccctcagctccgtggtgaccgtccccagctccagcctggggacgcagacctacatctgcaacgtgaaccacaagccctccaacaccaaggtggacaagaaggtcgagcccaagagctgcgacaagacccacacgtgcccgccctgcccggcccccgagctgctcggcgggccctccgtgttcctgttcccgccgaagcccaaggacaccctgatgatcagccgcacccccgaggtcacctgcgtggtggtcgacgtgagccacgaggaccccgaggtgaagttcaactggtacgtcgacggcgtggaggtgcacaacgccaagacgaagccgcgggaggagcagtacaactccacctaccgcgtcgtgagcgtgctcaccgtcctgcaccaggactggctgaacgggaaggagtacaagtgcaaggtgtccaacaaggccctccccgcgcccatcgagaagaccatcagcaaggccaagggccagccccgggagccccaggtgtacacgctgccgccctcccgcgacgagctgaccaagaaccaggtcagcctcacctgcctggtgaagggcttctacccctccgacatcgccgtggagtgggagagcaacgggcagcccgagaacaactacaagaccacgccgcccgtcctggactccgacggcagcttcttcctctactccaagctgaccgtggacaagagccggtggcagcaggggaacgtgttctcctgcagcgtcatgcacgaggccctgcacaaccactacacccagaagtccctcagcctgtccccgggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccgggagctacgtcctgacgcagcccccgtccgtgagcgtggcgcccggcgagaccgcccgcatctcctgcgggggcaacaacatcgggaccaaggtcctccactggtaccagcagacccccggccaggcccccgtgctggtggtctacgacgacagcgaccggccgtccggcatccccgagcgcttcagcgggtccaacagcggcaacacggccaccctgaccatctcccgggtggaggtgggggacgaggccgactactactgccaggtctgggacatcagcaccgaccaggcggtgttcggcgggggcacgaagctcaccgtgctgggccagcccaaggccgccccctccgtcaccctgttcccgcccagctccgaggagctccaggccaacaaggcgaccctggtgtgcctgatcagcgacttctaccccggggccgtgacggtcgcctggaaggccgactccagccccgtgaaggccggcgtggagaccaccaccccgtccaagcagagcaacaacaagtacgcggccagctcctacctcagcctgacgcccgagcagtggaagtcccaccgcagctactcctgccaggtcacccacgaggggagcaccgtggagaagaccgtggcccccacggagtgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61521 - protein, 450 aa, synthetic construct
  REGION 1..450: note = Protein (HC) w/o signal peptide encoded by mRNA R4008
QVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61522 - protein, 214 aa, synthetic construct
  REGION 1..214: note = Protein (LC) w/o signal peptide encoded by mRNA R4008
DIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61523 - RNA, 1350 nt, synthetic construct
  misc_feature 1..1350: note = CDS (HC) w/o signal peptide encoded by mRNA R4008
  source 1..1350: mol_type = other RNA
caggtgcagctcgtccagtccggggccgaggtgaaggagcccggcagcgccatgaaggtgtcctgcaaggccagcgggggcacgttctccagcgacgccttctgctgggtccggcaggcgccggggcgcggcctggagtggatgggcgggatcatccccgtgttccagaccgccaactacggccccaacttccaggggcgggtgaccatctccgccgacgtctacaccacgaccctgtacctcgagctgagcggcctgacctccgaggacaccgccgtgtacttctgcgcgcgcagcggggacggctacaactactacttccccctctggggccaggggacgctggtgaccgtctccagcgcctccaccaagggcccgagcgtgttccccctggccccctccagcaagtccaccagcgggggcacggccgccctcggctgcctggtgaaggactacttccccgagccggtcaccgtgtcctggaacagcggggcgctgaccagcggcgtgcacaccttccccgccgtcctccagtccagcgggctgtactccctgagctccgtggtgacggtccccagctccagcctcggcacccagacctacatctgcaacgtgaaccacaagccctccaacaccaaggtggacaagaaggtcgagcccaagagctgcgacaagacgcacacctgcccgccctgccccgccccggagctgctgggcgggccctccgtgttcctcttcccgcccaagccgaaggacaccctgatgatcagccggacccccgaggtcacgtgcgtggtggtcgacgtgtcccacgaggaccccgaggtgaagttcaactggtacgtcgacggcgtggaggtgcacaacgccaagaccaagccccgcgaggagcagtacaacagcacctaccgggtcgtgtccgtgctgaccgtcctccaccaggactggctgaacgggaaggagtacaagtgcaaggtgagcaacaaggccctgccggcgcccatcgagaagacgatctccaaggccaagggccagccccgcgagccccaggtgtacaccctcccgcccagccgggacgagctgaccaagaaccaggtctccctgacctgcctcgtgaaggggttctaccccagcgacatcgccgtggagtgggagagcaacggccagccggagaacaactacaagacgaccccgcccgtcctggactccgacgggagcttcttcctgtactccaagctcaccgtggacaagagccgctggcagcagggcaacgtgttctcctgcagcgtcatgcacgaggccctgcacaaccactacacccagaagtccctgagcctctcccccggcaag

SEQ ID NO: 61524 - RNA, 642 nt, synthetic construct
  misc_feature 1..642: note = CDS (LC) w/o signal peptide encoded by mRNA R4008
  source 1..642: mol_type = other RNA
gacatccagatgacccagagcccctccaccctcagcggctccgtcggggaccgggtgacgatcacctgccgcgcgagccagaacatcggcccctggctggcctggtaccagcaggagtccgggaaggcccccaagctgctcatcagccgggcctccatcctggagagcggcgtgccctcccgcttcagcggcaccgggaccggcacggagttcaccctgaccatctccagcctccagcccgacgacttcgccacctactactgccagcactacaacgcgtactgggggacgttcggccaggggaccaaggtcgagatcaaccggaccgtggccgccccgtccgtgttcatcttcccgccgagcgacgagcagctgaagtccggcaccgccagcgtcgtgtgcctgctcaacaacttctacccccgcgaggcgaaggtgcagtggaaggtcgacaacgccctgcagtccggcaacagccaggagtccgtgacggagcaggacagcaaggacagcacctactccctgagctccaccctcaccctgagcaaggccgactacgagaagcacaaggtgtacgcctgcgaggtcacgcaccaggggctgtccagccccgtgaccaagtccttcaaccggggcgagtgc

SEQ ID NO: 61525 - RNA, 1350 nt, synthetic construct
  misc_feature 1..1350: note = derived and/or modified sequence opt2 from CDS (HC) w/o signal peptide encoded by mRNA R4008
  source 1..1350: mol_type = other RNA
caggtccagctcgtccagtccggcgccgaggtcaaggagcccggctccgccatgaaggtctcctgcaaggcctccggcggcaccttctcctccgacgccttctgctgggtccgccaggcccccggccgcggcctcgagtggatgggcggcatcatccccgtcttccagaccgccaactacggccccaacttccagggccgcgtcaccatctccgccgacgtctacaccaccaccctctacctcgagctctccggcctcacctccgaggacaccgccgtctacttctgcgcccgctccggcgacggctacaactactacttccccctctggggccagggcaccctcgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61526 - RNA, 642 nt, synthetic construct
  misc_feature 1..642: note = derived and/or modified sequence opt2 from CDS (LC) w/o signal peptide encoded by mRNA R4008
  source 1..642: mol_type = other RNA
gacatccagatgacccagtccccctccaccctctccggctccgtcggcgaccgcgtcaccatcacctgccgcgcctcccagaacatcggcccctggctcgcctggtaccagcaggagtccggcaaggcccccaagctcctcatctcccgcgcctccatcctcgagtccggcgtcccctcccgcttctccggcaccggcaccggcaccgagttcaccctcaccatctcctccctccagcccgacgacttcgccacctactactgccagcactacaacgcctactggggcaccttcggccagggcaccaaggtcgagatcaaccgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61527 - RNA, 1350 nt, synthetic construct
  misc_feature 1..1350: note = derived and/or modified sequence opt3 from CDS (HC) w/o signal peptide encoded by mRNA R4008
  source 1..1350: mol_type = other RNA
caggtgcaactggtccagagcggcgccgaggttaaggaacccgggtccgctatgaaagtgtcttgcaaggcatcaggaggtaccttcagtagcgacgccttttgttgggtaagacaggcgcctggcagggggctcgagtggatgggaggcatcattccagtgttccagacagctaactacggtccgaattttcaagggcgggtcactatatccgccgatgtgtatacgaccacactttacctggaattgtctggattaacttcggaggacaccgcagtttatttctgcgcccgctcaggcgatggctacaactattactttcccctgtgggggcagggaaccctagtgacagtcagcagtgcttccactaaaggtccttctgtgttcccactcgcacccagctccaagtcaacaagtggcgggaccgccgctctgggatgtcttgtaaaagactattttcctgaaccagttacggtgagctggaactctggcgccctgacttccggtgtccacaccttccccgcggtgttgcagtcaagcgggctctacagtctgtcttccgtggtcacagttcctagctcgtctctgggaactcagacctacatctgcaatgtgaatcataagccatccaacacaaaggtagataaaaaggtggagccgaaatcatgtgacaagacccacacgtgtcccccttgcccagcacccgagctcttaggcggccctagtgtctttctgttcccacccaaaccgaaggatactcttatgattagccgaacacctgaagtgacctgcgttgtggtcgacgtgtcccatgaggatcccgaagtaaagtttaattggtatgttgacggggtggaggtccacaacgccaaaactaagccacgtgaggaacaatacaattctacatatagagtggtcagcgtgttgaccgttctgcatcaggattggctaaacggaaaagagtacaagtgtaaagtgtcaaataaggctctccctgcccccatcgagaaaacgattagtaaggcaaagggtcagccaagggaaccccaggtatataccctgcctccatcccgggacgaacttactaaaaaccaagtcagcctgacatgcttggtgaagggcttctacccgtctgatatcgctgttgagtgggagtcaaatgggcagcccgaaaacaattataaaaccacacctccagtgctcgacagtgacggcagctttttcctgtactccaagttaactgtcgataaatctcgctggcagcaaggaaacgtgttctcgtgtagcgtaatgcacgaggccctgcacaaccattacacccagaagtccctctcacttagtcccggtaag

SEQ ID NO: 61528 - RNA, 642 nt, synthetic construct
  misc_feature 1..642: note = derived and/or modified sequence opt3 from CDS (LC) w/o signal peptide encoded by mRNA R4008
  source 1..642: mol_type = other RNA
gacatccagatgacccaaagcccctccacactgtctggctcagtgggggatagagtcactattacgtgcagggccagtcagaacataggaccttggctcgcttggtaccagcaggagagcggtaaggcaccaaaacttctgatctcccgggcctctattttggaatcgggcgttccgtcacgcttcagcgggaccggaacaggcactgagtttaccttaacaatcagttccctgcaacccgacgatttcgcgacctattactgtcagcactataatgcttactggggtacttttgggcagggaacaaaggtggaaattaaccgaaccgtagccgcaccttctgtgttcatctttccacccagcgacgagcagctaaaatccggcacggcctcagtcgtgtgcctcctgaataacttctatcctcgtgaagctaaggttcaatggaaagtggataatgcacttcagagtggcaacagccaggagtctgtcactgagcaggactccaaggattcaacctacagcctgagttctacattgactctctccaaggccgactatgaaaaacataaggtgtacgcttgtgaggtaacccaccaagggctgagctcgccagttacaaaatcttttaatagaggagaatgc

SEQ ID NO: 61529 - RNA, 1350 nt, synthetic construct
  misc_feature 1..1350: note = derived and/or modified sequence opt4 from CDS (HC) w/o signal peptide encoded by mRNA R4008
  source 1..1350: mol_type = other RNA
caggtgcagctggtgcagagcggcgccgaggtgaaggagcccggcagcgccatgaaggtgagctgcaaggccagcggcggcaccttcagcagcgacgccttctgctgggtgagacaggcccccggcagaggcctggagtggatgggcggcatcatccccgtgttccagaccgccaactacggccccaacttccagggcagagtgaccatcagcgccgacgtgtacaccaccaccctgtacctggagctgagcggcctgaccagcgaggacaccgccgtgtacttctgcgccagaagcggcgacggctacaactactacttccccctgtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61530 - RNA, 642 nt, synthetic construct
  misc_feature 1..642: note = derived and/or modified sequence opt4 from CDS (LC) w/o signal peptide encoded by mRNA R4008
  source 1..642: mol_type = other RNA
gacatccagatgacccagagccccagcaccctgagcggcagcgtgggcgacagagtgaccatcacctgcagagccagccagaacatcggcccctggctggcctggtaccagcaggagagcggcaaggcccccaagctgctgatcagcagagccagcatcctggagagcggcgtgcccagcagattcagcggcaccggcaccggcaccgagttcaccctgaccatcagcagcctgcagcccgacgacttcgccacctactactgccagcactacaacgcctactggggcaccttcggccagggcaccaaggtggagatcaacagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61531 - RNA, 1350 nt, synthetic construct
  misc_feature 1..1350: note = derived and/or modified sequence opt5 from CDS (HC) w/o signal peptide encoded by mRNA R4008
  source 1..1350: mol_type = other RNA
caggtgcaactggtccagagcggcgccgaggttaaggaacccgggtccgctatgaaagtgtcttgcaaggccagcggaggcaccttctcctctgacgcgttttgttgggtgagacaggctcctgggcggggactcgagtggatgggcgggatcattccggtcttccagacagccaactacggacccaattttcaaggccgcgtgacgatcagcgccgatgtttataccacaaccctgtaccttgaactgtccggcctcacatctgaggacaccgctgtgtatttctgcgccagaagcggggatggatacaactattactttcctctgtggggccaggggacacttgtcaccgtgtccagcgcttctacgaaaggaccctccgttttccctctggcccccagctctaagtccaccagcggcgggacagcggccctcggatgtctggtgaaagactattttcctgaaccggtcaccgtgtcttggaactccggcgctctgacaagcggcgtgcacaccttccccgccgtcctccagtcctctgggctgtacagcctttccagcgttgtgacggtgccttcttccagcctgggaacacagacctacatttgcaatgtcaatcataagccctctaacacaaaggtggataaaaaggttgagcctaaaagctgtgacaagacccacacctgtcccccgtgccctgctcccgagctcctgggcgggccttccgtgtttcttttccctcccaaacccaaggatacactgatgatctctcggacgccggaagtgacctgcgtcgttgtggacgtcagccatgaggatcccgaagtgaagtttaattggtatgtcgacggagtggaggttcacaacgccaaaacaaagcctcgcgaggaacaatacaattccacctatagagtggtcagcgtgctcacagttctgcatcaggattggctgaacggcaaagagtacaagtgtaaagtgtctaataaggcgctccccgcccctattgagaaaaccatctccaaggctaaggggcagccccgggaaccgcaggtctatacgctgcctcccagccgcgacgaacttaccaaaaaccaagtgtctctgacatgcctcgtgaagggattctacccttccgatatcgccgttgagtgggagagcaatggccagcccgaaaacaattataaaaccacacctcccgtcctggactccgacggcagctttttcctttactctaagctgaccgtggataaatccagatggcagcaagggaacgtgttctcttgtagcgtcatgcacgaggctctccacaaccattacacacagaagtccctgagcctgtctccgggaaag

SEQ ID NO: 61532 - RNA, 642 nt, synthetic construct
  misc_feature 1..642: note = derived and/or modified sequence opt5 from CDS (LC) w/o signal peptide encoded by mRNA R4008
  source 1..642: mol_type = other RNA
gacatccagatgacccaaagcccctccacactgtctggcagcgtgggggatagagtcacgattacctgccgggcctcccagaacatcggaccttggctcgcttggtaccagcaggagtctggcaaagccccgaaactgcttattagccgcgcgtccatcctggaatctggggttcccagcagattctccggaacaggcaccgggacagagtttaccctcacaattagctctctgcaacctgacgatttcgctacctattactgtcagcactataatgcctactggggaacgtttggccagggcaccaaggtggaaatcaaccggacagtggccgctccctccgtcttcatctttcctcccagcgacgagcagcttaaatctgggaccgcctccgtggtttgcctgctcaataacttctatcctcgcgaagctaaggtgcaatggaaagtcgataatgccctgcagagcggaaactctcaggagtccgtgacagagcaggacagcaaggattccacctactctctgagctccacgctcacactgagcaaggcggactatgaaaaacataaggtttacgcctgtgaggtgacccaccaaggcctttcttccccggtcacaaagagctttaatagaggggaatgc

SEQ ID NO: 61533 - RNA, 1350 nt, synthetic construct
  misc_feature 1..1350: note = derived and/or modified sequence opt6 from CDS (HC) w/o signal peptide encoded by mRNA R4008
  source 1..1350: mol_type = other RNA
caagttcaattagtacaaagtggtgcagaagtcaaagaacctggatcagcaatgaaagtatcatgtaaagctagtggaggaactttctcatcagacgcattttgctgggttcgacaagccccaggaagaggcttagaatggatgggtggaataataccagtattccaaaccgcaaactacggtccaaattttcaaggaagagtaacaatttctgctgacgtatacaccactactctatacctagaactatctggattaacttccgaagacaccgccgtatacttctgcgcaagatcaggagacggatacaattattatttcccattatggggacaaggaacactagtaacagtttcatcagcatcaacaaaaggaccatcagttttcccactagcaccatcaagtaaatcaacaagcggaggcacagcagccctaggatgccttgtcaaagactacttccctgaaccagtaaccgtatcatggaactcaggtgcattaacatcaggagtacatacattcccagcagtactacaatcatcaggactatactctttatcatcagtagtaacagtaccaagctcatccttaggaacccaaacatacatatgtaatgtaaatcataaaccatctaatacaaaagtagacaaaaaagtagaacccaaatcatgtgacaaaacacacacatgtccaccatgccccgcccccgaactattaggcggtccctcagtcttcttattccccccaaaaccaaaagatactctaatgatatcaagaactcctgaagtaacctgtgttgttgtcgacgtatctcacgaagacccagaagtcaaatttaactggtatgtagatggagtagaagtacacaacgcaaaaactaaaccacgagaagaacaatacaactcaacatacagagtagtttcagtcctcaccgtattacaccaagactggctaaatggcaaagaatataaatgtaaagtatctaacaaagcacttccagcaccaattgaaaaaacaatatctaaagccaaaggacaaccaagagaaccacaagtatacactctccccccatcacgagatgaattaacaaaaaaccaagtatccctaacatgtttagtaaaaggtttttacccttcagacatagcagtagaatgggaatccaacggacaaccagaaaacaattacaaaactacaccacccgtactagactccgacggatcattcttcctatattctaaactaacagtagacaaatcaagatggcaacaaggaaatgtcttttcttgctcagtaatgcatgaagcattacataaccactacacacaaaaatccctatcattatcacctggaaaa

SEQ ID NO: 61534 - RNA, 642 nt, synthetic construct
  misc_feature 1..642: note = derived and/or modified sequence opt6 from CDS (LC) w/o signal peptide encoded by mRNA R4008
  source 1..642: mol_type = other RNA
gatatacaaatgacacaatcaccatctacattaagcggaagcgtaggtgatagagtaacaataacatgtagagcaagccaaaacataggaccatggttagcatggtaccaacaagaaagcggtaaagcacccaaactattaatatcaagagcaagtatactagaaagtggagtaccaagcagattctcaggaacaggaacaggaacagaatttacattaacaataagctcactacaacccgacgactttgcaacgtactattgccaacactataacgcatattggggcacattcggacaaggaacaaaagtagaaataaatagaacagtagcagcaccaagcgtattcatattcccaccatcagacgaacaattaaaatcaggaacagcatcagtagtgtgcttactaaataacttttacccaagagaagcaaaagtccaatggaaagtcgataacgcactacaaagcggaaactcacaagaatcagtaaccgaacaagatagcaaagactctacatatagcttaagctcaaccttaacattaagtaaagcagattacgaaaaacataaagtatacgcatgcgaagtaacacaccaaggattaagttcaccagtaacaaaaagttttaacagaggagaatgc

SEQ ID NO: 61535 - RNA, 1350 nt, synthetic construct
  misc_feature 1..1350: note = derived and/or modified sequence opt11 from CDS (HC) w/o signal peptide encoded by mRNA R4008
  source 1..1350: mol_type = other RNA
caagttcaactcgtacaatccggcgccgaagtcaaagaacccggatccgcaatgaaagtatcctgcaaagcatccggaggaaccttctcctcagacgccttctgctgggtccgccaagcccccggccgaggactcgaatggatgggcggcatcatccccgtcttccagaccgccaattacggccccaacttccaaggccgagtcaccatctctgcagacgtctataccaccaccctctacctagaactcagcggactcacatccgaagacaccgccgtctacttctgcgcccgctccggagacggctacaactactacttccccctctggggacaaggaaccctagtcacagtaagctccgcctcaaccaaaggaccctccgtcttccccctagccccctcatcaaaatccacctccggcggcacggcagccctaggctgcctcgtcaaagactacttccccgaacccgtaaccgtctcctggaactcaggcgccctcaccagcggcgtccacaccttccccgcagtcctccaatcaagcggtctttactccctatcatccgtagtcaccgtcccatcaagctcgctaggcacccaaacttacatatgcaacgtcaaccacaaaccgtctaacaccaaagtcgacaagaaagtcgaacccaaatcttgcgacaaaacccacacatgcccaccctgccccgccccagaactacttgggggaccctcagtcttcctattcccgcccaaacctaaagacaccctaatgatctcgcgcaccccagaagttacctgcgtcgtcgtcgacgtctcccacgaagaccccgaagtcaaattcaactggtacgtagacggagtagaagttcacaacgccaaaacaaaacctcgcgaggaacaatacaactccacctaccgcgtcgtatctgttctcaccgtcctccaccaagactggctcaacggcaaagaatacaaatgcaaagtatcaaacaaagccctaccagcccccatcgagaaaacgatctcaaaagccaaaggccaacctcgcgaaccccaagtttacacacttcctccctcccgcgacgaactaactaaaaaccaagtatccctcacatgcctcgtcaaaggattctacccctccgacattgccgtggaatgggaatccaacggacaaccagaaaacaactacaaaacaaccccgcccgtcctcgattccgacggctcattcttcctttactccaaactcaccgtagacaaatcacgctggcaacaaggcaacgtcttctcctgctccgtcatgcacgaagccctccacaaccactacactcaaaaatccctctcactttcccccggcaaa

SEQ ID NO: 61536 - RNA, 642 nt, synthetic construct
  misc_feature 1..642: note = derived and/or modified sequence opt11 from CDS (LC) w/o signal peptide encoded by mRNA R4008
  source 1..642: mol_type = other RNA
gacatccaaatgacccaatccccctcaaccctctccggctccgtcggcgaccgcgtaaccatcacctgccgagcctcccaaaacatcggcccctggctcgcctggtaccaacaagaatccggcaaagccccaaaactcctcatctcccgcgcctccatcctcgaaagcggcgtcccatcccgattctccggcacaggcaccggcaccgaattcaccctcaccatcagctccctccaacccgacgacttcgccacctactactgccaacactacaacgcctactggggcacattcggccaaggaaccaaagtcgaaatcaaccgcaccgtcgccgccccctcagtcttcatcttcccaccctcagacgaacaactcaaatcaggcaccgcctccgtcgtatgcctcctcaacaacttctacccccgcgaagccaaagtccaatggaaagtcgacaacgcactccaatccggcaactcccaagaatccgtcaccgaacaagacagcaaagactcaacctactccctctcctcaaccctaaccctatccaaagccgactacgaaaaacacaaagtctacgcctgcgaagtcacacaccaaggcctatcctcacccgtcaccaaatcattcaaccgcggcgaatgc

SEQ ID NO: 61537 - protein, 475 aa, synthetic construct
  REGION 1..475: note = Protein (HC) encoded by mRNA R4008
MAVMAPRTLVLLLSGALALTQTWAGQVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61538 - protein, 239 aa, synthetic construct
  REGION 1..239: note = Protein (LC) encoded by mRNA R4008
MAVMAPRTLVLLLSGALALTQTWAGDIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61539 - RNA, 1428 nt, synthetic construct
  misc_feature 1..1428: note = CDS (HC) encoded by mRNA R4008
  source 1..1428: mol_type = other RNA
atggccgtgatggccccgcggaccctggtcctcctgctgagcggcgcgctcgccctgacccagacgtgggccgggcaggtgcagctcgtccagtccggggccgaggtgaaggagcccggcagcgccatgaaggtgtcctgcaaggccagcgggggcacgttctccagcgacgccttctgctgggtccggcaggcgccggggcgcggcctggagtggatgggcgggatcatccccgtgttccagaccgccaactacggccccaacttccaggggcgggtgaccatctccgccgacgtctacaccacgaccctgtacctcgagctgagcggcctgacctccgaggacaccgccgtgtacttctgcgcgcgcagcggggacggctacaactactacttccccctctggggccaggggacgctggtgaccgtctccagcgcctccaccaagggcccgagcgtgttccccctggccccctccagcaagtccaccagcgggggcacggccgccctcggctgcctggtgaaggactacttccccgagccggtcaccgtgtcctggaacagcggggcgctgaccagcggcgtgcacaccttccccgccgtcctccagtccagcgggctgtactccctgagctccgtggtgacggtccccagctccagcctcggcacccagacctacatctgcaacgtgaaccacaagccctccaacaccaaggtggacaagaaggtcgagcccaagagctgcgacaagacgcacacctgcccgccctgccccgccccggagctgctgggcgggccctccgtgttcctcttcccgcccaagccgaaggacaccctgatgatcagccggacccccgaggtcacgtgcgtggtggtcgacgtgtcccacgaggaccccgaggtgaagttcaactggtacgtcgacggcgtggaggtgcacaacgccaagaccaagccccgcgaggagcagtacaacagcacctaccgggtcgtgtccgtgctgaccgtcctccaccaggactggctgaacgggaaggagtacaagtgcaaggtgagcaacaaggccctgccggcgcccatcgagaagacgatctccaaggccaagggccagccccgcgagccccaggtgtacaccctcccgcccagccgggacgagctgaccaagaaccaggtctccctgacctgcctcgtgaaggggttctaccccagcgacatcgccgtggagtgggagagcaacggccagccggagaacaactacaagacgaccccgcccgtcctggactccgacgggagcttcttcctgtactccaagctcaccgtggacaagagccgctggcagcagggcaacgtgttctcctgcagcgtcatgcacgaggccctgcacaaccactacacccagaagtccctgagcctctcccccggcaagtga

SEQ ID NO: 61540 - RNA, 720 nt, synthetic construct
  misc_feature 1..720: note = CDS (LC) encoded by mRNA R4008
  source 1..720: mol_type = other RNA
atggccgtgatggccccgcggaccctggtcctcctgctgagcggcgcgctcgccctgacccagacgtgggccggggacatccagatgacccagagcccctccaccctcagcggctccgtcggggaccgggtgacgatcacctgccgcgcgagccagaacatcggcccctggctggcctggtaccagcaggagtccgggaaggcccccaagctgctcatcagccgggcctccatcctggagagcggcgtgccctcccgcttcagcggcaccgggaccggcacggagttcaccctgaccatctccagcctccagcccgacgacttcgccacctactactgccagcactacaacgcgtactgggggacgttcggccaggggaccaaggtcgagatcaaccggaccgtggccgccccgtccgtgttcatcttcccgccgagcgacgagcagctgaagtccggcaccgccagcgtcgtgtgcctgctcaacaacttctacccccgcgaggcgaaggtgcagtggaaggtcgacaacgccctgcagtccggcaacagccaggagtccgtgacggagcaggacagcaaggacagcacctactccctgagctccaccctcaccctgagcaaggccgactacgagaagcacaaggtgtacgcctgcgaggtcacgcaccaggggctgtccagccccgtgaccaagtccttcaaccggggcgagtgctga

SEQ ID NO: 61541 - RNA, 2819 nt, synthetic construct
  misc_feature 1..2819: note = CDS (HC)-IRES-CDS (LC) as RNA from mRNA R4008
  source 1..2819: mol_type = other RNA
atggccgtgatggccccgcggaccctggtcctcctgctgagcggcgcgctcgccctgacccagacgtgggccgggcaggtgcagctcgtccagtccggggccgaggtgaaggagcccggcagcgccatgaaggtgtcctgcaaggccagcgggggcacgttctccagcgacgccttctgctgggtccggcaggcgccggggcgcggcctggagtggatgggcgggatcatccccgtgttccagaccgccaactacggccccaacttccaggggcgggtgaccatctccgccgacgtctacaccacgaccctgtacctcgagctgagcggcctgacctccgaggacaccgccgtgtacttctgcgcgcgcagcggggacggctacaactactacttccccctctggggccaggggacgctggtgaccgtctccagcgcctccaccaagggcccgagcgtgttccccctggccccctccagcaagtccaccagcgggggcacggccgccctcggctgcctggtgaaggactacttccccgagccggtcaccgtgtcctggaacagcggggcgctgaccagcggcgtgcacaccttccccgccgtcctccagtccagcgggctgtactccctgagctccgtggtgacggtccccagctccagcctcggcacccagacctacatctgcaacgtgaaccacaagccctccaacaccaaggtggacaagaaggtcgagcccaagagctgcgacaagacgcacacctgcccgccctgccccgccccggagctgctgggcgggccctccgtgttcctcttcccgcccaagccgaaggacaccctgatgatcagccggacccccgaggtcacgtgcgtggtggtcgacgtgtcccacgaggaccccgaggtgaagttcaactggtacgtcgacggcgtggaggtgcacaacgccaagaccaagccccgcgaggagcagtacaacagcacctaccgggtcgtgtccgtgctgaccgtcctccaccaggactggctgaacgggaaggagtacaagtgcaaggtgagcaacaaggccctgccggcgcccatcgagaagacgatctccaaggccaagggccagccccgcgagccccaggtgtacaccctcccgcccagccgggacgagctgaccaagaaccaggtctccctgacctgcctcgtgaaggggttctaccccagcgacatcgccgtggagtgggagagcaacggccagccggagaacaactacaagacgaccccgcccgtcctggactccgacgggagcttcttcctgtactccaagctcaccgtggacaagagccgctggcagcagggcaacgtgttctcctgcagcgtcatgcacgaggccctgcacaaccactacacccagaagtccctgagcctctcccccggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggacatccagatgacccagagcccctccaccctcagcggctccgtcggggaccgggtgacgatcacctgccgcgcgagccagaacatcggcccctggctggcctggtaccagcaggagtccgggaaggcccccaagctgctcatcagccgggcctccatcctggagagcggcgtgccctcccgcttcagcggcaccgggaccggcacggagttcaccctgaccatctccagcctccagcccgacgacttcgccacctactactgccagcactacaacgcgtactgggggacgttcggccaggggaccaaggtcgagatcaaccggaccgtggccgccccgtccgtgttcatcttcccgccgagcgacgagcagctgaagtccggcaccgccagcgtcgtgtgcctgctcaacaacttctacccccgcgaggcgaaggtgcagtggaaggtcgacaacgccctgcagtccggcaacagccaggagtccgtgacggagcaggacagcaaggacagcacctactccctgagctccaccctcaccctgagcaaggccgactacgagaagcacaaggtgtacgcctgcgaggtcacgcaccaggggctgtccagccccgtgaccaagtccttcaaccggggcgagtgctga

SEQ ID NO: 61542 - RNA, 3023 nt, synthetic construct
  misc_feature 1..3023: note = R4008
  source 1..3023: mol_type = other RNA
gggagaaagcttaccatggccgtgatggccccgcggaccctggtcctcctgctgagcggcgcgctcgccctgacccagacgtgggccgggcaggtgcagctcgtccagtccggggccgaggtgaaggagcccggcagcgccatgaaggtgtcctgcaaggccagcgggggcacgttctccagcgacgccttctgctgggtccggcaggcgccggggcgcggcctggagtggatgggcgggatcatccccgtgttccagaccgccaactacggccccaacttccaggggcgggtgaccatctccgccgacgtctacaccacgaccctgtacctcgagctgagcggcctgacctccgaggacaccgccgtgtacttctgcgcgcgcagcggggacggctacaactactacttccccctctggggccaggggacgctggtgaccgtctccagcgcctccaccaagggcccgagcgtgttccccctggccccctccagcaagtccaccagcgggggcacggccgccctcggctgcctggtgaaggactacttccccgagccggtcaccgtgtcctggaacagcggggcgctgaccagcggcgtgcacaccttccccgccgtcctccagtccagcgggctgtactccctgagctccgtggtgacggtccccagctccagcctcggcacccagacctacatctgcaacgtgaaccacaagccctccaacaccaaggtggacaagaaggtcgagcccaagagctgcgacaagacgcacacctgcccgccctgccccgccccggagctgctgggcgggccctccgtgttcctcttcccgcccaagccgaaggacaccctgatgatcagccggacccccgaggtcacgtgcgtggtggtcgacgtgtcccacgaggaccccgaggtgaagttcaactggtacgtcgacggcgtggaggtgcacaacgccaagaccaagccccgcgaggagcagtacaacagcacctaccgggtcgtgtccgtgctgaccgtcctccaccaggactggctgaacgggaaggagtacaagtgcaaggtgagcaacaaggccctgccggcgcccatcgagaagacgatctccaaggccaagggccagccccgcgagccccaggtgtacaccctcccgcccagccgggacgagctgaccaagaaccaggtctccctgacctgcctcgtgaaggggttctaccccagcgacatcgccgtggagtgggagagcaacggccagccggagaacaactacaagacgaccccgcccgtcctggactccgacgggagcttcttcctgtactccaagctcaccgtggacaagagccgctggcagcagggcaacgtgttctcctgcagcgtcatgcacgaggccctgcacaaccactacacccagaagtccctgagcctctcccccggcaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggacatccagatgacccagagcccctccaccctcagcggctccgtcggggaccgggtgacgatcacctgccgcgcgagccagaacatcggcccctggctggcctggtaccagcaggagtccgggaaggcccccaagctgctcatcagccgggcctccatcctggagagcggcgtgccctcccgcttcagcggcaccgggaccggcacggagttcaccctgaccatctccagcctccagcccgacgacttcgccacctactactgccagcactacaacgcgtactgggggacgttcggccaggggaccaaggtcgagatcaaccggaccgtggccgccccgtccgtgttcatcttcccgccgagcgacgagcagctgaagtccggcaccgccagcgtcgtgtgcctgctcaacaacttctacccccgcgaggcgaaggtgcagtggaaggtcgacaacgccctgcagtccggcaacagccaggagtccgtgacggagcaggacagcaaggacagcacctactccctgagctccaccctcaccctgagcaaggccgactacgagaagcacaaggtgtacgcctgcgaggtcacgcaccaggggctgtccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61543 - protein, 457 aa, synthetic construct
  REGION 1..457: note = Protein (HC) w/o signal peptide encoded by mRNA R4010
QVKLLESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61544 - protein, 212 aa, synthetic construct
  REGION 1..212: note = Protein (LC) w/o signal peptide encoded by mRNA R4010
ELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61545 - RNA, 1371 nt, synthetic construct
  misc_feature 1..1371: note = CDS (HC) w/o signal peptide encoded by mRNA R4010
  source 1..1371: mol_type = other RNA
caggtgaagctgctcgagtccggcgggggcctggtgcagcccgggggcagcctgcgcctctcctgcgccgcgagcggcatcaccttctccagctacgccatgtcctgggtccggcaggccccggggaagggcctggagtgggtgagcaccgtgaactccgggggcgggagcacgtactacggcgactccgtccgcggccggttcaccatcagccgcgacaactccaagagcaccctgtacctccagctgaactccctgcgggccgaggacaccgccatctactactgcgcgaaggacaaggggcgccccatcttcggcctcgtgacgcccagctactacatggacgtgtgggggaacggcaccaccgtcaccgtgtccagcgcctccacgaagggccccagcgtgttcccgctggcccccagctccaagagcacctccgggggcaccgccgcgctggggtgcctcgtcaaggactacttccccgagcccgtgaccgtgagctggaactccggcgccctgacgagcggggtccacaccttccccgccgtgctgcagtccagcggcctctactccctgagctccgtggtcaccgtgcccagctccagcctgggcacccagacgtacatctgcaacgtgaaccacaagccctccaacaccaaggtcgacaagaaggtggagcccaagagctgcgacaagacccacacctgcccgccctgccccgccccggagctcctgggcgggccgtccgtgttcctgttcccgcccaagcccaaggacacgctcatgatcagccggaccccggaggtcacctgcgtggtcgtggacgtgtcccacgaggaccccgaggtcaagttcaactggtacgtggacggggtggaggtccacaacgccaagaccaagccccgcgaggagcagtacaacagcacgtaccgggtggtgagcgtcctgaccgtgctgcaccaggactggctcaacggcaaggagtacaagtgcaaggtgtccaacaaggcgctgcccgccccgatcgagaagaccatcagcaaggccaaggggcagccccgcgagccccaggtctacaccctgcccccgtcccgggacgagctcacgaagaaccaggtgagcctgacctgcctggtgaagggcttctacccctccgacatcgccgtcgagtgggagagcaacggccagcccgagaacaactacaagaccaccccgcccgtgctcgactccgacgggagcttcttcctgtactccaagctgacggtggacaagagccgctggcagcagggcaacgtcttctcctgcagcgtgatgcacgaggccctccacaaccactacacccagaagtccctgagcctgtcccccgggaag

SEQ ID NO: 61546 - RNA, 636 nt, synthetic construct
  misc_feature 1..636: note = CDS (LC) w/o signal peptide encoded by mRNA R4010
  source 1..636: mol_type = other RNA
gagctcacccagagcccctccagcctgtccgcgagcgtcggggactccgtgaccatcacgtgccggaccagcgagcgcatctccacctacctgaactggtaccagcagaagcccgggaaggccccgcggctcctggtgagcggcgcctccaccctgcagggcggcgtccccagccgcttctccgggagcgggtccggcacggccttcaccctcaccatcaacagcctgcagccggaggacttcgccacctactactgccagcagtcctacagcacgcccctgaccttcgggggcgggaccaaggtggagatcaagcggaccgtggcggccccctccgtcttcatcttcccgccgagcgacgagcagctcaagtccggcacggccagcgtggtgtgcctgctgaacaacttctacccccgcgaggccaaggtccagtggaaggtggacaacgcgctccagagcggcaactcccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgc

SEQ ID NO: 61547 - RNA, 1371 nt, synthetic construct
  misc_feature 1..1371: note = derived and/or modified sequence opt2 from CDS (HC) w/o signal peptide encoded by mRNA R4010
  source 1..1371: mol_type = other RNA
caggtcaagctcctcgagtccggcggcggcctcgtccagcccggcggctccctccgcctctcctgcgccgcctccggcatcaccttctcctcctacgccatgtcctgggtccgccaggcccccggcaagggcctcgagtgggtctccaccgtcaactccggcggcggctccacctactacggcgactccgtccgcggccgcttcaccatctcccgcgacaactccaagtccaccctctacctccagctcaactccctccgcgccgaggacaccgccatctactactgcgccaaggacaagggccgccccatcttcggcctcgtcaccccctcctactacatggacgtctggggcaacggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61548 - RNA, 636 nt, synthetic construct
  misc_feature 1..636: note = derived and/or modified sequence opt2 from CDS (LC) w/o signal peptide encoded by mRNA R4010
  source 1..636: mol_type = other RNA
gagctcacccagtccccctcctccctctccgcctccgtcggcgactccgtcaccatcacctgccgcacctccgagcgcatctccacctacctcaactggtaccagcagaagcccggcaaggccccccgcctcctcgtctccggcgcctccaccctccagggcggcgtcccctcccgcttctccggctccggctccggcaccgccttcaccctcaccatcaactccctccagcccgaggacttcgccacctactactgccagcagtcctactccacccccctcaccttcggcggcggcaccaaggtcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61549 - RNA, 1371 nt, synthetic construct
  misc_feature 1..1371: note = derived and/or modified sequence opt3 from CDS (HC) w/o signal peptide encoded by mRNA R4010
  source 1..1371: mol_type = other RNA
caggtgaagctgctcgagagcggcgggggacttgtccaacccggtggctccctgagattgtcttgcgccgcttcagggatcaccttcagtagctacgcaatgtcctgggttaggcaggcccctggaaaaggcttagaatgggtgtctacagtaaactcgggtgggggatcaacttattacggcgacagcgtgcggggccgctttacgattagtcgagataattccaagtctaccctgtatctacagctcaacagcctgcgtgcggaggacacagctatatactattgtgccaaagataaggggagaccaatcttcggacttgtcactccgtcctactatatggacgtgtggggtaatggcaccacagttaccgtgtcaagtgcaagcactaaagggccctctgtctttcctctggccccatcctcaaagagcacaagtggaggcaccgctgcattgggttgcctcgtgaaggattacttccccgaacctgtaacggtttcttggaactccggggccctgactagcggagtgcacacctttccagctgtcctgcagtcgtctggcctctactccttatcaagtgtggtgacagtccccagctcctctctgggcactcaaacctatatttgtaatgttaaccataaacctagcaatacaaaggtggacaaaaaggtagagccaaaatcatgcgataagacccacacgtgtccgccctgccctgccccagaacttttgggagggcccagtgtgttcctgtttcctccaaagcccaaagacactctaatgatctccaggacaccggaggtcacctgtgtggttgtggatgtcagccatgaggaccctgaagtgaagttcaactggtacgtagatggtgttgaggtgcacaatgcgaaaactaagccccgggaggaacagtataactctacataccgcgtcgtgtcagtcctcaccgtgctgcatcaggactggcttaatggcaaagagtataagtgcaaagttagtaacaaggcactgccagcccctattgaaaagacgatcagcaaagctaaggggcagcccagagagccacaagtgtacaccttgcccccttccagggatgaactcacaaagaatcaggtatctctgacttgtttagtcaagggattttatccatcggacatagccgtggagtgggaaagcaacggccagccggagaataactacaaaaccacaccccctgttctggactccgatggttcattctttctctacagtaaacttactgtggacaagtctcggtggcagcaagggaacgtcttcagctgctccgtgatgcacgaggcactgcacaatcattatacccagaaatcattgagcctatctccaggcaag

SEQ ID NO: 61550 - RNA, 636 nt, synthetic construct
  misc_feature 1..636: note = derived and/or modified sequence opt3 from CDS (LC) w/o signal peptide encoded by mRNA R4010
  source 1..636: mol_type = other RNA
gagctgacccagagcccctcctctctctcagccagtgtgggcgacagcgtcacaatcacttgcagaacgtccgaaaggatttctacctaccttaactggtatcaacagaagcctgggaaagctccacggctgttggtttcgggagcatcaacattacagggtggcgtgccgagccgcttcagtgggtccggatctggcactgcctttaccctgacaataaatagcctacagcccgaggatttcgcgacctactattgtcaacagtcctactcaactcctctcacatttggtgggggaaccaaggtagaaatcaaacgaacggtggctgccccaagtgtcttcatttttccccctagcgacgagcagctgaagtctggcactgcatccgtggtttgccttctgaacaatttctatccacgtgaagccaaagtgcagtggaaggtcgataacgctttgcaatcaggcaatagccaggagagtgtgaccgagcaggactctaaggattccacatacagcctctcgtctactctgaccctgtccaaagcagactatgaaaagcacaaagtatacgcctgtgaggttacacatcaggggctctcaagtcccgtgaccaagagctttaacagaggagaatgc

SEQ ID NO: 61551 - RNA, 1371 nt, synthetic construct
  misc_feature 1..1371: note = derived and/or modified sequence opt4 from CDS (HC) w/o signal peptide encoded by mRNA R4010
  source 1..1371: mol_type = other RNA
caggtgaagctgctggagagcggcggcggcctggtgcagcccggcggcagcctgagactgagctgcgccgccagcggcatcaccttcagcagctacgccatgagctgggtgagacaggcccccggcaagggcctggagtgggtgagcaccgtgaacagcggcggcggcagcacctactacggcgacagcgtgagaggcagattcaccatcagcagagacaacagcaagagcaccctgtacctgcagctgaacagcctgagagccgaggacaccgccatctactactgcgccaaggacaagggcagacccatcttcggcctggtgacccccagctactacatggacgtgtggggcaacggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61552 - RNA, 636 nt, synthetic construct
  misc_feature 1..636: note = derived and/or modified sequence opt4 from CDS (LC) w/o signal peptide encoded by mRNA R4010
  source 1..636: mol_type = other RNA
gagctgacccagagccccagcagcctgagcgccagcgtgggcgacagcgtgaccatcacctgcagaaccagcgagagaatcagcacctacctgaactggtaccagcagaagcccggcaaggcccccagactgctggtgagcggcgccagcaccctgcagggcggcgtgcccagcagattcagcggcagcggcagcggcaccgccttcaccctgaccatcaacagcctgcagcccgaggacttcgccacctactactgccagcagagctacagcacccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61553 - RNA, 1371 nt, synthetic construct
  misc_feature 1..1371: note = derived and/or modified sequence opt5 from CDS (HC) w/o signal peptide encoded by mRNA R4010
  source 1..1371: mol_type = other RNA
caggtgaagctgctcgagagcggcgggggactggtccaacccggcgggtcccttagactgtcttgcgccgctagcggaatcaccttctcctcttacgccatgagctgggttcggcaggcgcctggcaaagggctcgaatgggtgtccacagtgaactctggaggcggcagcacgtattacggggactccgtccgcggaagatttaccattagccgggataattctaagtccacactgtatcttcagctgaacagcctccgcgctgaggacaccgccatctactattgtgccaaagataagggcagaccgattttcgggctggtgacaccctcttactatatggacgtttggggaaatggcaccacagtgaccgtctccagcgcttctacgaaagggccttccgtgtttcccctggcccctagctccaagtctaccagcggaggcacagctgccctcggctgcctggttaaggattacttccccgaacctgtgaccgtctcctggaacagcggggcgcttacatctggagtgcacacctttccggccgtgctgcagtccagcggcctctactctctgagctccgtcgttacggtgccctctagctcccttgggacacaaacctatatctgtaatgtgaaccataaacctagcaatacaaaggtcgacaaaaaggtggagcccaaatcttgcgataagacccacacctgtcctccctgcccggctcctgaactgctcggaggcccctccgttttcctgtttcctcccaagcccaaagacacactgatgattagccggacgcctgaggtgacctgtgtcgtggttgatgtgtctcatgaggacccggaagtcaagttcaactggtacgtggatggggtcgaggtgcacaatgccaaaacaaagccccgcgaggaacagtataactccacctacagagttgtgagcgtcctcacagtgctgcatcaggactggcttaatggaaaagagtataagtgcaaagtttccaacaaggctctgcctgcccccatcgaaaagaccatctctaaagcgaagggccagcctcgggagccccaagtgtacacgctcccgcctagccgcgatgaactgaccaaaaatcaggtctcccttacatgtctggtgaagggcttttatccctctgacattgccgtggagtgggaaagcaacgggcagcctgagaataactacaaaaccacaccccctgttctcgactccgatggcagcttctttctgtactctaagctgaccgtcgacaagtccagatggcagcaaggaaacgtgttcagctgctctgtgatgcacgaggctctccacaatcattatacacagaaatccctgagcctttctcccgggaag

SEQ ID NO: 61554 - RNA, 636 nt, synthetic construct
  misc_feature 1..636: note = derived and/or modified sequence opt5 from CDS (LC) w/o signal peptide encoded by mRNA R4010
  source 1..636: mol_type = other RNA
gagctgacccagagcccctcctctctcagcgcctccgtgggcgactctgtcacaatcacgtgcagaaccagcgaacggatttccacatacctgaactggtatcaacagaagcctgggaaagctccgcgccttctggtttctggagccagcaccctccagggcggggtgccctccagattcagcggatctggctccgggacagcgtttaccctgacaatcaatagccttcagcctgaggatttcgctacctactattgtcaacagtcttactccacgcccctgacctttggaggcggcacaaaggtggaaattaaacggaccgtcgccgcccctagcgtgttcatctttcccccttctgacgagcagctcaagtccgggacagctagcgttgtgtgcctgctgaacaatttctatccgcgcgaagccaaagtccagtggaaggtggataacgctctccaatccggaaattctcaggagagcgttaccgagcaggactccaaggatagcacgtactctctgtccagcacacttaccctgtctaaagccgactatgaaaagcacaaagtgtacgcgtgtgaggtcacacatcagggcctcagctcccccgtgaccaagtcttttaacagaggggaatgc

SEQ ID NO: 61555 - RNA, 1371 nt, synthetic construct
  misc_feature 1..1371: note = derived and/or modified sequence opt6 from CDS (HC) w/o signal peptide encoded by mRNA R4010
  source 1..1371: mol_type = other RNA
caagtcaaactattagaatctggaggcggacttgtacaaccaggcgggagcctaagactttcatgtgcagcatctggtataacattctcatcatacgcaatgtcatgggtacgacaagcaccaggaaaaggattagaatgggtatcaacagtaaatagcggaggcggttcaacttactatggagactcagtacgtggcagattcacaatatcaagagataactctaaatcaacattatatctacaattaaattcactaagagcagaagacaccgctatatactattgtgccaaagacaaaggaagaccaatattcggactagtaacaccatcttactacatggatgtatggggaaatggaacaactgtaacagtctcaagcgcatcaacaaaaggaccatcagtatttcctctagcaccatcctcaaaatcaacatccggaggaacagcagctctaggatgcctcgtaaaagactactttccagaaccagtaaccgtatcatggaactcaggagctctaacatcaggtgtccacacctttcctgccgtacttcaatcatcaggattatattcactaagctcagtagttaccgtaccaagttccagtctaggaactcaaacctacatatgcaacgttaaccacaaaccttcaaatacaaaagtagacaaaaaagtagaaccaaaatcttgcgacaaaacacacacatgtccaccatgcccagccccagaattactaggaggcccatcagtattcttattccctccaaaaccaaaagacacattaatgatatctagaacaccagaagtaacatgcgttgttgtagacgtatcacatgaagatccagaagtaaaattcaactggtatgtagatggagtagaagtacacaatgccaaaactaaaccaagagaagaacaatataactctacataccgagtcgtttcagtactaacagtactccatcaagactggctcaatggaaaagaatacaaatgcaaagtatcaaacaaagccttaccagcaccaatagaaaaaaccatttcaaaagcaaaaggacaacctagagaaccacaagtatacacacttcccccatcaagagacgaattaactaaaaaccaagtaagccttacatgcctcgtcaaaggattttacccaagcgacatagcagtagaatgggaatcaaatggacaaccagaaaacaactataaaacaacacccccagttctagattccgacggatctttcttcctctactcaaaactaacagttgacaaatcaagatggcaacaaggaaacgttttctcatgctcagttatgcacgaagcactacataatcattatactcaaaaatcactatcactatcacctggaaaa

SEQ ID NO: 61556 - RNA, 636 nt, synthetic construct
  misc_feature 1..636: note = derived and/or modified sequence opt6 from CDS (LC) w/o signal peptide encoded by mRNA R4010
  source 1..636: mol_type = other RNA
gaactcacacaaagcccatcatcattatcagcatcagtaggagactcagtaacaataacatgtagaacatcagaaagaatatcaacatacctaaattggtaccaacaaaaaccaggaaaagcaccaagactcctagtatcaggagcaagcacactacaaggaggagtaccatcaagattctcaggatcaggatccggaacagcattcacactaacaatcaactcactacaaccagaagacttcgcaacatactactgtcaacaatcatactcaacaccactaacattcggcggaggaacaaaagtagaaataaaaagaacagtagcagcaccatcagtattcatattcccaccatcagacgaacaactaaaatcaggcacagcatcagtagtatgcctactaaacaacttctacccaagagaagcaaaagtacaatggaaagtagacaacgcactacaatcaggaaactcacaagaatcagtcacagaacaagactccaaagactcaacatactccctatcatcaacactaaccctatcaaaagcagactacgaaaaacataaagtatacgcatgcgaagtaacacaccaaggactatcatcaccagtaacaaaatcattcaacagaggagaatgc

SEQ ID NO: 61557 - RNA, 1371 nt, synthetic construct
  misc_feature 1..1371: note = derived and/or modified sequence opt11 from CDS (HC) w/o signal peptide encoded by mRNA R4010
  source 1..1371: mol_type = other RNA
caagtcaaactactagagtcaggcggcggcctagtccaacccggcggctcactccgactcagctgcgccgccagcggaatcaccttctcatcatacgccatgtcctgggtccgacaagcccccgggaaaggcctagaatgggtctccaccgtgaacagtggcggaggctccacttactacggcgactccgtccgcggccgattcaccatttcacgcgacaactccaaaagcaccctatacctccaactaaatagcctccgcgccgaagatactgcaatatactactgcgccaaagacaaaggccgacccatcttcggcctcgtcacaccctcctactacatggacgtctggggaaacggaaccaccgtcaccgtatcatccgcctcaacaaaaggcccatccgtcttcccactagcaccaagcagcaaatctacctcaggcggcaccgccgcactcggctgtctcgtaaaagactactttcccgaaccagtaaccgtatcatggaactccggcgccctaacctccggagtccacaccttccccgccgtcctacaatcctcaggactctactccctaagttcagtcgtgaccgtcccctcctccagccttggcacccaaacctacatctgcaacgtgaatcacaaaccctccaacaccaaagtcgataagaaagtcgaacctaaatcctgcgacaaaacacacacctgtccaccctgccccgcgcccgagctccttggaggccccagcgtcttcctattccctcccaaacccaaagacaccctcatgatatcccgcacacccgaagtaacctgcgtcgtcgtcgacgtatcacacgaagacccagaagtaaaattcaactggtacgtcgacggagtcgaagtccacaacgccaaaaccaaaccacgagaagaacaatacaattcaacgtatagagtcgtctcagtccttacagtcctccatcaagactggctcaacggaaaagaatacaaatgcaaagtctccaacaaagccctacccgcccccatcgagaaaaccatctcaaaagcaaaaggccaacccagagaaccccaagtctacacactaccaccctcacgcgacgaactcactaaaaaccaagtctcactgacctgcctcgtaaaaggcttttacccctccgacatcgcagtagaatgggaatcaaacggccaacccgaaaacaactacaagaccaccccacccgtactcgactctgacggatccttcttcctctactccaaactcaccgtcgacaaatcccgctggcaacaaggcaacgtcttctcctgcagcgtcatgcacgaagctctccacaaccactacacacaaaaatcactctcactatcccccggcaag

SEQ ID NO: 61558 - RNA, 636 nt, synthetic construct
  misc_feature 1..636: note = derived and/or modified sequence opt11 from CDS (LC) w/o signal peptide encoded by mRNA R4010
  source 1..636: mol_type = other RNA
gaactcacccaatcaccatcatccctctccgcctcagtcggcgactccgtcacaataacctgccgcacctccgaacgaatctccacatacctcaactggtaccaacaaaaacccggcaaagcccccagactcctagtctccggcgcctcaaccctccaaggcggcgtcccctcccgattctccggctccggctccggcaccgccttcaccctcaccatcaactccctacaacccgaagacttcgccacctactactgccaacaatcctattcaacacccctcaccttcggcggaggaaccaaagtcgaaatcaaacgcaccgtcgccgccccctccgtcttcatattcccaccctccgacgaacaactcaaatccggcaccgcctcagtcgtctgcctcctcaacaacttctacccccgcgaagccaaagtccaatggaaagttgacaacgccctccaatcaggaaactcccaagaatccgtcaccgaacaagacagcaaagactccacctactccctctcctccaccctgaccctctccaaagccgactacgaaaaacacaaagtctacgcctgcgaagtcacccaccaaggcctaagctcccccgtcaccaagagcttcaaccgcggcgaatgc

SEQ ID NO: 61559 - protein, 482 aa, synthetic construct
  REGION 1..482: note = Protein (HC) encoded by mRNA R4010
MAVMAPRTLVLLLSGALALTQTWAGQVKLLESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61560 - protein, 237 aa, synthetic construct
  REGION 1..237: note = Protein (LC) encoded by mRNA R4010
MAVMAPRTLVLLLSGALALTQTWAGELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61561 - RNA, 1449 nt, synthetic construct
  misc_feature 1..1449: note = CDS (HC) encoded by mRNA R4010
  source 1..1449: mol_type = other RNA
atggccgtgatggccccgcggaccctggtcctcctgctgagcggcgcgctcgccctgacccagacgtgggccgggcaggtgaagctgctcgagtccggcgggggcctggtgcagcccgggggcagcctgcgcctctcctgcgccgcgagcggcatcaccttctccagctacgccatgtcctgggtccggcaggccccggggaagggcctggagtgggtgagcaccgtgaactccgggggcgggagcacgtactacggcgactccgtccgcggccggttcaccatcagccgcgacaactccaagagcaccctgtacctccagctgaactccctgcgggccgaggacaccgccatctactactgcgcgaaggacaaggggcgccccatcttcggcctcgtgacgcccagctactacatggacgtgtgggggaacggcaccaccgtcaccgtgtccagcgcctccacgaagggccccagcgtgttcccgctggcccccagctccaagagcacctccgggggcaccgccgcgctggggtgcctcgtcaaggactacttccccgagcccgtgaccgtgagctggaactccggcgccctgacgagcggggtccacaccttccccgccgtgctgcagtccagcggcctctactccctgagctccgtggtcaccgtgcccagctccagcctgggcacccagacgtacatctgcaacgtgaaccacaagccctccaacaccaaggtcgacaagaaggtggagcccaagagctgcgacaagacccacacctgcccgccctgccccgccccggagctcctgggcgggccgtccgtgttcctgttcccgcccaagcccaaggacacgctcatgatcagccggaccccggaggtcacctgcgtggtcgtggacgtgtcccacgaggaccccgaggtcaagttcaactggtacgtggacggggtggaggtccacaacgccaagaccaagccccgcgaggagcagtacaacagcacgtaccgggtggtgagcgtcctgaccgtgctgcaccaggactggctcaacggcaaggagtacaagtgcaaggtgtccaacaaggcgctgcccgccccgatcgagaagaccatcagcaaggccaaggggcagccccgcgagccccaggtctacaccctgcccccgtcccgggacgagctcacgaagaaccaggtgagcctgacctgcctggtgaagggcttctacccctccgacatcgccgtcgagtgggagagcaacggccagcccgagaacaactacaagaccaccccgcccgtgctcgactccgacgggagcttcttcctgtactccaagctgacggtggacaagagccgctggcagcagggcaacgtcttctcctgcagcgtgatgcacgaggccctccacaaccactacacccagaagtccctgagcctgtcccccgggaagtga

SEQ ID NO: 61562 - RNA, 714 nt, synthetic construct
  misc_feature 1..714: note = CDS (LC) encoded by mRNA R4010
  source 1..714: mol_type = other RNA
atggccgtgatggccccgcggaccctggtcctcctgctgagcggcgcgctcgccctgacccagacgtgggccggggagctcacccagagcccctccagcctgtccgcgagcgtcggggactccgtgaccatcacgtgccggaccagcgagcgcatctccacctacctgaactggtaccagcagaagcccgggaaggccccgcggctcctggtgagcggcgcctccaccctgcagggcggcgtccccagccgcttctccgggagcgggtccggcacggccttcaccctcaccatcaacagcctgcagccggaggacttcgccacctactactgccagcagtcctacagcacgcccctgaccttcgggggcgggaccaaggtggagatcaagcggaccgtggcggccccctccgtcttcatcttcccgccgagcgacgagcagctcaagtccggcacggccagcgtggtgtgcctgctgaacaacttctacccccgcgaggccaaggtccagtggaaggtggacaacgcgctccagagcggcaactcccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgctga

SEQ ID NO: 61563 - RNA, 2834 nt, synthetic construct
  misc_feature 1..2834: note = CDS (HC)-IRES-CDS (LC) as RNA from mRNA R4010
  source 1..2834: mol_type = other RNA
atggccgtgatggccccgcggaccctggtcctcctgctgagcggcgcgctcgccctgacccagacgtgggccgggcaggtgaagctgctcgagtccggcgggggcctggtgcagcccgggggcagcctgcgcctctcctgcgccgcgagcggcatcaccttctccagctacgccatgtcctgggtccggcaggccccggggaagggcctggagtgggtgagcaccgtgaactccgggggcgggagcacgtactacggcgactccgtccgcggccggttcaccatcagccgcgacaactccaagagcaccctgtacctccagctgaactccctgcgggccgaggacaccgccatctactactgcgcgaaggacaaggggcgccccatcttcggcctcgtgacgcccagctactacatggacgtgtgggggaacggcaccaccgtcaccgtgtccagcgcctccacgaagggccccagcgtgttcccgctggcccccagctccaagagcacctccgggggcaccgccgcgctggggtgcctcgtcaaggactacttccccgagcccgtgaccgtgagctggaactccggcgccctgacgagcggggtccacaccttccccgccgtgctgcagtccagcggcctctactccctgagctccgtggtcaccgtgcccagctccagcctgggcacccagacgtacatctgcaacgtgaaccacaagccctccaacaccaaggtcgacaagaaggtggagcccaagagctgcgacaagacccacacctgcccgccctgccccgccccggagctcctgggcgggccgtccgtgttcctgttcccgcccaagcccaaggacacgctcatgatcagccggaccccggaggtcacctgcgtggtcgtggacgtgtcccacgaggaccccgaggtcaagttcaactggtacgtggacggggtggaggtccacaacgccaagaccaagccccgcgaggagcagtacaacagcacgtaccgggtggtgagcgtcctgaccgtgctgcaccaggactggctcaacggcaaggagtacaagtgcaaggtgtccaacaaggcgctgcccgccccgatcgagaagaccatcagcaaggccaaggggcagccccgcgagccccaggtctacaccctgcccccgtcccgggacgagctcacgaagaaccaggtgagcctgacctgcctggtgaagggcttctacccctccgacatcgccgtcgagtgggagagcaacggccagcccgagaacaactacaagaccaccccgcccgtgctcgactccgacgggagcttcttcctgtactccaagctgacggtggacaagagccgctggcagcagggcaacgtcttctcctgcagcgtgatgcacgaggccctccacaaccactacacccagaagtccctgagcctgtcccccgggaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggagctcacccagagcccctccagcctgtccgcgagcgtcggggactccgtgaccatcacgtgccggaccagcgagcgcatctccacctacctgaactggtaccagcagaagcccgggaaggccccgcggctcctggtgagcggcgcctccaccctgcagggcggcgtccccagccgcttctccgggagcgggtccggcacggccttcaccctcaccatcaacagcctgcagccggaggacttcgccacctactactgccagcagtcctacagcacgcccctgaccttcgggggcgggaccaaggtggagatcaagcggaccgtggcggccccctccgtcttcatcttcccgccgagcgacgagcagctcaagtccggcacggccagcgtggtgtgcctgctgaacaacttctacccccgcgaggccaaggtccagtggaaggtggacaacgcgctccagagcggcaactcccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgctga

SEQ ID NO: 61564 - RNA, 3026 nt, synthetic construct
  misc_feature 1..3026: note = R4010
  source 1..3026: mol_type = other RNA
gggagaaagcttaccatggccgtgatggccccgcggaccctggtcctcctgctgagcggcgcgctcgccctgacccagacgtgggccgggcaggtgaagctgctcgagtccggcgggggcctggtgcagcccgggggcagcctgcgcctctcctgcgccgcgagcggcatcaccttctccagctacgccatgtcctgggtccggcaggccccggggaagggcctggagtgggtgagcaccgtgaactccgggggcgggagcacgtactacggcgactccgtccgcggccggttcaccatcagccgcgacaactccaagagcaccctgtacctccagctgaactccctgcgggccgaggacaccgccatctactactgcgcgaaggacaaggggcgccccatcttcggcctcgtgacgcccagctactacatggacgtgtgggggaacggcaccaccgtcaccgtgtccagcgcctccacgaagggccccagcgtgttcccgctggcccccagctccaagagcacctccgggggcaccgccgcgctggggtgcctcgtcaaggactacttccccgagcccgtgaccgtgagctggaactccggcgccctgacgagcggggtccacaccttccccgccgtgctgcagtccagcggcctctactccctgagctccgtggtcaccgtgcccagctccagcctgggcacccagacgtacatctgcaacgtgaaccacaagccctccaacaccaaggtcgacaagaaggtggagcccaagagctgcgacaagacccacacctgcccgccctgccccgccccggagctcctgggcgggccgtccgtgttcctgttcccgcccaagcccaaggacacgctcatgatcagccggaccccggaggtcacctgcgtggtcgtggacgtgtcccacgaggaccccgaggtcaagttcaactggtacgtggacggggtggaggtccacaacgccaagaccaagccccgcgaggagcagtacaacagcacgtaccgggtggtgagcgtcctgaccgtgctgcaccaggactggctcaacggcaaggagtacaagtgcaaggtgtccaacaaggcgctgcccgccccgatcgagaagaccatcagcaaggccaaggggcagccccgcgagccccaggtctacaccctgcccccgtcccgggacgagctcacgaagaaccaggtgagcctgacctgcctggtgaagggcttctacccctccgacatcgccgtcgagtgggagagcaacggccagcccgagaacaactacaagaccaccccgcccgtgctcgactccgacgggagcttcttcctgtactccaagctgacggtggacaagagccgctggcagcagggcaacgtcttctcctgcagcgtgatgcacgaggccctccacaaccactacacccagaagtccctgagcctgtcccccgggaagtgattgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggagctcacccagagcccctccagcctgtccgcgagcgtcggggactccgtgaccatcacgtgccggaccagcgagcgcatctccacctacctgaactggtaccagcagaagcccgggaaggccccgcggctcctggtgagcggcgcctccaccctgcagggcggcgtccccagccgcttctccgggagcgggtccggcacggccttcaccctcaccatcaacagcctgcagccggaggacttcgccacctactactgccagcagtcctacagcacgcccctgaccttcgggggcgggaccaaggtggagatcaagcggaccgtggcggccccctccgtcttcatcttcccgccgagcgacgagcagctcaagtccggcacggccagcgtggtgtgcctgctgaacaacttctacccccgcgaggccaaggtccagtggaaggtggacaacgcgctccagagcggcaactcccaggagagcgtgaccgagcaggactccaaggacagcacctactccctgagctccaccctgacgctcagcaaggccgactacgagaagcacaaggtctacgcctgcgaggtgacccaccaggggctgtccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61565 - protein, 448 aa, synthetic construct; identical to SEQ ID NO: 484
  REGION 1..448: note = Protein (HC) w/o signal peptide encoded by mRNA R5417

SEQ ID NO: 61566 - RNA, 1344 nt, synthetic construct; identical to SEQ ID NO: 8126
  misc_feature 1..1344: note = CDS (HC) w/o signal peptide encoded by mRNA R5417
  source 1..1344: mol_type = other RNA

SEQ ID NO: 61567 - RNA, 1344 nt, synthetic construct; identical to SEQ ID NO: 15768
  misc_feature 1..1344: note = derived and/or modified sequence opt2 from CDS (HC) w/o signal peptide encoded by mRNA R5417
  source 1..1344: mol_type = other RNA

SEQ ID NO: 61568 - RNA, 1344 nt, synthetic construct; identical to SEQ ID NO: 23410
  misc_feature 1..1344: note = derived and/or modified sequence opt3 from CDS (HC) w/o signal peptide encoded by mRNA R5417
  source 1..1344: mol_type = other RNA

SEQ ID NO: 61569 - RNA, 1344 nt, synthetic construct; identical to SEQ ID NO: 31052
  misc_feature 1..1344: note = derived and/or modified sequence opt4 from CDS (HC) w/o signal peptide encoded by mRNA R5417
  source 1..1344: mol_type = other RNA

SEQ ID NO: 61570 - RNA, 1344 nt, synthetic construct; identical to SEQ ID NO: 38694
  misc_feature 1..1344: note = derived and/or modified sequence opt5 from CDS (HC) w/o signal peptide encoded by mRNA R5417
  source 1..1344: mol_type = other RNA

SEQ ID NO: 61571 - RNA, 1344 nt, synthetic construct
  misc_feature 1..1344: note = derived and/or modified sequence opt6 from CDS (HC) w/o signal peptide encoded by mRNA R5417
  source 1..1344: mol_type = other RNA
caagttcaactagtagaatcaggaggaggagtcgtccaaccaggcagatcactaagactatcatgtgcagcctctggcttcacattctcttcttatacaatgcactgggtaagacaagcaccaggaaaaggactagaatgggtaacattcatatcttacgacggaaataacaaatattacgctgattctgtaaaaggtagattcacaatttctagagacaatagtaaaaatacattatacctccaaatgaatagtcttagagcagaagatacagcaatatactattgtgcacgaacaggatggttaggaccattcgattactggggtcaaggaacattagtaacagtatcatctgcatcaacaaaaggtccttcagtattcccactcgcaccatcatcaaaatccacatcaggaggaactgcagccctcggatgcctagtcaaagactacttcccagaaccagtaaccgtatcttggaactccggagcattaacatctggagtacatacattccctgcagtactccaatcatcaggactatactcactatcctccgtagtaaccgtcccttcatcatctctaggtacacaaacttacatatgcaacgtaaatcacaaaccatctaatacaaaagtagacaaaagagtcgaaccaaaatcatgcgacaaaacccacacatgccccccatgcccagcacccgaactactcggaggaccatcagtatttctatttccaccaaaaccaaaagatacactaatgatatcacgaacacctgaagtaacctgtgttgtcgtcgacgtatcgcacgaagacccagaagtaaaatttaattggtacgtagacggtgtagaagttcacaatgcaaaaacaaaaccaagagaagaacaatacaactcaacatatagagtagtttctgtcttaaccgtcttacaccaagattggttaaacggtaaagaatataaatgcaaagtatctaataaagctctacccgccccaatcgaaaaaacaatatcaaaagccaaaggccaacctcgagaaccacaagtatacacactacccccttcaagagatgaactaacaaaaaaccaagtaagcctaacatgcctagtaaaaggcttttatccatcagacatagcagtagaatgggaatctaacggtcaacctgaaaataactataaaacaacaccaccagtactagactcagatggatcattctttctatactcaaaattaacagtagataaatcaagatggcaacaaggaaacgttttttcttgttctgtaatgcacgaagcactacacaatcactatacccaaaaatctctcagcctatcacccggaaaa

SEQ ID NO: 61572 - RNA, 1344 nt, synthetic construct
  misc_feature 1..1344: note = derived and/or modified sequence opt11 from CDS (HC) w/o signal peptide encoded by mRNA R5417
  source 1..1344: mol_type = other RNA
caagttcaactcgtagaatcaggaggaggcgtcgtccaaccaggccgctccctccgcctatcctgcgccgcatccggcttcactttctccagctacaccatgcactgggtccgacaggcccccggaaaaggcctcgaatgggtcacattcatcagctacgacggaaacaacaaatactacgccgactccgtcaaaggccgcttcaccatctctcgtgacaacagcaaaaacaccctctacctccaaatgaactccctccgcgccgaagacactgcaatctactactgtgcacgcactggctggctcggccccttcgactactggggccaaggcacactcgtcaccgtctcctcagcctccaccaaaggcccctccgtcttccccctggcaccctcctcaaaatctacatccggaggaaccgcagcccttggctgcctcgtaaaagactatttcccagaacccgtaacagtctcctggaacagcggcgcgctcacctccggcgtccacaccttccccgccgtcctccaatcatccggcctctactcactctcctccgtagtaaccgttccctcgtcgtctctcggaacccaaacctacatatgcaacgtcaaccataaaccatccaacacaaaggtagataaaagagtcgaacctaaatcctgcgacaagacccatacctgcccaccctgcccggccccagaacttctcggcggcccctcagtattcctctttcccccgaaacccaaagacacactaatgatctccagaacacccgaagtaacctgcgtcgtcgtagacgtctcacacgaagacccagaagtcaaattcaactggtacgtagacggcgtcgaagtacacaacgccaagacaaaaccccgcgaagaacaatacaactccacctatcgcgtcgtcagcgtccttaccgtactccaccaagactggctcaacggcaaagaatacaaatgcaaagtatcaaacaaagcactccccgcccctattgagaaaaccatctccaaagcgaaaggccaaccccgagaaccccaagtatatacactaccaccctcacgcgacgaactcaccaaaaaccaagtgtccctaacctgcctcgtcaagggcttctacccctccgacatcgccgtagaatgggaatccaacggccagccagaaaacaactacaaaaccacccctcccgtactagactccgacggatcattcttcctgtactccaaactcaccgtcgacaaatcccgatggcaacaaggcaacgtattctcatgctccgtcatgcacgaagccctacacaaccactacacccaaaagtccctctccctctcacccggcaaa

SEQ ID NO: 61573 - protein, 467 aa, synthetic construct
  REGION 1..467: note = Protein (HC) encoded by mRNA R5417
MELGLSWIFLLAILKGVQCQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61574 - RNA, 1404 nt, synthetic construct
  misc_feature 1..1404: note = CDS (HC) encoded by mRNA R5417
  source 1..1404: mol_type = other RNA
atggagctgggcctcagctggatcttcctgctggccatcctcaagggggtgcagtgccaggtgcagctggtcgagagcggcgggggcgtggtgcagcccgggcgctccctccggctgagctgcgccgcctccggcttcaccttcagctcctacaccatgcactgggtccgccaggcgccggggaagggcctggagtgggtgacgttcatcagctacgacggcaacaacaagtactacgccgactccgtgaaggggcggttcaccatcagccgcgacaactccaagaacaccctctacctgcagatgaacagcctgcgggccgaggacaccgccatctactactgcgcccgcacgggctggctcgggcccttcgactactggggccaggggaccctggtcaccgtgtccagcgcgtccaccaagggccccagcgtgttccccctggccccgtccagcaagtccacgagcggcgggaccgccgccctcggctgcctggtcaaggactacttccccgagcccgtgaccgtgtcctggaacagcggggcgctgaccagcggcgtccacacgttccccgccgtgctccagtccagcggcctgtactccctgagctccgtggtcaccgtgccgagctccagcctcgggacccagacctacatctgcaacgtgaaccacaagccctccaacacgaaggtcgacaagcgggtggagcccaagagctgcgacaagacccacacgtgcccgccctgccccgcccccgagctgctgggcgggccctccgtgttcctcttcccgcccaagcccaaggacaccctgatgatcagccgcacccccgaggtgacctgcgtcgtggtcgacgtgtcccacgaggacccggaggtcaagttcaactggtacgtggacggcgtggaggtccacaacgccaagaccaagccccgggaggagcagtacaacagcacctaccgcgtggtgtccgtcctgacggtgctccaccaggactggctgaacgggaaggagtacaagtgcaaggtgagcaacaaggccctgcccgcgcccatcgagaagaccatctccaaggccaagggccagccgcgggagccccaggtctacaccctcccgcccagccgcgacgagctgaccaagaaccaggtgtccctgacgtgcctcgtgaagggcttctaccccagcgacatcgccgtcgagtgggagagcaacgggcagcccgagaacaactacaagaccacgcccccggtgctggactccgacggcagcttcttcctgtactccaagctcaccgtggacaagagccggtggcagcaggggaacgtcttctcctgcagcgtgatgcacgaggccctgcacaaccactacacccagaagtccctgagcctctcccccggcaagtga

SEQ ID NO: 61575 - RNA, 1621 nt, synthetic construct
  misc_feature 1..1621: note = R5417
  source 1..1621: mol_type = other RNA
gggagaaagcttaccatggagctgggcctcagctggatcttcctgctggccatcctcaagggggtgcagtgccaggtgcagctggtcgagagcggcgggggcgtggtgcagcccgggcgctccctccggctgagctgcgccgcctccggcttcaccttcagctcctacaccatgcactgggtccgccaggcgccggggaagggcctggagtgggtgacgttcatcagctacgacggcaacaacaagtactacgccgactccgtgaaggggcggttcaccatcagccgcgacaactccaagaacaccctctacctgcagatgaacagcctgcgggccgaggacaccgccatctactactgcgcccgcacgggctggctcgggcccttcgactactggggccaggggaccctggtcaccgtgtccagcgcgtccaccaagggccccagcgtgttccccctggccccgtccagcaagtccacgagcggcgggaccgccgccctcggctgcctggtcaaggactacttccccgagcccgtgaccgtgtcctggaacagcggggcgctgaccagcggcgtccacacgttccccgccgtgctccagtccagcggcctgtactccctgagctccgtggtcaccgtgccgagctccagcctcgggacccagacctacatctgcaacgtgaaccacaagccctccaacacgaaggtcgacaagcgggtggagcccaagagctgcgacaagacccacacgtgcccgccctgccccgcccccgagctgctgggcgggccctccgtgttcctcttcccgcccaagcccaaggacaccctgatgatcagccgcacccccgaggtgacctgcgtcgtggtcgacgtgtcccacgaggacccggaggtcaagttcaactggtacgtggacggcgtggaggtccacaacgccaagaccaagccccgggaggagcagtacaacagcacctaccgcgtggtgtccgtcctgacggtgctccaccaggactggctgaacgggaaggagtacaagtgcaaggtgagcaacaaggccctgcccgcgcccatcgagaagaccatctccaaggccaagggccagccgcgggagccccaggtctacaccctcccgcccagccgcgacgagctgaccaagaaccaggtgtccctgacgtgcctcgtgaagggcttctaccccagcgacatcgccgtcgagtgggagagcaacgggcagcccgagaacaactacaagaccacgcccccggtgctggactccgacggcagcttcttcctgtactccaagctcaccgtggacaagagccggtggcagcaggggaacgtcttctcctgcagcgtgatgcacgaggccctgcacaaccactacacccagaagtccctgagcctctcccccggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61576 - protein, 215 aa, synthetic construct; identical to SEQ ID NO: 485
  REGION 1..215: note = Protein (LC) w/o signal peptide encoded by mRNA R5418

SEQ ID NO: 61577 - RNA, 645 nt, synthetic construct; identical to SEQ ID NO: 8127
  misc_feature 1..645: note = CDS (LC) w/o signal peptide encoded by mRNA R5418
  source 1..645: mol_type = other RNA

SEQ ID NO: 61578 - RNA, 645 nt, synthetic construct; identical to SEQ ID NO: 15769
  misc_feature 1..645: note = derived and/or modified sequence opt2 from CDS (LC) w/o signal peptide encoded by mRNA R5418
  source 1..645: mol_type = other RNA

SEQ ID NO: 61579 - RNA, 645 nt, synthetic construct; identical to SEQ ID NO: 23411
  misc_feature 1..645: note = derived and/or modified sequence opt3 from CDS (LC) w/o signal peptide encoded by mRNA R5418
  source 1..645: mol_type = other RNA

SEQ ID NO: 61580 - RNA, 645 nt, synthetic construct; identical to SEQ ID NO: 31053
  misc_feature 1..645: note = derived and/or modified sequence opt4 from CDS (LC) w/o signal peptide encoded by mRNA R5418
  source 1..645: mol_type = other RNA

SEQ ID NO: 61581 - RNA, 645 nt, synthetic construct; identical to SEQ ID NO: 38695
  misc_feature 1..645: note = derived and/or modified sequence opt5 from CDS (LC) w/o signal peptide encoded by mRNA R5418
  source 1..645: mol_type = other RNA

SEQ ID NO: 61582 - RNA, 645 nt, synthetic construct
  misc_feature 1..645: note = derived and/or modified sequence opt6 from CDS (LC) w/o signal peptide encoded by mRNA R5418
  source 1..645: mol_type = other RNA
gaaatagtactaacacaatcaccaggaaccctctcactatctccaggagaaagagcaacactaagctgcagagcctcacaatcagtcggatcatcatacctagcatggtaccaacaaaaaccaggacaagcccccagattactaatctacggagcattctcacgagcaacaggaatcccagacagattctcaggttccggatcaggaacagacttcacactaacaatatccagattagaaccagaagacttcgcagtatactactgccaacaatacggatcatcaccatggacatttggacaaggaaccaaagtagaaatcaaaagaacagtagcagccccatcagtatttatattcccaccatcagacgaacaactaaaatcaggcaccgcatcagtagtatgtctattaaacaacttctacccaagagaagcaaaagtacaatggaaagtagacaacgcactacaatcaggaaactcccaagaatcagtcacagaacaagactcaaaagactcaacatactcactatcatcaacactaaccttatcaaaagcagactacgaaaaacacaaagtatacgcatgcgaagtaacacaccaaggattatcatccccagtaacaaaatcattcaacagaggagaatgc

SEQ ID NO: 61583 - RNA, 645 nt, synthetic construct
  misc_feature 1..645: note = derived and/or modified sequence opt11 from CDS (LC) w/o signal peptide encoded by mRNA R5418
  source 1..645: mol_type = other RNA
gaaatcgtcctcacccaatcccccggcacactatccctctcccccggcgaacgcgccaccctctcctgccgcgcctcccaatccgtcggctcctcctacctcgcctggtaccaacaaaaacccggccaagccccccgtctcttaatctacggcgccttctcccgcgccaccggaatccccgaccgattctccggctccggctccggcacagacttcaccctaaccatcagccgcctcgaacccgaagacttcgccgtctactactgccaacaatacggatcctcaccctggaccttcggccaaggcaccaaagtcgaaatcaagcgcaccgtcgccgccccctctgtattcatattccccccatccgacgaacaactaaaatccggcaccgcctcagtcgtctgcctcctcaacaacttctacccccgcgaagccaaagtccaatggaaagtcgacaacgccctccagtccggcaactcccaagaatcagtcaccgaacaagactctaaagactcaacatactccctctcctccaccctaaccctctcaaaagccgactacgaaaaacacaaagtctacgcctgcgaagtcacccaccaaggcctctcatcccccgtcaccaaatccttcaaccgaggcgaatgc

SEQ ID NO: 61584 - protein, 235 aa, synthetic construct
  REGION 1..235: note = Protein (LC) encoded by mRNA R5418
METPAQLLFLLLLWLPDTTGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61585 - RNA, 708 nt, synthetic construct
  misc_feature 1..708: note = CDS (LC) encoded by mRNA R5418
  source 1..708: mol_type = other RNA
atggagacccccgcccagctgctcttcctgctgctcctgtggctgccggacaccacgggcgagatcgtgctgacccagagccccggcaccctctccctgagcccgggggagcgcgccacgctgtcctgccgggccagccagtccgtcggcagctcctacctcgcgtggtaccagcagaagcccgggcaggcgccccgcctgctgatctacggcgccttcagccgggccaccgggatccccgaccgcttctccggcagcggctccgggaccgacttcaccctcacgatcagccggctggagccggaggacttcgccgtgtactactgccagcagtacggctccagcccctggaccttcgggcagggcaccaaggtggagatcaagcgcaccgtcgccgccccctccgtgttcatcttcccgcccagcgacgagcagctgaagtccgggacggccagcgtggtctgcctcctgaacaacttctacccccgggaggccaaggtgcagtggaaggtggacaacgcgctgcagtccggcaacagccaggagagcgtcaccgagcaggactccaaggacagcacctactccctcagctccaccctgacgctgagcaaggccgactacgagaagcacaaggtgtacgcctgcgaggtgacccaccagggcctctccagccccgtcaccaagtccttcaaccgcggggagtgctga

SEQ ID NO: 61586 - RNA, 925 nt, synthetic construct
  misc_feature 1..925: note = R5418
  source 1..925: mol_type = other RNA
gggagaaagcttaccatggagacccccgcccagctgctcttcctgctgctcctgtggctgccggacaccacgggcgagatcgtgctgacccagagccccggcaccctctccctgagcccgggggagcgcgccacgctgtcctgccgggccagccagtccgtcggcagctcctacctcgcgtggtaccagcagaagcccgggcaggcgccccgcctgctgatctacggcgccttcagccgggccaccgggatccccgaccgcttctccggcagcggctccgggaccgacttcaccctcacgatcagccggctggagccggaggacttcgccgtgtactactgccagcagtacggctccagcccctggaccttcgggcagggcaccaaggtggagatcaagcgcaccgtcgccgccccctccgtgttcatcttcccgcccagcgacgagcagctgaagtccgggacggccagcgtggtctgcctcctgaacaacttctacccccgggaggccaaggtgcagtggaaggtggacaacgcgctgcagtccggcaacagccaggagagcgtcaccgagcaggactccaaggacagcacctactccctcagctccaccctgacgctgagcaaggccgactacgagaagcacaaggtgtacgcctgcgaggtgacccaccagggcctctccagccccgtcaccaagtccttcaaccgcggggagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61587 - protein, 447 aa, synthetic construct
  REGION 1..447: note = Protein (HC) w/o signal peptide encoded by mRNA R3118, R3729, R4120, R5045
QVQLQESGGGLVKPGGSLKLSCAASGFTFSDYYMYWVRQTPEKRLEWVATISDGGSYTYYPDSVKGRFTISRDNAKNNLYLQMSSLKSEDTAMYYCSRYRYDDAMDYWGQGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61588 - protein, 218 aa, synthetic construct
  REGION 1..218: note = Protein (LC) w/o signal peptide encoded by mRNA R3118, R3729, R4122, R5046
DIELTQSPASLAVSLGQRATISCRASESVDSYGHSFMQWYQQKPGQPPKLLIYRASNLEPGIPARFSGSGSGTDFTLTINPVEADDVATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61589 - RNA, 1341 nt, synthetic construct
  misc_feature 1..1341: note = CDS (HC) w/o signal peptide encoded by mRNA R3118, R3729, R4120, R5045
  source 1..1341: mol_type = other RNA
caggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaag

SEQ ID NO: 61590 - RNA, 654 nt, synthetic construct
  misc_feature 1..654: note = CDS (LC) w/o signal peptide encoded by mRNA R3118, R3729, R4122, R5046
  source 1..654: mol_type = other RNA
gacatcgagctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgc

SEQ ID NO: 61591 - RNA, 1341 nt, synthetic construct
  misc_feature 1..1341: note = derived and/or modified sequence opt2 from CDS (HC) w/o signal peptide encoded by mRNA R3118, R3729, R4120, R5045
  source 1..1341: mol_type = other RNA
caggtccagctccaggagtccggcggcggcctcgtcaagcccggcggctccctcaagctctcctgcgccgcctccggcttcaccttctccgactactacatgtactgggtccgccagacccccgagaagcgcctcgagtgggtcgccaccatctccgacggcggctcctacacctactaccccgactccgtcaagggccgcttcaccatctcccgcgacaacgccaagaacaacctctacctccagatgtcctccctcaagtccgaggacaccgccatgtactactgctcccgctaccgctacgacgacgccatggactactggggccagggcaccaccgtcaccgtctcctcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61592 - RNA, 654 nt, synthetic construct
  misc_feature 1..654: note = derived and/or modified sequence opt2 from CDS (LC) w/o signal peptide encoded by mRNA R3118, R3729, R4122, R5046
  source 1..654: mol_type = other RNA
gacatcgagctcacccagtcccccgcctccctcgccgtctccctcggccagcgcgccaccatctcctgccgcgcctccgagtccgtcgactcctacggccactccttcatgcagtggtaccagcagaagcccggccagccccccaagctcctcatctaccgcgcctccaacctcgagcccggcatccccgcccgcttctccggctccggctccggcaccgacttcaccctcaccatcaaccccgtcgaggccgacgacgtcgccacctactactgccagcagtccaacgaggaccccttcaccttcggctccggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61593 - RNA, 1341 nt, synthetic construct
  misc_feature 1..1341: note = derived and/or modified sequence opt3 from CDS (HC) w/o signal peptide encoded by mRNA R3118, R3729, R4120, R5045
  source 1..1341: mol_type = other RNA
caggtgcaactgcaggagagcggcgggggactcgtcaagcccggtggctcccttaaactgtcttgcgccgcttcagggttcacctttagtgactactatatgtactgggttagacagacacctgaaaagaggttggagtgggtggcaactatcagcgatggaggctcctatacgtactatccagactctgtaaaaggtcggttcaccatttcgcgcgataacgccaagaataacttatacctgcagatgtcaagcctaaaaagtgaagacacagcgatgtattactgttcccgataccgttatgatgacgctatggattactgggggcaaggaactaccgtgacagtctctagctccaccaagggcccgtcagtgtttcccctcgcccctagtagcaagtctacttccggcgggacagcagccctgggatgccttgttaaagactatttcccagagcccgtgaccgtctcatggaatagcggtgctctgacgagtggcgtgcacacttttcctgcagtattgcagtcttccgggctctacagcctgtcgtctgttgtgaccgtcccatcctcaagtctgggaacacagacttatatatgtaacgtgaatcataagcccagcaacaccaaagtggataagaaagtcgaacctaagtcctgcgacaagacacacacctgtccaccgtgccccgcccctgagctcttaggcggtccatctgttttcctgtttccccctaaaccaaaggatacgcttatgatcagcagaactcccgaggtgacatgtgtagtggtcgacgtgtcacatgaagatccggaggttaaattcaattggtacgtggacggggtcgaagtgcacaacgctaagaccaaacctagggaggagcagtataatagtacttaccgggtagtttccgtgttgacagtcctgcatcaagactggctaaacggaaaggaatacaaatgcaaggtgagcaataaggccctccccgcgccaattgagaaaaccatctctaaggcaaaaggccagcctcgcgaaccccaggtctatacgctgccaccctcaagagatgagcttaccaagaaccaggtgagtctgacatgtttggttaaaggcttttaccctagcgacattgccgtggaatgggagtccaatgggcaaccagagaacaattataagactaccccgcccgtactcgattctgacggatcgttctttctgtacagcaagttaacagtcgataaatccaggtggcagcagggtaacgtgttctcatgcagtgttatgcacgaagctctgcacaaccattatactcaaaagtctctcagcctttcccctggcaaa

SEQ ID NO: 61594 - RNA, 654 nt, synthetic construct
  misc_feature 1..654: note = derived and/or modified sequence opt3 from CDS (LC) w/o signal peptide encoded by mRNA R3118, R3729, R4122, R5046
  source 1..654: mol_type = other RNA
gacatcgagctgacccagagccccgcctccctcgctgtgtctcttggccaaagagcaacaatttcatgcagggccagtgaaagcgtcgattcctacgggcactctttcatgcagtggtatcagcagaagcctggacaaccaccgaaactgttgatataccgggcgtcgaacttagagcccggtatccctgctcgcttttcaggcagcgggagtggaactgacttcacgctgaccattaatccagttgaagccgatgacgtggcaacatattactgtcagcagtccaacgaggatccctttactttcggctctggtaccaagctagaaatcaaacgaacagtagccgctcctagcgtgtttattttcccaccctccgacgagcagctcaagtcagggaccgcaagtgtcgtgtgcctgcttaataacttttatcctcgtgaggccaaagttcaatggaaggtggataatgctctgcagagcggaaactctcaggaatccgtcactgagcaggactcaaaggatagcacatacagtttgtcttccaccctcacgctgagcaaagccgactatgaaaagcataaagtgtacgcgtgtgaggtaactcaccaaggcctgtcgtctccagttaccaagtccttcaatagaggcgagtgc

SEQ ID NO: 61595 - RNA, 1341 nt, synthetic construct
  misc_feature 1..1341: note = derived and/or modified sequence opt4 from CDS (HC) w/o signal peptide encoded by mRNA R3118, R3729, R4120, R5045
  source 1..1341: mol_type = other RNA
caggtgcagctgcaggagagcggcggcggcctggtgaagcccggcggcagcctgaagctgagctgcgccgccagcggcttcaccttcagcgactactacatgtactgggtgagacagacccccgagaagagactggagtgggtggccaccatcagcgacggcggcagctacacctactaccccgacagcgtgaagggcagattcaccatcagcagagacaacgccaagaacaacctgtacctgcagatgagcagcctgaagagcgaggacaccgccatgtactactgcagcagatacagatacgacgacgccatggactactggggccagggcaccaccgtgaccgtgagcagcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61596 - RNA, 654 nt, synthetic construct
  misc_feature 1..654: note = derived and/or modified sequence opt4 from CDS (LC) w/o signal peptide encoded by mRNA R3118, R3729, R4122, R5046
  source 1..654: mol_type = other RNA
gacatcgagctgacccagagccccgccagcctggccgtgagcctgggccagagagccaccatcagctgcagagccagcgagagcgtggacagctacggccacagcttcatgcagtggtaccagcagaagcccggccagccccccaagctgctgatctacagagccagcaacctggagcccggcatccccgccagattcagcggcagcggcagcggcaccgacttcaccctgaccatcaaccccgtggaggccgacgacgtggccacctactactgccagcagagcaacgaggaccccttcaccttcggcagcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61597 - RNA, 1341 nt, synthetic construct
  misc_feature 1..1341: note = derived and/or modified sequence opt5 from CDS (HC) w/o signal peptide encoded by mRNA R3118, R3729, R4120, R5045
  source 1..1341: mol_type = other RNA
caggtgcaactgcaggagagcggcgggggactcgtcaagcccggcgggtccctgaaactttcttgcgccgctagcggattcaccttttccgactactatatgtactgggttagacagacacctgaaaagcggctggagtgggtggccacgatctctgatggcgggagctatacctactatccggactccgtgaaaggacgcttcacaatttctagagataacgcgaagaataacctctacctgcagatgagctcccttaaaagcgaagacaccgctatgtattactgttctcggtaccgctatgatgacgccatggattactggggccaaggcacaaccgtcacagtgtccagctctaccaaggggccctccgtttttcctctggcccccagctctaagtccacgagcggaggcaccgctgccctcgggtgcctggtgaaagactatttccctgagcccgtcacagtgtcctggaactctggagctctgaccagcggcgttcacacatttcctgccgtgctccagtccagcgggctgtactctctttccagcgtcgtgaccgtgccgtctagctccctgggaacgcagacatatatctgtaatgtcaatcataagccctctaacaccaaagttgataagaaagtggaacctaagagctgcgacaagacacacacctgtcccccttgccccgcgccggagctcctgggcggcccttccgtgttcctttttccccctaaacccaaggataccctgatgattagcagaacacccgaggtcacgtgtgtggttgtggacgtctctcatgaagatcctgaggtgaaattcaattggtacgttgacggggtggaagtccacaacgccaagaccaaaccgcgggaggagcagtataattccacataccgcgtggtcagcgtgctcaccgttctgcatcaagactggctgaacggaaaggaatacaaatgcaaggtgtctaataaggctctccccgcccctatcgagaaaacaatttccaaggctaaaggccagcccagagaacctcaggtctataccctgcccccgagccgggatgagcttacgaagaaccaggtgtccctgacatgtctcgttaaagggttttacccttctgacatcgccgtggaatgggagagcaatggacaacccgagaacaattataagaccacccctcccgtcctggattccgacggctctttctttctttacagcaagctgacagtggataaatcccgctggcagcaggggaacgtgttcagctgctctgttatgcacgaagcgctccacaaccattatacccaaaagtccctgagcctgtctcctggaaaa

SEQ ID NO: 61598 - RNA, 654 nt, synthetic construct
  misc_feature 1..654: note = derived and/or modified sequence opt5 from CDS (LC) w/o signal peptide encoded by mRNA R3118, R3729, R4122, R5046
  source 1..654: mol_type = other RNA
gacatcgagctgacccagagccccgcctccctcgctgtgtctctgggccaaagagccacaattagctgccgggcgtccgaatctgtcgatagctacgggcactccttcatgcagtggtatcagcagaagcctggacaaccgcccaaacttctgatctaccgcgcttctaacctcgagcctggcattcccgccagatttagcgggtccggaagcggcacggacttcaccctgacaatcaatcctgttgaagccgatgacgtggctacctattactgtcagcagtctaacgaggatccctttacattcgggtccggaaccaaacttgaaattaagcggacagtggccgctcctagcgtctttatcttcccgccctctgacgagcagctgaagtccggcaccgccagcgtggtttgcctcctgaataacttttatcctcgcgaggcgaaagtgcaatggaaggtcgataatgccctgcagtctggcaactcccaggaaagcgtgacggagcaggactccaaggattctacctacagcctctccagcacactgaccctttctaaagctgactatgaaaagcataaagtttacgcctgtgaggtgacacaccaagggctgtccagccccgtcaccaagtctttcaatagaggagagtgc

SEQ ID NO: 61599 - RNA, 1341 nt, synthetic construct
  misc_feature 1..1341: note = derived and/or modified sequence opt6 from CDS (HC) w/o signal peptide encoded by mRNA R3118, R3729, R4120, R5045
  source 1..1341: mol_type = other RNA
caagtacaactacaagaatcaggaggtggacttgtaaaaccaggaggtagcctaaaattaagttgcgcagcttccggcttcacattctcagactactacatgtactgggtaagacagacacccgaaaaaagactagaatgggtcgcaacaatatcagatggaggatcttacacatactacccagattctgtaaaaggccgattcacaatatccagagataacgctaaaaacaacttatacctccaaatgtcaagcctcaaaagtgaagacacagcaatgtactattgttcaagataccgatacgacgacgcaatggactactggggacaaggaacaacagtaaccgtctcttcatcaacaaaaggaccatcagtattcccactagccccatcaagtaaatcaacatcaggaggaacagcagcccttggctgtttagtaaaagactacttcccagaaccagtaacagtatcatggaattcaggagcactaacatcaggagtacacacattccccgcagtattacaatcatcaggcttatattcactatcaagtgttgtaaccgtaccatcatcaagcttaggaacccaaacatacatatgtaatgttaaccataaaccaagcaatactaaagtagacaaaaaagttgaaccaaaatcttgtgacaaaactcatacttgccccccatgtccagcaccagaactattaggaggaccatcagttttcctattcccacccaaaccaaaagacacactaatgatctcaagaacaccagaagtcacatgcgtagtcgtagatgtatcacatgaagacccagaagttaaattcaactggtacgtagacggagtagaagtacataatgcaaaaacaaaaccaagagaagaacaatataactcaacatacagagtagtttcagttctaacagtacttcaccaagactggttaaacggtaaggaatataaatgtaaagtatcaaacaaagcactacctgccccaatagaaaaaacaatatcaaaagctaaaggacaacccagagaaccccaagtatatacactaccaccgtcacgagacgaactaacaaaaaaccaagtctcactaacatgcctagtaaaaggattctatccttctgacatagccgtagaatgggaatcaaacggacaaccagaaaacaactacaaaacaacaccaccagtcctagattcagatggatcattcttcttatactcaaaattaacagtggataaatcaagatggcaacaaggtaacgtattctcttgtagtgttatgcatgaagcactacataaccattacactcaaaaatcactttcactaagtccaggaaaa

SEQ ID NO: 61600 - RNA, 654 nt, synthetic construct
  misc_feature 1..654: note = derived and/or modified sequence opt6 from CDS (LC) w/o signal peptide encoded by mRNA R3118, R3729, R4122, R5046
  source 1..654: mol_type = other RNA
gacatagaactaacacaatcacccgcatcactagcagtatcattaggacaaagagcaacaatctcatgcagagcatcagaatcagtagactcatacggacactcattcatgcaatggtaccaacaaaaaccaggccaaccaccaaaactactaatatacagagcatcaaaccttgaaccaggaatcccagcaagattctcaggatcaggatcaggaacagacttcaccttaacaataaacccagtagaagcagacgacgtagcaacctattattgccaacaatcaaacgaagacccattcacattcggatcaggaacaaaacttgaaataaaaagaaccgtagcagcaccatcagtattcatattcccaccatcagacgaacaactaaaatcaggaacagcatcagtagtatgcttactcaacaacttctaccccagagaagcaaaagtacaatggaaagtagataacgcactccaatcaggaaactcacaagaatcagtaacagaacaagattcaaaagactcaacctacagcttatcatcaacactaacactatcaaaagcagactacgaaaaacacaaagtatacgcatgcgaagtcacacaccaaggactatcatcaccagtaacaaaatcattcaacagaggagaatgc

SEQ ID NO: 61601 - RNA, 1341 nt, synthetic construct
  misc_feature 1..1341: note = derived and/or modified sequence opt11 from CDS (HC) w/o signal peptide encoded by mRNA R3118, R3729, R4120, R5045
  source 1..1341: mol_type = other RNA
caggtccaactacaagaatcaggaggcggactcgtcaaacccggcggctcccttaaactctcctgcgccgcctccggctttaccttcagcgactactacatgtactgggtcagacaaacccccgaaaaacgcctcgaatgggtcgcaaccatatccgacggcggctcatacacctactaccccgactccgtaaaaggcagattcaccatctcccgcgacaacgccaaaaacaacctttacctccaaatgtcctccctaaaatcagaagacacagcaatgtactactgctcccgataccgatacgacgacgccatggactactggggccaaggcacaaccgtcaccgtaagctcctccaccaaaggcccctccgtcttccccctagccccctcctccaaatccacctccggcggcaccgccgctcttggctgcctcgttaaagactactttcccgaacccgtcaccgtatcctggaactccggcgcactaacctccggcgtccacacattccccgccgtcctccaatcatccggcctctattcactctccagcgtcgtaacagtcccctcctcttccctaggaacccaaacctatatctgcaatgtcaaccacaaaccctccaacacgaaagtagacaagaaagtcgaacccaaatcctgcgacaaaacgcacacatgcccaccctgccccgcaccagaactcctcggcggcccatccgtcttcctattcccaccaaaaccaaaagacactctaatgatatcccgcacccccgaagtaacatgcgtcgtcgtcgacgtcagccacgaagaccctgaagtgaaattcaactggtacgtagacggcgtagaagtccacaacgccaaaacaaaaccccgagaagaacaatacaactccacatatcgcgtcgtatcagttctcaccgtccttcaccaagactggctgaacggcaaagaatacaaatgcaaagtcagcaacaaagcactccccgcccccatagaaaagaccatatctaaagccaaaggacaaccccgcgaaccccaggtctacacactcccaccctccagagatgaactaaccaaaaatcaggtctcacttacctgcctcgtaaaaggtttctacccctcagacatcgccgtcgaatgggaatccaacggccaacccgaaaacaactacaaaaccaccccacccgttctcgactccgacggctccttcttcctctactcaaaactcaccgtagacaaatcacgatggcagcaaggcaacgtcttttcatgctcagtcatgcacgaagccctacacaaccactacacccaaaaatccctatcactctcccccggcaaa

SEQ ID NO: 61602 - RNA, 654 nt, synthetic construct
  misc_feature 1..654: note = derived and/or modified sequence opt11 from CDS (LC) w/o signal peptide encoded by mRNA R3118, R3729, R4122, R5046
  source 1..654: mol_type = other RNA
gacatcgaactaacccaaagccccgcctccctcgccgtctccctcggccaacgcgccaccatctcctgccgcgcctccgaatccgtcgactcctacggccactccttcatgcaatggtaccaacaaaaacccggccaaccacccaaactcctaatctaccgcgcctccaacctcgaacccggaatccccgcccgcttctccggctccggctccggcaccgacttcaccctaaccatcaaccccgtagaagcagacgacgtcgccacctactactgccaacaatccaacgaagaccccttcacattcggatccggcaccaaactcgaaatcaaacgcaccgtcgcagccccctccgtcttcatctttcccccatccgacgaacaactcaaatcaggcacagcctccgtcgtatgcctcctcaacaacttctacccccgagaagccaaagtccaatggaaagtcgacaacgccctccaatccggcaactcccaagaatccgtcaccgaacaagactccaaagactccacctactcactatcctccaccctcacactttccaaagccgactacgaaaaacataaagtctacgcctgcgaagtcacccaccaaggcctctcctcccccgtcaccaaatccttcaaccgaggcgaatgc

SEQ ID NO: 61603 - protein, 466 aa, synthetic construct
  REGION 1..466: note = Protein (HC) encoded by mRNA R4120
MKCSWVIFFLMAVVTGVNSQVQLQESGGGLVKPGGSLKLSCAASGFTFSDYYMYWVRQTPEKRLEWVATISDGGSYTYYPDSVKGRFTISRDNAKNNLYLQMSSLKSEDTAMYYCSRYRYDDAMDYWGQGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61604 - RNA, 1401 nt, synthetic construct
  misc_feature 1..1401: note = CDS (HC) as RNA from mRNA R4120
  source 1..1401: mol_type = other RNA
atgaagtgcagctgggtgatcttcttcctgatggccgtcgtgaccggcgtgaactcccaggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtga

SEQ ID NO: 61605 - RNA, 1605 nt, synthetic construct
  misc_feature 1..1605: note = R4120
  source 1..1605: mol_type = other RNA
gggagaaagcttaccatgaagtgcagctgggtgatcttcttcctgatggccgtcgtgaccggcgtgaactcccaggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61606 - protein, 237 aa, synthetic construct
  REGION 1..237: note = Protein (LC) encoded by mRNA R4122
MKLPVRLLVLMFWIPASSSDIVLTQSPASLAVSLGQRATISCRASESVDSYGHSFMQWYQQKPGQPPKLLIYRASNLEPGIPARFSGSGSGTDFTLTINPVEADDVATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61607 - RNA, 714 nt, synthetic construct
  misc_feature 1..714: note = CDS (LC) as RNA from mRNA R4122
  source 1..714: mol_type = other RNA
atgaagctgcccgtgcgcctcctggtcctgatgttctggatcccggccagctccagcgacatcgtgctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61608 - RNA, 918 nt, synthetic construct
  misc_feature 1..918: note = R4122
  source 1..918: mol_type = other RNA
gggagaaagcttaccatgaagctgcccgtgcgcctcctggtcctgatgttctggatcccggccagctccagcgacatcgtgctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61609 - protein, 472 aa, synthetic construct
  REGION 1..472: note = Protein (HC) encoded by mRNA R5045, R3118, R3729
MAVMAPRTLVLLLSGALALTQTWAGQVQLQESGGGLVKPGGSLKLSCAASGFTFSDYYMYWVRQTPEKRLEWVATISDGGSYTYYPDSVKGRFTISRDNAKNNLYLQMSSLKSEDTAMYYCSRYRYDDAMDYWGQGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61610 - RNA, 1419 nt, synthetic construct
  misc_feature 1..1419: note = CDS (HC) as RNA from mRNA R5045, R3118, R3729
  source 1..1419: mol_type = other RNA
atggccgtgatggcgccgcggaccctggtcctcctgctgagcggcgccctcgccctgacgcagacctgggccgggcaggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtga

SEQ ID NO: 61611 - RNA, 1623 nt, synthetic construct
  misc_feature 1..1623: note = R5045
  source 1..1623: mol_type = other RNA
gggagaaagcttaccatggccgtgatggcgccgcggaccctggtcctcctgctgagcggcgccctcgccctgacgcagacctgggccgggcaggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61612 - protein, 243 aa, synthetic construct
  REGION 1..243: note = Protein (LC) encoded by mRNA R5046, R3118, R3729
MAVMAPRTLVLLLSGALALTQTWAGDIELTQSPASLAVSLGQRATISCRASESVDSYGHSFMQWYQQKPGQPPKLLIYRASNLEPGIPARFSGSGSGTDFTLTINPVEADDVATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61613 - RNA, 732 nt, synthetic construct
  misc_feature 1..732: note = CDS (LC) as RNA from mRNA R5046, R3118, R3729
  source 1..732: mol_type = other RNA
atggccgtgatggcgccgcggaccctggtcctcctgctgagcggcgccctcgccctgacgcagacctgggccggggacatcgagctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61614 - RNA, 936 nt, synthetic construct
  misc_feature 1..936: note = R5046
  source 1..936: mol_type = other RNA
gggagaaagcttaccatggccgtgatggcgccgcggaccctggtcctcctgctgagcggcgccctcgccctgacgcagacctgggccggggacatcgagctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61615 - RNA, 2830 nt, synthetic construct
  misc_feature 1..2830: note = CDS 1-IRES-CDS 2 as RNA from mRNA R3118, R3729
  source 1..2830: mol_type = other RNA
atggccgtgatggcgccgcggaccctggtcctcctgctgagcggcgccctcgccctgacgcagacctgggccgggcaggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatcgagctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61616 - RNA, 3212 nt, synthetic construct
  misc_feature 1..3212: note = R3118
  source 1..3212: mol_type = other RNA
ggggcgctgcctacggaggtggcagccatctccttctcggcatcaagcttaccatggccgtgatggcgccgcggaccctggtcctcctgctgagcggcgccctcgccctgacgcagacctgggccgggcaggtgcagctgcaggagagcggcgggggcctcgtcaagcccgggggctccctgaagctgagctgcgccgcctccgggttcaccttcagcgactactacatgtactgggtgcgccagaccccggagaagcggctcgagtgggtggcgacgatctccgacggcggcagctacacctactaccccgactccgtcaaggggcgcttcaccatcagccgggacaacgccaagaacaacctgtacctgcagatgtccagcctcaagtccgaggacaccgccatgtactactgcagccgctaccggtacgacgacgccatggactactggggccaggggacgaccgtgaccgtgtccagcagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatcgagctgacccagagccccgcctccctcgccgtgagcctgggccagcgcgcgaccatctcctgccgggccagcgagtccgtcgacagctacgggcactccttcatgcagtggtaccagcagaagccgggccagcctcccaagctgctcatctaccgcgccagcaacctggagcccgggatcccggcccggttctccggcagcgggtccggcacggacttcaccctgaccatcaaccccgtggaggccgacgacgtggcgacctactactgccagcagagcaacgaggaccccttcacgttcggctccgggaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61617 - RNA, 3002 nt, synthetic construct; identical to SEQ ID NO: 61465
  misc_feature 1..3002: note = R3729
  source 1..3002: mol_type = other RNA

SEQ ID NO: 61618 - protein, 504 aa, synthetic construct; identical to SEQ ID NO: 107
  REGION 1..504: note = Protein w/o signal peptide encoded by mRNA R3979, R3981

SEQ ID NO: 61619 - protein, 498 aa, synthetic construct; identical to SEQ ID NO: 964
  REGION 1..498: note = Protein w/o signal peptide & his-tag encoded by mRNA R3979, R3981

SEQ ID NO: 61620 - RNA, 1512 nt, synthetic construct
  misc_feature 1..1512: note = CDS w/o signal peptide encoded by mRNA R3979, R3981
  source 1..1512: mol_type = other RNA
gacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagcaccaccaccaccaccac

SEQ ID NO: 61621 - RNA, 1494 nt, synthetic construct
  misc_feature 1..1494: note = CDS w/o signal peptide & his-tag encoded by mRNA R3979, R3981
  source 1..1494: mol_type = other RNA
gacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaag

SEQ ID NO: 61622 - RNA, 1512 nt, synthetic construct; identical to SEQ ID NO: 15391
  misc_feature 1..1512: note = derived and/or modified sequence opt2 from CDS w/o signal peptide encoded by mRNA R3979, R3981
  source 1..1512: mol_type = other RNA

SEQ ID NO: 61623 - RNA, 1494 nt, synthetic construct; identical to SEQ ID NO: 16248
  misc_feature 1..1494: note = derived and/or modified sequence opt2 from CDS w/o signal peptide & his-tag encoded by mRNA R3979, R3981
  source 1..1494: mol_type = other RNA

SEQ ID NO: 61624 - RNA, 1512 nt, synthetic construct; identical to SEQ ID NO: 23033
  misc_feature 1..1512: note = derived and/or modified sequence opt3 from CDS w/o signal peptide encoded by mRNA R3979, R3981
  source 1..1512: mol_type = other RNA

SEQ ID NO: 61625 - RNA, 1494 nt, synthetic construct; identical to SEQ ID NO: 23890
  misc_feature 1..1494: note = derived and/or modified sequence opt3 from CDS w/o signal peptide & his-tag encoded by mRNA R3979, R3981
  source 1..1494: mol_type = other RNA

SEQ ID NO: 61626 - RNA, 1512 nt, synthetic construct; identical to SEQ ID NO: 30675
  misc_feature 1..1512: note = derived and/or modified sequence opt4 from CDS w/o signal peptide encoded by mRNA R3979, R3981
  source 1..1512: mol_type = other RNA

SEQ ID NO: 61627 - RNA, 1494 nt, synthetic construct; identical to SEQ ID NO: 31532
  misc_feature 1..1494: note = derived and/or modified sequence opt4 from CDS w/o signal peptide & his-tag encoded by mRNA R3979, R3981
  source 1..1494: mol_type = other RNA

SEQ ID NO: 61628 - RNA, 1512 nt, synthetic construct; identical to SEQ ID NO: 38317
  misc_feature 1..1512: note = derived and/or modified sequence opt5 from CDS w/o signal peptide encoded by mRNA R3979, R3981
  source 1..1512: mol_type = other RNA

SEQ ID NO: 61629 - RNA, 1494 nt, synthetic construct; identical to SEQ ID NO: 39174
  misc_feature 1..1494: note = derived and/or modified sequence opt5 from CDS w/o signal peptide & his-tag encoded by mRNA R3979, R3981
  source 1..1494: mol_type = other RNA

SEQ ID NO: 61630 - RNA, 1512 nt, synthetic construct
  misc_feature 1..1512: note = derived and/or modified sequence opt6 from CDS w/o signal peptide encoded by mRNA R3979, R3981
  source 1..1512: mol_type = other RNA
gatatacaattaacccaatcgccagcaagccttgcagtatccttaggacaaagagcaacgataagttgcaaagcaagtcaatcagtagactatgacggtgatagttatttaaactggtatcaacaaataccaggacaaccaccaaaattattaatatatgacgcatctaacctagtaagtggtatacccccaagattctcaggatcaggttcaggaacagatttcaccttaaatatacatcccgtagaaaaagttgatgccgcaacatatcattgtcaacaatcaacagaagatccgtggactttcggtggaggaacaaaattagaaattaaaggaggaggaggttcaggaggtggaggatcaggaggaggtggatcacaagttcaactacaacaatccggagcagagctagtaagaccaggaagctcagtcaaaataagctgtaaagcatcaggttatgcatttagttcatattggatgaattgggtaaaacaacgtcctggacaaggcttagaatggataggacaaatatggccaggagatggtgatacaaattataatggaaaatttaaaggcaaagcaacactaacagcagatgaaagttcatcaactgcttacatgcaactatcaagcctagctagtgaagatagcgccgtatacttttgtgcaagaagggaaactacaacagttggtcgatattactatgcaatggattattggggacagggaactacagtaacagtttcatcaggaggaggaggaagcgatatcaaattacaacaaagcggagcagaactagcacgacctggcgcatcagtaaaaatgtcttgcaaaacgagtggatatacatttacaagatatacaatgcactgggtaaaacaaagaccaggacaaggattagaatggattgggtacattaatccctcaagaggttatacaaattataatcaaaaatttaaagataaagctacactaacaacagacaaatcatcaagtaccgcatacatgcaactatcaagtctcacatcagaagacagcgccgtctactattgtgctagatactacgacgatcattattgtctagattattggggacaaggaacaaccttaactgtaagctcagtagaaggaggaagcggaggatcaggaggaagtggaggatctggaggagttgatgatatacaactaacacaatcaccagcaatcatgagtgcatctccaggagaaaaagttacgatgacttgcagagcttcatcatcagtatcatatatgaattggtatcagcaaaaatcaggcacaagtccaaaaagatggatctacgacacatcaaaagttgcttcaggagtaccctatagatttagtggatcaggatcgggaacatcatattcattaacaatatcatcaatggaagctgaagatgcagcaacatactattgccaacaatggagttcaaaccccttaacatttggagcaggtacaaaactagaactaaaacatcatcatcatcatcat

SEQ ID NO: 61631 - RNA, 1494 nt, synthetic construct
  misc_feature 1..1494: note = derived and/or modified sequence opt6 from CDS w/o signal peptide & his-tag encoded by mRNA R3979, R3981
  source 1..1494: mol_type = other RNA
gatatacaattaacacaatcaccagcatctctagcagttagcttgggacaaagagctacaataagctgtaaagcaagtcaatcagtcgattacgatggtgatagttacttaaactggtatcaacaaataccaggacaaccacctaaattactaatatatgacgcatcaaatttagtaagcggaatccctccaagattttcaggatcaggatcaggaacagactttacattaaacatccatccagtagaaaaagtagatgctgcaacatatcactgtcaacaaagcaccgaagatccatggacctttggaggcggaactaagttagagattaaaggaggaggaggctcaggtggaggtggatcaggagggggaggaagccaagtacaattacaacaatcaggagcagaattagttagaccaggatcaagtgtaaaaatatcatgtaaagcatcaggatatgcatttagttcatactggatgaattgggtgaaacaacgaccaggacaaggcttagaatggatagggcaaatatggcctggagatggtgatacaaattataatggaaaatttaaaggaaaagctacactcacagcagatgaaagctcaagcacagcatacatgcaactatcatctttagcaagcgaagactcagcagtgtacttttgtgcgagaagagaaactacaacagtaggaaggtactattatgcaatggattattggggacaaggaacaacagtaacagtatcaagcggaggaggaggatcagacataaaactacaacaaagtggcgcagaattagcaagaccaggagcaagcgtaaaaatgagctgtaaaacaagcggttatacttttacaagatatacaatgcattgggttaaacaaagaccaggtcaaggattagaatggataggatatataaatccatcaagaggatatacaaactataatcaaaaatttaaagataaagcaacattaaccacagataaatcttcaagtactgcttatatgcaattatcaagtttaacatcagaagatagcgcagtatattactgtgctaggtattatgatgaccattattgcttggactactggggacaaggtacaaccctaacagtaagtagcgtggaaggaggcagtggaggaagcggaggaagtggaggaagtggaggagtagatgatatacaactaacacaatcaccagcaataatgagtgcatcaccaggagaaaaagttacaatgacatgcagagcatcaagtagtgtaagttatatgaattggtatcaacaaaaatcaggaacaagtccgaaaagatggatatatgatacttcaaaagtagcatctggagtgccatacagatttagcggaagtggaagtggtacaagctattcattaacaataagtagtatggaagcagaagacgcagcaacttattattgccaacaatggagtagcaatccattaacatttggagcaggaacaaaattagaattaaaa

SEQ ID NO: 61632 - RNA, 1512 nt, synthetic construct
  misc_feature 1..1512: note = derived and/or modified sequence opt11 from CDS w/o signal peptide encoded by mRNA R3979, R3981
  source 1..1512: mol_type = other RNA
gacatccaactaacacaaagccccgcctccctcgcagtaagtctaggacagcgcgcgacaattagttgcaaagcaagccaaagcgtcgactacgacggcgactcctacctaaactggtaccaacagatccccggccaaccaccaaaactcctaatctacgacgctagcaaccttgtcagcggcatcccaccccgcttctccggctcaggcagcggcacagacttcactctaaacatacacccagtcgaaaaagtagacgcagccacatatcactgccaacaatcaaccgaagacccatggacattcggaggaggaaccaaactcgaaatcaagggcggcggcggatcaggcggcggaggcagcggcggaggaggcagccaagtccaactccaacaatccggcgcagagctagtccgaccaggcagcagcgtcaaaatatcatgcaaagcaagcggctacgcattctcctcatactggatgaactgggtaaaacagagaccaggacagggcctcgaatggataggacaaatatggccaggagacggcgacaccaactacaacggaaaattcaagggaaaagccaccctaaccgccgacgaatcaagctcaacagcctacatgcaactcagctcactagcatccgaagacagcgcggtctacttctgcgcgcgccgcgaaacaaccaccgtcggacgttactactacgccatggactactggggccaagggaccacagtaacggtctcttccggcggtggcggctcagacataaaactgcaacagagcggagcagaactagcaagacccggcgcaagcgtaaaaatgtcctgcaaaacgagcgggtacacattcacacgttacactatgcactgggtcaaacaaagacccggccaaggactagaatggataggatacatcaacccatccagagggtacacaaactacaaccaaaaattcaaggacaaagccactctcacaacggacaaaagctccagcacagcatacatgcaactatcatccttaacctcagaagactccgctgtctactactgcgcacgctactacgacgaccactactgcctagactactggggccaaggaaccacactaaccgtgtcctcagtcgaaggcggctccggcggcagcggcggaagcggcggatccggaggagtcgacgacatacaactcacccaatccccagcaatcatgtcagcctcacccggcgaaaaagtaaccatgacctgccgagcaagctcctcagtaagctacatgaactggtaccaacagaaaagcggcacatccccaaaacgatggatctacgacacaagcaaagtagcctccggagtaccataccgcttcagcggaagcggcagcggaacaagctactcgctcacaatctcaagcatggaagccgaagacgcagccacctactactgccaacaatggtcctccaacccactaaccttcggcgcgggcacaaaactagaactaaaacaccaccaccaccaccac

SEQ ID NO: 61633 - RNA, 1494 nt, synthetic construct
  misc_feature 1..1494: note = derived and/or modified sequence opt11 from CDS w/o signal peptide & his-tag encoded by mRNA R3979, R3981
  source 1..1494: mol_type = other RNA
gacatccaactcacgcaatccccagcaagcctggccgtctcacttggccaaagagcaaccataagctgcaaagccagccaaagcgtagactacgacggggactcttaccttaactggtaccagcaaatacccgggcaaccaccaaagctactaatctacgacgcgagcaacctagtcagcggaatcccacccaggttctcgggctcaggaagcggcactgacttcaccctaaacatacacccagtagaaaaagtagacgcagccacatatcactgccagcaatcgacagaagacccatggacgttcggaggcgggaccaaactcgaaatcaaaggcggaggaggctccggaggcggaggctcgggagggggcggaagccaagtccaactacaacaatccggcgcagagctagtaagaccgggcagcagcgttaaaatctcctgcaaagcctcgggctacgccttctcatcatactggatgaactgggtaaaacaaagaccaggacaaggactagaatggatcgggcaaatatggcccggagacggggacacaaattacaacggaaagttcaaaggcaaagcaacactcacagcagacgaatcaagctcaaccgcgtacatgcaactaagctcgctggcgtccgaagactcagcagtatacttctgcgcgcgcagagaaaccaccacagtcggccgctactactacgcaatggactactggggacaaggaaccaccgtcacagtatcaagcgggggcgggggatccgacataaaactacaacagagcggggccgaactcgcccgacccggagcgagcgtgaaaatgagctgcaaaacaagcgggtacacgttcacccgctacactatgcactgggtcaagcaacgccccggtcaaggactagaatggatcggatacatcaacccctcccgaggctacacaaactacaaccaaaaattcaaagacaaagcaacactaaccacagacaaaagctcatcaacagcctatatgcaactctcaagcctgacctcagaagatagcgcagtctactactgtgcaagatactacgacgaccactactgcctcgactactggggacaagggaccacactaaccgtctcgagcgtcgaaggaggctcaggagggagcggcggctccggcgggtccggcggagtcgacgacatacagctcacgcaatcaccagcaatcatgagcgcaagccccggcgaaaaagtcaccatgacatgccgagcgtcctccagcgtaagctacatgaactggtaccaacagaaatcaggaacgagcccgaaaaggtggatatacgacacatcgaaagtagcctcgggcgtaccctaccgctttagcggaagcgggagcggaacctcgtactcactcacaatctcgagcatggaagcagaagacgccgcgacatactactgtcaacaatggtcctccaaccccctaaccttcggcgcaggaacaaaactagaactaaaa

SEQ ID NO: 61634 - protein, 523 aa, synthetic construct
  REGION 1..523: note = Protein w/o his-tag encoded by mRNA R3979
MAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 61635 - protein, 529 aa, synthetic construct
  REGION 1..529: note = Protein encoded by mRNA R3979
MAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 61636 - RNA, 1572 nt, synthetic construct
  misc_feature 1..1572: note = CDS w/o his-tag as RNA from mRNA R3979
  source 1..1572: mol_type = other RNA
atggccgtgatggccccgcggaccctggtcctcctgctgagcggcgcgctcgccctgacccagacgtgggccggggacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagtga

SEQ ID NO: 61637 - RNA, 1590 nt, synthetic construct
  misc_feature 1..1590: note = CDS as RNA from mRNA R3979
  source 1..1590: mol_type = other RNA
atggccgtgatggccccgcggaccctggtcctcctgctgagcggcgcgctcgccctgacccagacgtgggccggggacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagcaccaccaccaccaccactga

SEQ ID NO: 61638 - RNA, 1782 nt, synthetic construct
  misc_feature 1..1782: note = R3979
  source 1..1782: mol_type = other RNA
gggagaaagcttaccatggccgtgatggccccgcggaccctggtcctcctgctgagcggcgcgctcgccctgacccagacgtgggccggggacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagcaccaccaccaccaccactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61639 - protein, 520 aa, synthetic construct
  REGION 1..520: note = Protein w/o his-tag encoded by mRNA R3981
MDFQVQIFSFLLISASVIISRGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 61640 - protein, 526 aa, synthetic construct
  REGION 1..526: note = Protein encoded by mRNA R3981
MDFQVQIFSFLLISASVIISRGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 61641 - RNA, 1563 nt, synthetic construct
  misc_feature 1..1563: note = CDS w/o his-tag as RNA from mRNA R3981
  source 1..1563: mol_type = other RNA
atggacttccaggtgcagatcttcagcttcctgctcatctccgccagcgtcatcatctcccgcggcgacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagtga

SEQ ID NO: 61642 - RNA, 1581 nt, synthetic construct
  misc_feature 1..1581: note = CDS as RNA from mRNA R3981
  source 1..1581: mol_type = other RNA
atggacttccaggtgcagatcttcagcttcctgctcatctccgccagcgtcatcatctcccgcggcgacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagcaccaccaccaccaccactga

SEQ ID NO: 61643 - RNA, 1773 nt, synthetic construct
  misc_feature 1..1773: note = R3981
  source 1..1773: mol_type = other RNA
gggagaaagcttaccatggacttccaggtgcagatcttcagcttcctgctcatctccgccagcgtcatcatctcccgcggcgacatccagctgacccagagccccgcctccctcgccgtgagcctgggccagcgcgcgaccatctcctgcaaggccagccagtccgtcgactacgacggggacagctacctgaactggtaccagcagatccccggccagcccccgaagctcctgatctacgacgcctccaacctggtgagcgggatcccgccgcggttctccggcagcgggtccggcacggacttcaccctcaacatccaccccgtggagaaggtcgacgccgccacctaccactgccagcagagcaccgaggacccctggacgttcggcgggggcaccaagctggagatcaagggcggcggggggtccggcgggggcgggagcggcggcgggggctcccaggtgcagctgcagcagagcggggcggagctcgtgcgccccggctccagcgtcaagatctcctgcaaggccagcgggtacgccttcagctcctactggatgaactgggtgaagcagcggccgggccagggcctggagtggatcgggcagatctggcccggcgacggggacaccaactacaacggcaagttcaaggggaaggccaccctgacggcggacgagagctccagcaccgcctacatgcagctctccagcctggcctccgaggacagcgccgtgtacttctgcgcccgccgggagaccaccacggtcggccgctactactacgcgatggactactggggccaggggaccaccgtgaccgtgtccagcggcgggggcgggtccgacatcaagctgcagcagagcggcgccgagctcgcccggcccggcgcctccgtcaagatgagctgcaagacgtccgggtacaccttcacccgctacaccatgcactgggtgaagcagcggcccggccaggggctggagtggatcggctacatcaacccgagccgcggctacacgaactacaaccagaagttcaaggacaaggccaccctgaccaccgacaagtccagctccacggcgtacatgcagctcagcagcctgacctccgaggacagcgccgtgtactactgcgcccggtactacgacgaccactactgcctggactactgggggcagggcaccaccctcacggtctccagcgtggagggcgggtccgggggcagcggcgggtccggcgggagcggcggggtggacgacatccagctgacccagtcccccgccatcatgagcgcctcccccggcgagaaggtcaccatgacctgccgcgcgagctccagcgtgtcctacatgaactggtaccagcagaagagcggcacgtcccccaagcggtggatctacgacaccagcaaggtggccagcggggtcccgtaccgcttctccggcagcgggtccggcaccagctactccctgaccatcagctccatggaggccgaggacgccgccacgtactactgccagcagtggagctccaaccccctcaccttcggggcgggcaccaagctggagctgaagcaccaccaccaccaccactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61644 - protein, 449 aa, synthetic construct
  REGION 1..449: note = Protein (HC) w/o signal peptide encoded by mRNA R3058, R3060
QVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61645 - protein, 212 aa, synthetic construct
  REGION 1..212: note = Protein (LC) w/o signal peptide encoded by mRNA R3058, R3060
DIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61646 - RNA, 1347 nt, synthetic construct
  misc_feature 1..1347: note = CDS (HC) w/o signal peptide encoded by mRNA R3058, R3060
  source 1..1347: mol_type = other RNA
caggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaag

SEQ ID NO: 61647 - RNA, 636 nt, synthetic construct
  misc_feature 1..636: note = CDS (LC) w/o signal peptide encoded by mRNA R3058, R3060
  source 1..636: mol_type = other RNA
gacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgc

SEQ ID NO: 61648 - RNA, 1347 nt, synthetic construct
  misc_feature 1..1347: note = derived and/or modified sequence opt2 from CDS (HC) w/o signal peptide encoded by mRNA R3058, R3060
  source 1..1347: mol_type = other RNA
caggtcgagctccaggagtccggccccggcatcctccagccctcccagaccctctccctcacctgctccttctccggcttctccctctccacctccggcatgtccgtcggctggatccgccagccctccggcgagggcctcgagtggctcgccgacatctggtgggacgacaagaaggactacaacccctccctcaagtcccgcctcaccatctccaaggacacctcctccaaccaggtcttcctcaagatcaccggcgtcgacaccgccgacaccgccacctactactgcgcccgctccatgatcaccaactggtacttcgacgtctggggcgccggcaccaccgtcaccgtctcctcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61649 - RNA, 636 nt, synthetic construct
  misc_feature 1..636: note = derived and/or modified sequence opt2 from CDS (LC) w/o signal peptide encoded by mRNA R3058, R3060
  source 1..636: mol_type = other RNA
gacatccagctcacccagtcccccgccatcatgtccgcctcccccggcgagaaggtcaccatgacctgctccgcctcctcctccgtcggctacatgcactggtaccagcagaagtcctccacctcccccaagctctggatctacgacacctccaagctcgcctccggcgtccccggccgcttctccggctccggctccggcaactcctactccctcaccatctcctccatccaggccgaggacgtcgccacctactactgcttccagggctccggctaccccttcaccttcggcggcggcaccaagctcgagatcaagaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61650 - RNA, 1347 nt, synthetic construct
  misc_feature 1..1347: note = derived and/or modified sequence opt3 from CDS (HC) w/o signal peptide encoded by mRNA R3058, R3060
  source 1..1347: mol_type = other RNA
caggtggagctgcaagaaagcggccccgggatcctccagccttcccagaccctttctctgacatgctcattcagtggatttagcttgtccacttctggtatgtcggtcggctggattagacagccatcaggggagggattagaatggctggccgacatatggtgggatgacaagaaagattacaacccgagcctaaagagtaggctcacgatctccaaagacacctctagcaatcaagttttcctgaagattacaggcgtggatactgctgacaccgcaacatattactgtgcccggtccatgatcaccaactggtattttgatgtatggggtgcggggactacagtgaccgtctcaagtagcacgaaaggaccctctgtgttccctcttgctccatcctcaaagagcacaagtggcggcaccgccgcactggggtgcttggttaaggactactttcccgagcctgtgacagtctcttggaactccggagccctcactagcggtgtgcacaccttcccagctgtactgcagtcgtctggcctgtattccctctcaagtgttgtgacagtccccagctcctctttagggacccagacgtacatttgtaatgtgaatcataaacctagcaacactaaggtggataaaaaggtcgaaccaaaatcatgcgacaagacacacacctgtccgccctgccctgcaccagagctgcttggaggccccagtgtttttcttttccctccaaagcccaaagatactctgatgatctcccgcacaccggaggtgacctgtgtagtggtcgacgtgagccatgaagatcctgaggttaagtttaattggtatgtggacggtgtcgaagtgcacaacgccaaaacgaagccccgagaggagcagtacaattctacctaccgtgtagtttcagtgctaacagtcctccatcaagactggctgaacgggaaagaatataagtgcaaagtgagtaataaggctttgccagcccctatagagaagactatcagcaaagcgaagggacagcccagagaaccacaggtctacaccctgcccccttccagggatgagttgactaaaaaccaggtgtctctcacttgtctggttaagggcttctatccatcggacattgcagtggaatgggagagcaatggccaaccggagaacaattacaaaaccacaccccctgtattagattccgacgggtcatttttcctgtatagtaagctcaccgtcgataagtctcggtggcagcagggaaacgtgtttagctgctccgttatgcacgaagcccttcacaaccattacactcaaaaatcactgagcttgtctccaggtaag

SEQ ID NO: 61651 - RNA, 636 nt, synthetic construct
  misc_feature 1..636: note = derived and/or modified sequence opt3 from CDS (LC) w/o signal peptide encoded by mRNA R3058, R3060
  source 1..636: mol_type = other RNA
gacatccagctgacccaaagccccgccattatgtccgcttctcctggcgagaaggtgacaatgacttgctcagcaagtagctccgtcgggtacatgcactggtatcagcagaaatcttcgacgtcaccaaagctctggatatacgataccagcaaacttgccagtggagttccgggtagattctccggctctgggagcggaaactcctattcactgacaatcagtagcattcaggcggaagacgtggctacttactattgttttcaaggctctggttaccccttcacctttgggggaggcacaaagttggagatcaaaaccgtagccgcaccttccgtgttcatttttccaccctcagatgaacagttaaagagcggcactgccagtgtcgtgtgcctgctaaataacttctatcctagggaggctaaggttcagtggaaagtggacaatgcactccagtctgggaactcccaagaaagcgtcacagagcaggattcgaaggactctacctactccctgtcaagtacgcttactctgagcaaagccgattacgagaagcataaagtgtatgcttgtgaagtaacccaccagggattgtcctctccagttacaaagagctttaatcggggtgagtgc

SEQ ID NO: 61652 - RNA, 1347 nt, synthetic construct
  misc_feature 1..1347: note = derived and/or modified sequence opt4 from CDS (HC) w/o signal peptide encoded by mRNA R3058, R3060
  source 1..1347: mol_type = other RNA
caggtggagctgcaggagagcggccccggcatcctgcagcccagccagaccctgagcctgacctgcagcttcagcggcttcagcctgagcaccagcggcatgagcgtgggctggatcagacagcccagcggcgagggcctggagtggctggccgacatctggtgggacgacaagaaggactacaaccccagcctgaagagcagactgaccatcagcaaggacaccagcagcaaccaggtgttcctgaagatcaccggcgtggacaccgccgacaccgccacctactactgcgccagaagcatgatcaccaactggtacttcgacgtgtggggcgccggcaccaccgtgaccgtgagcagcagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61653 - RNA, 636 nt, synthetic construct
  misc_feature 1..636: note = derived and/or modified sequence opt4 from CDS (LC) w/o signal peptide encoded by mRNA R3058, R3060
  source 1..636: mol_type = other RNA
gacatccagctgacccagagccccgccatcatgagcgccagccccggcgagaaggtgaccatgacctgcagcgccagcagcagcgtgggctacatgcactggtaccagcagaagagcagcaccagccccaagctgtggatctacgacaccagcaagctggccagcggcgtgcccggcagattcagcggcagcggcagcggcaacagctacagcctgaccatcagcagcatccaggccgaggacgtggccacctactactgcttccagggcagcggctaccccttcaccttcggcggcggcaccaagctggagatcaagaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61654 - RNA, 1347 nt, synthetic construct
  misc_feature 1..1347: note = derived and/or modified sequence opt5 from CDS (HC) w/o signal peptide encoded by mRNA R3058, R3060
  source 1..1347: mol_type = other RNA
caggtggagctgcaagaaagcggccccgggatcctccagccttcccagaccctgtctcttacatgcagcttctccggattttctctgagcacgtccggcatgtctgtcgggtggattagacagccgagcggagagggcctcgaatggctggccgacatctggtgggatgacaagaaagattacaacccctcccttaagagccggctgaccatttctaaagacacatccagcaatcaagttttcctcaagatcaccggggtggatacagctgacaccgccacatattactgtgcgcgctctatgattaccaactggtattttgatgtgtggggagctggcacgaccgtcacagtgtccagctctaccaaaggcccttccgttttccccctggcccctagctccaagtctacaagcgggggaaccgccgctctgggctgcctcgtgaaggactactttcccgagcctgtcacggtgtcctggaatagcggggccctgacatctggagttcacaccttcccggctgtgcttcagtccagcggcctgtattctctcagctccgtcgtgacagtgccctctagctccctggggacccagacctacatctgtaacgtcaatcataaacctagcaacacaaaggttgataaaaaggtggaacccaaatcttgcgacaagacgcacacctgtcctccctgcccggcccctgagcttctgggaggcccctccgtgtttctcttccctcccaagcccaaagatacactgatgatcagcagaacccctgaggtcacatgtgtggttgtggacgtctctcatgaagatccggaggtgaagtttaattggtatgttgacggcgtggaagtccacaacgcgaaaaccaagccccgggaggagcagtacaattccacgtaccgcgtggtcagcgtgctgacagttctccatcaagactggctgaacgggaaagaatataagtgcaaagtgtccaataaggcccttcctgctcccattgagaagaccatctctaaagccaagggacagcctagagaaccccaggtctacaccctgccgcctagccgggatgagctcaccaaaaaccaggtgtccctgacatgtcttgttaagggcttctatccctctgacattgctgtggaatgggagagcaatgggcaacctgagaacaattacaaaacaacgccccctgtcctggattccgacggcagctttttcctctattctaagctgaccgtggataagtcccgctggcagcagggaaacgtgtttagctgctctgttatgcacgaagccctgcacaaccattacacacaaaaatccctcagcctgtctcccgggaag

SEQ ID NO: 61655 - RNA, 636 nt, synthetic construct
  misc_feature 1..636: note = derived and/or modified sequence opt5 from CDS (LC) w/o signal peptide encoded by mRNA R3058, R3060
  source 1..636: mol_type = other RNA
gacatccagctgacgcaaagccccgccattatgtccgcttctcctggcgagaaggtgacaatgacgtgcagcgcctcctctagcgtcgggtacatgcactggtatcagcagaaatcctctaccagcccgaagctctggatctacgatacatccaaactggcgagcggagttcccggcagattctctgggtccggaagcggcaactcttattcccttaccattagctctatccaggctgaagacgtggccacatactattgttttcaagggtccggataccctttcacctttggcggcgggacaaagctggagattaaaaccgtggccgctcccagcgtcttcatctttcctccctccgatgaacagctcaagtctggaacggccagcgtggtttgcctgcttaataacttctatcctcgggaggctaaggtgcagtggaaagtcgacaatgccctgcagtccggcaacagccaagaatctgtgaccgagcaggattccaaggacagcacatactctctcagctccaccctgacactgtctaaagcggattacgagaagcataaagtttatgcctgtgaagtgacccaccaggggctcagctccccggtcaccaagagctttaatcgcggagagtgc

SEQ ID NO: 61656 - RNA, 1302 nt, synthetic construct
  misc_feature 1..1302: note = derived and/or modified sequence opt6 from CDS (HC) w/o signal peptide encoded by mRNA R3058, R3060
  source 1..1302: mol_type = other RNA
caagtagaactccaagaatcaggtccaggcatcttacaaccatcccaaacattatcactaacatgctcattctcaggattctcactatcaacatcaggcatgtcagttggatggataagacaaccatctggagaaggactagaatggttagcagatatctggtgggatgacaaaaaagactataacccatcattaaaatcccgactaaccatatccaaagacacatcctctaaccaagttttcttaaaaattacaggagtcgacactgcagatactgccacctattattgcgcaagatccatgataacaaattggtatttcgatgtatggggagcaggcacaacagtaacagtatcatcatccacaaaaggaccttcagttttcccactcgcaccctcatcaaaatcaacctccggaggcactgcagccctaggttgcctagtaaaagactactttcccgaacctgtcacagtatcgtggaactcaggtgctctaacatcaggagtccacacctttccagcagtacttcaatcctccggactctactcattatcatcagttgtaaccgtaccatcatcatcattaggtacccaaacatacatatgtaatgtaaaccataaaccaagcaacaccaaagtcgacaaaaaagtagaaccaaaatcttgcgataaaacacacacatgcccaccctgccccgccccagaactactaggaggaccatcagtattcctattcccacctaaacccaaagacacccttatgatatctcgaacacccgaagtcacgtgtgtagtagtagacgtatcacacgaagaccccgaagtaaaattcaattggtacgtcgacggcgtagaagttcacaacgcaaaaacaaaacctagagaagaacaatataactcaacatatcgcgtagtatcagtcctaacagtactacaccaagactggttaaatggaaaagaatacaaatgcaaagtatcaaataaagcacttccagcacccatagaaaaaacaatatcaaaagcaaaaggtcaaccaagagaacctcaagtatacacattaccaccatcaagagatgaactaacaaaaaaccaagtatcactaacatgtttagtaaaaggtttttacccatctgacatagcagtagaatgggaatccaacggacaacccgaaaataattacaaaaccacacccccagtattagattccgatggatctttcttcttatactcaaaattaactgtagacaaatcaagatggcaacaaggtaacgtattttcatgttcagtcatgcacgaagcacta

SEQ ID NO: 61657 - RNA, 636 nt, synthetic construct
  misc_feature 1..636: note = derived and/or modified sequence opt6 from CDS (LC) w/o signal peptide encoded by mRNA R3058, R3060
  source 1..636: mol_type = other RNA
gacatacaactaacacaatcaccagcaataatgtcagcatcaccaggagaaaaagtaacaatgacatgctcagcaagctcatccgtaggatatatgcactggtatcaacaaaaatcaagcacatcaccaaaattatggatatacgacacatcaaaattagcatcaggagtaccaggacgctttagcggatcaggaagcggaaactcatactctctcacaatatcatcaatacaagccgaagacgtcgcaacatattactgcttccaaggatcaggctacccattcacatttggcggaggaacaaaactagaaataaaaacagtagcagccccaagcgtattcatattcccaccatcagacgaacaactaaaatcaggaacagcatcagtagtttgcctactaaataacttctacccaagagaagcaaaagtacaatggaaagtagacaacgcactacaatcaggaaactcacaagaatcagtaacagaacaagactcaaaagattcaacatattcattatcctcaacactaactttatcaaaagcagactacgaaaaacacaaagtatacgcatgcgaagtaacacaccaaggactatcatccccagtaacaaaatcatttaacagaggagaatgc

SEQ ID NO: 61658 - RNA, 1347 nt, synthetic construct
  misc_feature 1..1347: note = derived and/or modified sequence opt11 from CDS (HC) w/o signal peptide encoded by mRNA R3058, R3060
  source 1..1347: mol_type = other RNA
caagtcgaactccaagaaagcggccccggcatcctccagccctcccaaaccctttccctaacctgctcattctccggcttctccctctccacttccggcatgtccgtaggatggatcagacaaccctccggtgagggcctcgaatggcttgccgacatatggtgggacgacaagaaagactacaacccctccctgaaatcccgcctaaccatctccaaagacacatcctcaaaccaggtcttcctcaaaataaccggcgtcgacaccgccgacaccgccacctactactgcgcacgctccatgataacaaactggtacttcgacgtctggggtgccggcacaaccgtcaccgtctcctcatccactaaaggcccctccgtcttcccactcgccccatcctccaaatccacttccggcggcaccgccgccctcggctgcctcgtcaaagactacttccctgaacccgtcaccgtatcttggaactccggggcactcaccagcggggtccacaccttcccggcagtactccagtcctcaggactctactccctatcctcagtcgtcacagtcccctcctcctccctcggaacccaaacctatatatgcaacgtcaaccacaaaccctcaaacacaaaagtagacaagaaagtcgaacccaaatcatgcgacaaaacacacacatgcccaccctgccccgcacccgaactcttaggaggcccttcagtcttcctcttcccacccaaacccaaagacaccctaatgatatcccgaacccccgaagtaacctgcgtcgtcgtagacgtatcccacgaagacccagaagtcaaattcaactggtacgtcgacggcgtcgaagtccacaacgccaaaaccaaaccccgggaagaacaatacaactctacctaccgagtcgtctcggtactcacagtactccaccaagactggctaaacggaaaagaatacaaatgcaaagtctccaacaaagcactccccgctcccatcgagaaaacaatctccaaagccaaaggccaaccccgcgaaccccaagtctacaccctcccaccctctcgcgacgaactcaccaaaaaccaagtatcactaacctgcctcgtcaaaggattttacccctcagacatcgccgtagaatgggaatccaacggccagccagaaaacaactacaaaaccaccccacccgttctcgactcagacggctcattcttcctctactccaaactcaccgtggacaaatcccgctggcaacagggcaacgtattcagctgctccgtaatgcacgaagcactccacaaccactacacacagaaatctctatccctctcacccggaaaa

SEQ ID NO: 61659 - RNA, 636 nt, synthetic construct
  misc_feature 1..636: note = derived and/or modified sequence opt11 from CDS (LC) w/o signal peptide encoded by mRNA R3058, R3060
  source 1..636: mol_type = other RNA
gacatccaactcacccaatcccccgccatcatgtccgcatcccccggcgaaaaagtcacaatgacctgctccgcctcctcatccgtcggctacatgcactggtaccaacaaaaatcatccacctcccccaaactatggatatacgacacatcaaaactggcctccggcgtccccggacgcttctccggctccggctccggcaactcctactccctcacaatctccagcatccaagccgaagacgtagccacctactactgcttccaaggctcaggctaccccttcaccttcggcggaggcaccaaactagaaatcaaaaccgtcgccgccccctccgtcttcatcttccccccctcagacgaacaactaaaatccggcaccgcctccgtcgtatgcctgctcaacaacttctacccccgcgaagccaaagtccaatggaaagtcgacaacgccctccaatccggcaactcacaagaatccgtcaccgaacaagactccaaagactccacctactccctatcatccaccctaaccctatccaaagccgactacgaaaaacacaaagtatacgcctgcgaagtcacccaccaaggcctcagctcccccgtcaccaaatccttcaaccgcggcgaatgc

SEQ ID NO: 61660 - protein, 474 aa, synthetic construct
  REGION 1..474: note = Protein (HC) encoded by mRNA R3058, R3060
MAVMAPRTLVLLLSGALALTQTWAGQVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61661 - protein, 237 aa, synthetic construct
  REGION 1..237: note = Protein (LC) encoded by mRNA R3058, R3060
MAVMAPRTLVLLLSGALALTQTWAGDIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61662 - RNA, 1425 nt, synthetic construct
  misc_feature 1..1425: note = CDS (HC) encoded by mRNA R3058, R3060
  source 1..1425: mol_type = other RNA
atggccgtgatggcgccgcggaccctggtcctcctgctgagcggcgccctcgccctgacgcagacctgggccgggcaggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtga

SEQ ID NO: 61663 - RNA, 714 nt, synthetic construct
  misc_feature 1..714: note = CDS (LC) encoded by mRNA R3058, R3060
  source 1..714: mol_type = other RNA
atggccgtgatggcgccgcggaccctggtcctcctgctgagcggcgccctcgccctgacgcagacctgggccggggacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61664 - RNA, 2818 nt, synthetic construct
  misc_feature 1..2818: note = CDS (HC)-IRES-CDS (LC) as RNA from mRNA R3058, R3060
  source 1..2818: mol_type = other RNA
atggccgtgatggcgccgcggaccctggtcctcctgctgagcggcgccctcgccctgacgcagacctgggccgggcaggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61665 - RNA, 3010 nt, synthetic construct
  misc_feature 1..3010: note = R3058
  source 1..3010: mol_type = other RNA
gggagaaagcttaccatggccgtgatggcgccgcggaccctggtcctcctgctgagcggcgccctcgccctgacgcagacctgggccgggcaggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag

SEQ ID NO: 61666 - RNA, 3200 nt, synthetic construct
  misc_feature 1..3200: note = R3060
  source 1..3200: mol_type = other RNA
ggggcgctgcctacggaggtggcagccatctccttctcggcatcaagcttaccatggccgtgatggcgccgcggaccctggtcctcctgctgagcggcgccctcgccctgacgcagacctgggccgggcaggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggcgccgcggaccctggtcctcctgctgagcggcgccctcgccctgacgcagacctgggccggggacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 61667 - protein, 450 aa, synthetic construct
  REGION 1..450: note = Protein (HC) w/o signal peptide encoded by mRNA R4179
QVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61668 - RNA, 1350 nt, synthetic construct
  misc_feature 1..1350: note = CDS (HC) w/o signal peptide encoded by mRNA R4179
  source 1..1350: mol_type = other RNA
caggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccgccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaag

SEQ ID NO: 61669 - RNA, 1350 nt, synthetic construct
  misc_feature 1..1350: note = derived and/or modified sequence opt2 from CDS (HC) w/o signal peptide encoded by mRNA R4179
  source 1..1350: mol_type = other RNA
caggtcgagctccaggagtccggccccggcatcctccagccctcccagaccctctccctcacctgctccttctccggcttctccctctccacctccggcatgtccgtcggctggatccgccagccctccggcgagggcctcgagtggctcgccgacatctggtgggacgacaagaaggactacaacccctccctcaagtcccgcctcaccatctccaaggacacctcctccaaccaggtcttcctcaagatcaccggcgtcgacaccgccgacaccgccacctactactgcgcccgctccatgatcaccaactggtacttcgacgtctggggcgccggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61670 - RNA, 1350 nt, synthetic construct
  misc_feature 1..1350: note = derived and/or modified sequence opt3 from CDS (HC) w/o signal peptide encoded by mRNA R4179
  source 1..1350: mol_type = other RNA
caggtggagctgcaagaaagcggccccgggatcctccagccttcccagaccctttctctgacatgctcattcagtggatttagcttgtccacttctggtatgtcggtcggctggattagacagccatcaggggagggattagaatggctggctgacatatggtgggatgacaagaaagattacaacccgagcctaaagagtaggctcacgatctccaaagacacctctagcaatcaagttttcctgaagattacaggcgtggatactgctgacaccgcaacatattactgtgcccggtccatgatcaccaactggtattttgatgtatggggtgcggggactacagtgaccgtctcaagtgctagcacgaaaggaccctctgtgttccctcttgccccatcctcaaagagcacaagtggcggcaccgcagccctggggtgcttggttaaggactactttcccgagcctgtgacagtctcttggaactccggagctctcactagcggtgtgcacaccttcccagcagtactgcagtcgtctggcctgtattccctctcaagtgttgtgacagtccccagctcctctttagggacccagacgtacatttgtaatgtgaatcataaacctagcaacactaaggtggataaaaaggtcgaaccaaaatcatgcgacaagacacacacctgtccgccctgccctgccccagagctgcttggaggccccagtgtgtttttgttccctccaaagcccaaagatactctgatgatctcccgcacaccggaggttacctgtgtagtggtcgacgtgagccatgaagatcctgaggttaagtttaattggtatgtggacggtgtcgaagtgcacaacgctaaaacgaagccccgagaggagcagtacaattctacctaccgtgtagtttcagtgctaacagtcctccatcaagactggctgaacgggaaagaatataagtgcaaagtgagtaataaggcccttccagcgcctatagagaagactatcagcaaagcaaagggacagcccagagaaccacaggtctacaccctgcccccttccagggatgagttgactaaaaaccaggtgtctctcacttgtctggttaagggcttctatccatcggacattgccgtggaatgggagagcaatggccaaccggagaacaattacaaaaccacaccccctgtattagattccgacgggtcatttttcctgtatagtaagctcaccgtcgataagtctcggtggcagcagggaaacgtgtttagctgctccgttatgcacgaagcccttcacaaccattacactcaaaaatcactgagcttgtctccaggtaag

SEQ ID NO: 61671 - RNA, 1350 nt, synthetic construct
  misc_feature 1..1350: note = derived and/or modified sequence opt4 from CDS (HC) w/o signal peptide encoded by mRNA R4179
  source 1..1350: mol_type = other RNA
caggtggagctgcaggagagcggccccggcatcctgcagcccagccagaccctgagcctgacctgcagcttcagcggcttcagcctgagcaccagcggcatgagcgtgggctggatcagacagcccagcggcgagggcctggagtggctggccgacatctggtgggacgacaagaaggactacaaccccagcctgaagagcagactgaccatcagcaaggacaccagcagcaaccaggtgttcctgaagatcaccggcgtggacaccgccgacaccgccacctactactgcgccagaagcatgatcaccaactggtacttcgacgtgtggggcgccggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61672 - RNA, 1350 nt, synthetic construct
  misc_feature 1..1350: note = derived and/or modified sequence opt5 from CDS (HC) w/o signal peptide encoded by mRNA R4179
  source 1..1350: mol_type = other RNA
caggtggagctgcaagaaagcggccccgggatcctccagccttcccagaccctgtctcttacatgcagcttctccggattttctctgagcacgtccggcatgtctgtcgggtggattagacagccgagcggagagggcctcgaatggctggccgacatctggtgggatgacaagaaagattacaacccctcccttaagagccggctgaccatttctaaagacacatccagcaatcaagttttcctcaagatcaccggggtggatacagctgacaccgccacatattactgtgcgcgctctatgattaccaactggtattttgatgtgtggggagctggcacgaccgtcacagtgtccagcgcctctaccaaaggcccttccgttttccccctggcccctagctccaagtctacaagcgggggaaccgctgccctgggctgcctcgtgaaggactactttcccgagcctgtcacggtgtcctggaatagcggggctctgacatctggagttcacaccttcccggccgtgcttcagtccagcggcctgtattctctcagctccgtcgtgacagtgccctctagctccctggggacccagacctacatctgtaacgtcaatcataaacctagcaacacaaaggttgataaaaaggtggaacccaaatcttgcgacaagacgcacacctgtcctccctgcccggcgcctgagcttctgggaggcccctccgtgtttctcttccctcccaagcccaaagatacactgatgatcagcagaacccctgaggtcacatgtgtggttgtggacgtctctcatgaagatccggaggtgaagtttaattggtatgttgacggcgtggaagtccacaacgccaaaaccaagccccgggaggagcagtacaattccacgtaccgcgtggtcagcgtgctgacagttctccatcaagactggctgaacgggaaagaatataagtgcaaagtgtccaataaggcccttcctgctcccattgagaagaccatctctaaagctaagggacagcctagagaaccccaggtctacaccctgccgcctagccgggatgagctcaccaaaaaccaggtgtccctgacatgtcttgttaagggcttctatccctctgacattgccgtggaatgggagagcaatgggcaacctgagaacaattacaaaacaacgccccctgtcctggattccgacggcagctttttcctctattctaagctgaccgtggataagtcccgctggcagcagggaaacgtgtttagctgctctgttatgcacgaagcgctgcacaaccattacacacaaaaatccctcagcctgtctcccgggaag

SEQ ID NO: 61673 - RNA, 1350 nt, synthetic construct
  misc_feature 1..1350: note = derived and/or modified sequence opt6 from CDS (HC) w/o signal peptide encoded by mRNA R4179
  source 1..1350: mol_type = other RNA
caagtagaactccaagaatcaggaccaggtatcctacaaccctctcaaacattatcactaacctgctcattctcaggattctcactatcaacatcaggaatgtctgtaggctggataagacaaccatcaggcgaaggactagaatggctcgcagacatctggtgggatgataaaaaagactataatccttcactaaaatctcgattaaccatctcaaaagacacgtcatctaaccaagtattcttaaaaataacaggagtagatacagcagacactgccacatactattgcgcacgatcaatgataacaaactggtacttcgacgtctggggcgcaggaacaacagtaacagtttcaagtgcctcaacaaaaggtccatccgtattcccattagcaccatcttcaaaatctacatcaggaggaacagcagcactcggctgtctagtcaaagactactttcccgaaccagtaacagtatcatggaattctggagctctaacatcaggcgtacacacatttccagctgttctacaatcatcaggattatactcactttcatcagtcgtaacagtaccatcatcttctctaggaacacaaacttacatatgcaacgtaaaccataaaccctcaaatacaaaagttgacaaaaaagtagaaccaaaatcctgcgataaaacacatacatgccctccatgtccagcaccagaactcctaggaggaccatcagtattcctattcccccctaaaccaaaagacacattaatgatatctagaacaccagaagtaacatgcgtagtagtagatgtatcccacgaagacccagaagtcaaatttaactggtacgttgacggagtagaagtacacaacgcaaaaacaaaaccacgagaagaacaatacaactcaacgtacagagtagtatcagtactaacagtattacatcaagactggcttaacggaaaagaatataaatgtaaagtctcaaacaaagcacttcccgccccaatagaaaaaacgatatcaaaagcaaaaggacaaccaagagaaccacaagtatacacacttcccccaagccgcgacgaactaaccaaaaaccaagtatctctaacctgtctcgtaaaaggattctacccatcagacatagcagtcgagtgggaatcaaacggacaacctgaaaataactacaaaacaacaccaccagtcctagattcagatggatcattcttcctatactcaaaattaacagtagataaatcaagatggcaacaaggaaatgtatttagttgttcagtaatgcacgaagcactacacaaccactacacacaaaaatcactctcactctcaccaggaaaa

SEQ ID NO: 61674 - RNA, 1350 nt, synthetic construct
  misc_feature 1..1350: note = derived and/or modified sequence opt11 from CDS (HC) w/o signal peptide encoded by mRNA R4179
  source 1..1350: mol_type = other RNA
caagttgaactccaggaatccggccccggcatccttcaaccgtctcaaaccctctccctcacctgttccttctccggcttctccctgtccacctcaggcatgtccgtaggctggatccgccaaccctcgggagaaggcctcgaatggctcgcagacatctggtgggatgacaaaaaagactacaatccctcacttaaatcacgcctcaccatctccaaagacacctcctccaaccaagtattcctcaaaatcacaggagtcgacacggcagacaccgccacctactactgcgcccgctccatgataactaactggtacttcgacgtctggggcgccggcaccaccgtcaccgtctcatccgcctccaccaaaggaccctccgtattccctctagcaccctcatccaaatccacatccggaggcaccgcagccctcggctgcctcgtcaaagactacttccccgaaccagtcacggtctcatggaactccggcgccctcacatccggcgtccacacattccccgccgtcctccaatcatccggcctctacagcctctcctctgtcgtaaccgtcccctcctcctcactcggcacacaaacctacatttgcaacgtcaaccacaaaccttccaacaccaaagtcgacaaaaaagtcgaacccaaatcatgcgacaaaacacacacatgccctccctgccctgcccccgaactcctaggcggcccctctgtattcctcttcccacccaaacccaaagatacactcatgatctcccgcacccccgaggtaacgtgcgtcgtcgtcgacgtctcccacgaagaccccgaagtaaaattcaactggtacgtcgacggagtagaagtccacaacgcaaaaaccaaaccccgtgaagaacaatacaactccacctaccgagtagtcagcgtcctcaccgtactccaccaggactggctaaatggaaaagaatacaaatgcaaagtctccaacaaagccctcccagcacccattgaaaaaactataagcaaagcaaaaggccaaccccgcgaaccccaagtctacaccctccccccctcccgcgatgaactcacaaaaaaccaagtttccctaacctgcctcgtcaagggattctacccctccgacatagccgtcgaatgggaatcaaatggccaacccgaaaacaactacaaaaccaccccccccgtactagactcagacggctccttcttcctctactccaaactcacggtagacaaaagcagatggcaacaaggcaacgtcttttcgtgctccgtcatgcacgaagcacttcacaaccactacactcaaaaatccctgtccctatccccaggcaaa

SEQ ID NO: 61675 - protein, 469 aa, synthetic construct
  REGION 1..469: note = Protein (HC) encoded by mRNA R4179
MELGLSWIFLLAILKGVQCQVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61676 - RNA, 1410 nt, synthetic construct
  misc_feature 1..1410: note = CDS (HC) encoded by mRNA R4179
  source 1..1410: mol_type = other RNA
atggagctgggcctcagctggatcttcctgctggccatcctcaagggggtgcagtgccaggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccgccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtga

SEQ ID NO: 61677 - RNA, 1614 nt, synthetic construct
  misc_feature 1..1614: note = R4179
  source 1..1614: mol_type = other RNA
gggagaaagcttaccatggagctgggcctcagctggatcttcctgctggccatcctcaagggggtgcagtgccaggtggagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccgccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61678 - protein, 450 aa, synthetic construct
  REGION 1..450: note = Protein (HC) w/o signal peptide encoded by mRNA R4180
EVQLQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61679 - RNA, 1350 nt, synthetic construct
  misc_feature 1..1350: note = CDS (HC) w/o signal peptide encoded by mRNA R4180
  source 1..1350: mol_type = other RNA
gaggtgcagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccgccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaag

SEQ ID NO: 61680 - RNA, 1350 nt, synthetic construct
  misc_feature 1..1350: note = derived and/or modified sequence opt2 from CDS (HC) w/o signal peptide encoded by mRNA R4180
  source 1..1350: mol_type = other RNA
gaggtccagctccaggagtccggccccggcatcctccagccctcccagaccctctccctcacctgctccttctccggcttctccctctccacctccggcatgtccgtcggctggatccgccagccctccggcgagggcctcgagtggctcgccgacatctggtgggacgacaagaaggactacaacccctccctcaagtcccgcctcaccatctccaaggacacctcctccaaccaggtcttcctcaagatcaccggcgtcgacaccgccgacaccgccacctactactgcgcccgctccatgatcaccaactggtacttcgacgtctggggcgccggcaccaccgtcaccgtctcctccgcctccaccaagggcccctccgtcttccccctcgccccctcctccaagtccacctccggcggcaccgccgccctcggctgcctcgtcaaggactacttccccgagcccgtcaccgtctcctggaactccggcgccctcacctccggcgtccacaccttccccgccgtcctccagtcctccggcctctactccctctcctccgtcgtcaccgtcccctcctcctccctcggcacccagacctacatctgcaacgtcaaccacaagccctccaacaccaaggtcgacaagaaggtcgagcccaagtcctgcgacaagacccacacctgccccccctgccccgcccccgagctcctcggcggcccctccgtcttcctcttcccccccaagcccaaggacaccctcatgatctcccgcacccccgaggtcacctgcgtcgtcgtcgacgtctcccacgaggaccccgaggtcaagttcaactggtacgtcgacggcgtcgaggtccacaacgccaagaccaagccccgcgaggagcagtacaactccacctaccgcgtcgtctccgtcctcaccgtcctccaccaggactggctcaacggcaaggagtacaagtgcaaggtctccaacaaggccctccccgcccccatcgagaagaccatctccaaggccaagggccagccccgcgagccccaggtctacaccctccccccctcccgcgacgagctcaccaagaaccaggtctccctcacctgcctcgtcaagggcttctacccctccgacatcgccgtcgagtgggagtccaacggccagcccgagaacaactacaagaccaccccccccgtcctcgactccgacggctccttcttcctctactccaagctcaccgtcgacaagtcccgctggcagcagggcaacgtcttctcctgctccgtcatgcacgaggccctccacaaccactacacccagaagtccctctccctctcccccggcaag

SEQ ID NO: 61681 - RNA, 1350 nt, synthetic construct
  misc_feature 1..1350: note = derived and/or modified sequence opt3 from CDS (HC) w/o signal peptide encoded by mRNA R4180
  source 1..1350: mol_type = other RNA
gaggtgcagctgcaagaaagcggccccgggatcctccagccttcccagaccctttctctgacatgctcattcagtggatttagcttgtccacttctggtatgtcggtcggctggattagacagccatcaggggagggattagaatggctggctgacatatggtgggatgacaagaaagattacaacccgagcctaaagagtaggctcacgatctccaaagacacctctagcaatcaagttttcctgaagattacaggcgtggatactgctgacaccgcaacatattactgtgcccggtccatgatcaccaactggtattttgatgtatggggtgcggggactacagtgaccgtctcaagtgctagcacgaaaggaccctctgtgttccctcttgccccatcctcaaagagcacaagtggcggcaccgcagccctggggtgcttggttaaggactactttcccgagcctgtgacagtctcttggaactccggagctctcactagcggtgtgcacaccttcccagcagtactgcagtcgtctggcctgtattccctctcaagtgttgtgacagtccccagctcctctttagggacccagacgtacatttgtaatgtgaatcataaacctagcaacactaaggtggataaaaaggtcgaaccaaaatcatgcgacaagacacacacctgtccgccctgccctgccccagagctgcttggaggccccagtgtgtttttgttccctccaaagcccaaagatactctgatgatctcccgcacaccggaggttacctgtgtagtggtcgacgtgagccatgaagatcctgaggttaagtttaattggtatgtggacggtgtcgaagtgcacaacgctaaaacgaagccccgagaggagcagtacaattctacctaccgtgtagtttcagtgctaacagtcctccatcaagactggctgaacgggaaagaatataagtgcaaagtgagtaataaggcccttccagcgcctatagagaagactatcagcaaagcaaagggacagcccagagaaccacaggtctacaccctgcccccttccagggatgagttgactaaaaaccaggtgtctctcacttgtctggttaagggcttctatccatcggacattgccgtggaatgggagagcaatggccaaccggagaacaattacaaaaccacaccccctgtattagattccgacgggtcatttttcctgtatagtaagctcaccgtcgataagtctcggtggcagcagggaaacgtgtttagctgctccgttatgcacgaagcccttcacaaccattacactcaaaaatcactgagcttgtctccaggtaag

SEQ ID NO: 61682 - RNA, 1350 nt, synthetic construct
  misc_feature 1..1350: note = derived and/or modified sequence opt4 from CDS (HC) w/o signal peptide encoded by mRNA R4180
  source 1..1350: mol_type = other RNA
gaggtgcagctgcaggagagcggccccggcatcctgcagcccagccagaccctgagcctgacctgcagcttcagcggcttcagcctgagcaccagcggcatgagcgtgggctggatcagacagcccagcggcgagggcctggagtggctggccgacatctggtgggacgacaagaaggactacaaccccagcctgaagagcagactgaccatcagcaaggacaccagcagcaaccaggtgttcctgaagatcaccggcgtggacaccgccgacaccgccacctactactgcgccagaagcatgatcaccaactggtacttcgacgtgtggggcgccggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 61683 - RNA, 1350 nt, synthetic construct
  misc_feature 1..1350: note = derived and/or modified sequence opt5 from CDS (HC) w/o signal peptide encoded by mRNA R4180
  source 1..1350: mol_type = other RNA
gaggtgcagctgcaagaaagcggccccgggatcctccagccttcccagaccctgtctcttacatgcagcttctccggattttctctgagcacgtccggcatgtctgtcgggtggattagacagccgagcggagagggcctcgaatggctggccgacatctggtgggatgacaagaaagattacaacccctcccttaagagccggctgaccatttctaaagacacatccagcaatcaagttttcctcaagatcaccggggtggatacagctgacaccgccacatattactgtgcgcgctctatgattaccaactggtattttgatgtgtggggagctggcacgaccgtcacagtgtccagcgcctctaccaaaggcccttccgttttccccctggcccctagctccaagtctacaagcgggggaaccgctgccctgggctgcctcgtgaaggactactttcccgagcctgtcacggtgtcctggaatagcggggctctgacatctggagttcacaccttcccggccgtgcttcagtccagcggcctgtattctctcagctccgtcgtgacagtgccctctagctccctggggacccagacctacatctgtaacgtcaatcataaacctagcaacacaaaggttgataaaaaggtggaacccaaatcttgcgacaagacgcacacctgtcctccctgcccggcgcctgagcttctgggaggcccctccgtgtttctcttccctcccaagcccaaagatacactgatgatcagcagaacccctgaggtcacatgtgtggttgtggacgtctctcatgaagatccggaggtgaagtttaattggtatgttgacggcgtggaagtccacaacgccaaaaccaagccccgggaggagcagtacaattccacgtaccgcgtggtcagcgtgctgacagttctccatcaagactggctgaacgggaaagaatataagtgcaaagtgtccaataaggcccttcctgctcccattgagaagaccatctctaaagctaagggacagcctagagaaccccaggtctacaccctgccgcctagccgggatgagctcaccaaaaaccaggtgtccctgacatgtcttgttaagggcttctatccctctgacattgccgtggaatgggagagcaatgggcaacctgagaacaattacaaaacaacgccccctgtcctggattccgacggcagctttttcctctattctaagctgaccgtggataagtcccgctggcagcagggaaacgtgtttagctgctctgttatgcacgaagcgctgcacaaccattacacacaaaaatccctcagcctgtctcccgggaag

SEQ ID NO: 61684 - RNA, 1350 nt, synthetic construct
  misc_feature 1..1350: note = derived and/or modified sequence opt6 from CDS (HC) w/o signal peptide encoded by mRNA R4180
  source 1..1350: mol_type = other RNA
gaagtacaactacaagaatcaggacccggcatcctgcaaccatcacaaacattatcactaacatgctcattctcaggattctcactttctacctcaggaatgtccgtcggttggataagacaaccatcaggagaaggactagaatggttagcagacatatggtgggacgacaaaaaagactacaacccatccttaaaatctagattaacaatatctaaagatacatcatcaaatcaagtattcttaaaaatcactggagtggacacagccgacactgcaacatactattgcgccagatcaatgataacaaactggtatttcgacgtctggggagcaggaaccaccgtaacagtatcctccgcatccaccaaaggaccatccgtattcccacttgccccctcctcaaaaagtacatctggtggaacagcagcactaggatgcttagtcaaagactactttcccgaaccagtaacagtttcctggaactcaggagcattaacatcaggcgtacacacattcccagcagtcctacaaagctcaggactctactcactttcatccgtagttacagttccatcctcttccctaggaacacaaacttacatatgtaacgtaaaccataaaccatcaaatacaaaagtagataaaaaagtagaaccaaaatcctgcgacaaaacacatacatgtccaccatgtccagcaccagaactactaggaggaccatcagtattcctattcccacctaaaccaaaagacacactaatgatatccagaacaccagaagtaacatgcgtagttgtagacgtatcacacgaagatccagaagtaaaattcaattggtacgtagacggagtcgaagtacacaatgcaaaaacaaaaccacgtgaagaacaatacaactctacatacagagtagtatcagtcctaacagtattacaccaagactggctaaacggtaaagaatacaaatgcaaagtctcaaacaaagcattaccagcaccaatagaaaaaacaatatcaaaagctaaaggacaaccaagagaaccacaagtatacaccctacccccatcaagagacgaattaacaaaaaaccaagtatctcttacatgcttagtaaaaggtttttacccatccgacatagcagtagaatgggaatcgaacggccaacccgaaaacaattacaaaacaacaccaccagtcctcgattcagacggttcattcttcctttactccaaacttacagtcgacaaaagtagatggcaacaaggaaacgtattcagctgttcagtcatgcacgaagccctacataaccactacacacaaaaatcactatccctaagccccggcaaa

SEQ ID NO: 61685 - RNA, 1350 nt, synthetic construct
  misc_feature 1..1350: note = derived and/or modified sequence opt11 from CDS (HC) w/o signal peptide encoded by mRNA R4180
  source 1..1350: mol_type = other RNA
gaagtgcagctccaagaatccggtcccggcatactacaacccagccaaaccctttccctaacctgcagcttctccggcttctctctttccacctccggcatgagcgtcggctggatccgccaaccatccggcgaaggactcgaatggctcgccgatatctggtgggacgacaagaaagactacaacccctccctcaaatccagactcacaatttccaaagacacatcctccaaccaagtctttctcaaaatcaccggcgtcgacaccgcggacaccgccacatactactgcgcccgctcaatgatcacaaactggtacttcgacgtctggggcgccggcacgactgtcaccgtctcgagcgcatcgaccaaaggaccatcagtcttcccactggccccatcctccaaatcaacatccggcggaaccgccgcactcggctgcctcgtcaaagactacttcccagaacccgtcaccgtctcctggaactccggcgccctcacctctggtgtccacactttccccgccgtcctacaatcctccggactatattcactctcatccgtcgtcaccgtcccctcctcatcactcggcacacaaacctacatctgcaacgtcaaccacaaaccatctaacaccaaagttgacaagaaagtagaacccaaatcctgcgacaaaactcacacctgtcccccatgccccgctcccgaactcctcggaggcccctcagtattcctattcccacccaaacccaaagacaccctcatgatatcccgaaccccagaagttacatgcgtcgtagtcgacgtcagccacgaagaccccgaagtcaaatttaactggtacgtcgacggagtcgaagtccacaacgctaaaactaaacctcgcgaagaacaatacaactccacctaccgggtcgtatccgtcctcactgtcctgcaccaagactggctcaacggcaaagaatacaaatgcaaagtctcaaacaaagcactgcccgcccccatcgagaaaaccatctccaaagccaaaggccaaccccgcgaaccccaagtctacacactaccaccatcccgcgacgaactcaccaaaaaccaagtcagcctaacatgcctcgtcaaaggcttctacccctccgacatcgccgtagaatgggaatccaacggccaaccagaaaacaactacaaaaccaccccacccgtcctcgactcagacggctccttcttcctctattccaaactcaccgtagacaagtccagatggcaacaaggcaacgtcttctcctgctccgtcatgcacgaagcactccacaaccactacacccagaaatctctctccctctcacccggcaaa

SEQ ID NO: 61686 - protein, 469 aa, synthetic construct
  REGION 1..469: note = Protein (HC) encoded by mRNA R4180
MELGLSWIFLLAILKGVQCEVQLQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61687 - RNA, 1410 nt, synthetic construct
  misc_feature 1..1410: note = CDS (HC) encoded by mRNA R4180
  source 1..1410: mol_type = other RNA
atggagctgggcctcagctggatcttcctgctggccatcctcaagggggtgcagtgcgaggtgcagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccgccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtga

SEQ ID NO: 61688 - RNA, 1614 nt, synthetic construct
  misc_feature 1..1614: note = R4180
  source 1..1614: mol_type = other RNA
gggagaaagcttaccatggagctgggcctcagctggatcttcctgctggccatcctcaagggggtgcagtgcgaggtgcagctgcaggagagcggccccgggatcctccagccgtcccagaccctgagcctgacctgctccttcagcggcttctccctcagcacgtccgggatgagcgtcggctggatccgccagccctccggggagggcctggagtggctggccgacatctggtgggacgacaagaaggactacaaccccagcctcaagtcccggctgaccatcagcaaggacacctccagcaaccaggtgttcctgaagatcaccggcgtggacacggccgacaccgcgacctactactgcgcccgctccatgatcaccaactggtacttcgacgtgtggggcgccgggacgaccgtgaccgtgagctccgccagcaccaagggcccctccgtgttcccgctggcccccagctccaagagcacctccgggggcacggccgcgctcgggtgcctggtcaaggactacttccccgagcccgtgaccgtgagctggaactccggcgccctgaccagcggggtccacaccttcccggccgtgctccagtccagcggcctgtactccctgagctccgtggtcacggtgcccagctccagcctcggcacccagacctacatctgcaacgtgaaccacaagccctccaacaccaaggtcgacaagaaggtggagcccaagagctgcgacaagacgcacacctgcccgccctgccccgcccccgagctgctgggcgggccgtccgtgttcctcttccctcccaagcccaaggacaccctgatgatcagccgcaccccggaggtcacgtgcgtggtggtcgacgtgagccacgaggaccccgaggtgaagttcaactggtacgtcgacggggtggaggtgcacaacgccaagaccaagccccgggaggagcagtacaactccacctaccgcgtcgtgagcgtgctgaccgtcctccaccaggactggctgaacggcaaggagtacaagtgcaaggtgtccaacaaggcgctgcccgccccgatcgagaagacgatcagcaaggccaaggggcagccccgggagccccaggtctacaccctcccgccgtcccgcgacgagctgaccaagaaccaggtgagcctgacctgcctcgtgaagggcttctacccctccgacatcgccgtcgagtgggagagcaacggccagccggagaacaactacaagacgacccctccggtgctggactccgacgggagcttcttcctgtactccaagctcaccgtggacaagagccggtggcagcagggcaacgtcttctcctgcagcgtgatgcacgaggcgctgcacaaccactacacccagaagtccctgagcctctcccccgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61689 - protein, 213 aa, synthetic construct
  REGION 1..213: note = Protein (LC) w/o signal peptide encoded by mRNA R4181
DIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61690 - RNA, 639 nt, synthetic construct
  misc_feature 1..639: note = CDS (LC) w/o signal peptide encoded by mRNA R4181
  source 1..639: mol_type = other RNA
gacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgc

SEQ ID NO: 61691 - RNA, 639 nt, synthetic construct
  misc_feature 1..639: note = derived and/or modified sequence opt2 from CDS (LC) w/o signal peptide encoded by mRNA R4181
  source 1..639: mol_type = other RNA
gacatccagctcacccagtcccccgccatcatgtccgcctcccccggcgagaaggtcaccatgacctgctccgcctcctcctccgtcggctacatgcactggtaccagcagaagtcctccacctcccccaagctctggatctacgacacctccaagctcgcctccggcgtccccggccgcttctccggctccggctccggcaactcctactccctcaccatctcctccatccaggccgaggacgtcgccacctactactgcttccagggctccggctaccccttcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61692 - RNA, 639 nt, synthetic construct
  misc_feature 1..639: note = derived and/or modified sequence opt3 from CDS (LC) w/o signal peptide encoded by mRNA R4181
  source 1..639: mol_type = other RNA
gacatccagctgacccaaagccccgccattatgtccgcttctcctggcgagaaggtgacaatgacttgctcagcaagtagctccgtcgggtacatgcactggtatcagcagaaatcttcgacgtcaccaaagctctggatatacgataccagcaaacttgccagtggagttccgggtagattctccggctctgggagcggaaactcctattcactgacaatcagtagcattcaggcggaagacgtggctacttactattgttttcaaggctctggttaccccttcacctttgggggaggcacaaagttggagatcaaaaggaccgtagccgcaccttccgtgttcatttttccaccctcagatgaacagttaaagagcggcactgccagtgtcgtgtgcctgctaaataacttctatcctcgggaggctaaggttcagtggaaagtggacaatgcactccagtctgggaactcccaagaaagcgtcacagagcaggattcgaaggactctacctactccctgtcaagtacgcttactctgagcaaagccgattacgagaagcataaagtgtatgcttgtgaagtaacccaccagggattgtcctctccagttacaaagagctttaatcgcggtgagtgc

SEQ ID NO: 61693 - RNA, 639 nt, synthetic construct
  misc_feature 1..639: note = derived and/or modified sequence opt4 from CDS (LC) w/o signal peptide encoded by mRNA R4181
  source 1..639: mol_type = other RNA
gacatccagctgacccagagccccgccatcatgagcgccagccccggcgagaaggtgaccatgacctgcagcgccagcagcagcgtgggctacatgcactggtaccagcagaagagcagcaccagccccaagctgtggatctacgacaccagcaagctggccagcggcgtgcccggcagattcagcggcagcggcagcggcaacagctacagcctgaccatcagcagcatccaggccgaggacgtggccacctactactgcttccagggcagcggctaccccttcaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61694 - RNA, 639 nt, synthetic construct
  misc_feature 1..639: note = derived and/or modified sequence opt5 from CDS (LC) w/o signal peptide encoded by mRNA R4181
  source 1..639: mol_type = other RNA
gacatccagctgacgcaaagccccgccattatgtccgcttctcctggcgagaaggtgacaatgacgtgcagcgcctcctctagcgtcgggtacatgcactggtatcagcagaaatcctctaccagcccgaagctctggatctacgatacatccaaactggcgagcggagttcccggcagattctctgggtccggaagcggcaactcttattcccttaccattagctctatccaggctgaagacgtggccacatactattgttttcaagggtccggataccctttcacctttggcggcgggacaaagctggagattaaacggaccgtggccgctcccagcgtcttcatctttcctccctccgatgaacagctcaagtctggaacggccagcgtggtttgcctgcttaataacttctatcctcgcgaggctaaggtgcagtggaaagtcgacaatgccctgcagtccggcaacagccaagaatctgtgaccgagcaggattccaaggacagcacatactctctcagctccaccctgacactgtctaaagcggattacgagaagcataaagtttatgcctgtgaagtgacccaccaggggctcagctccccggtcaccaagagctttaatagaggagagtgc

SEQ ID NO: 61695 - RNA, 639 nt, synthetic construct
  misc_feature 1..639: note = derived and/or modified sequence opt6 from CDS (LC) w/o signal peptide encoded by mRNA R4181
  source 1..639: mol_type = other RNA
gacatacaactaacacaaagcccagcaataatgtcagcatcaccaggagaaaaagtaacaatgacatgctcagcatcatcatcagtaggatacatgcactggtaccaacaaaaatcatcaacatcaccaaaactatggatatacgatacatcaaaattagcatccggagtaccaggaagattttcaggatccggatcaggaaactcctactcactaacaatatcatcaatacaagcagaagacgtagcaacatactactgcttccaaggatccggatacccatttacattcggaggaggaacaaaattagaaataaaaagaacagtagcagcaccatcagtattcatattcccaccatcagacgaacaactaaaatcaggaacagcatcagtagtatgcctactaaacaatttctacccacgagaagcaaaagtacaatggaaagtagacaacgcactacaatcaggaaactcccaagaatcagtaacagaacaagactcaaaagactcaacctactcactatcatcaacactaacactatcaaaagcagactatgaaaaacacaaagtatacgcatgcgaagtaacacaccaaggactatcctcacccgtaacaaaatcatttaatagaggcgaatgc

SEQ ID NO: 61696 - RNA, 639 nt, synthetic construct
  misc_feature 1..639: note = derived and/or modified sequence opt11 from CDS (LC) w/o signal peptide encoded by mRNA R4181
  source 1..639: mol_type = other RNA
gacatacaactcacccaatcccccgccatcatgtcagcctcacccggcgaaaaagtcaccatgacctgctcagcctcctcctcagtaggctacatgcactggtaccaacaaaaatcctcaacctcccccaaactctggatctacgacacctccaaactcgcctctggcgtacccggccgcttctcaggctcaggctcaggcaactcctactccctcaccatctcctctatccaagccgaagacgtcgccacctactactgcttccaaggctccggctaccccttcaccttcggcggcggaaccaaactcgaaatcaaacgcaccgtcgccgcaccctccgtcttcatcttccccccctccgacgaacaactcaaatccggcaccgcctccgtcgtctgcctactcaacaacttctacccccgcgaagccaaagtccaatggaaagtcgacaacgcccttcaatctggcaactcccaagaatcagtcaccgaacaagactccaaagactccacctactccctctcctccaccctcaccctctccaaagccgactacgaaaaacacaaagtctacgcctgcgaagtcacacaccaaggcctatcctcccccgtcaccaaatccttcaaccgcggtgaatgc

SEQ ID NO: 61697 - protein, 233 aa, synthetic construct
  REGION 1..233: note = Protein (LC) encoded by mRNA R4181
METPAQLLFLLLLWLPDTTGDIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61698 - RNA, 702 nt, synthetic construct
  misc_feature 1..702: note = CDS (LC) encoded by mRNA R4181
  source 1..702: mol_type = other RNA
atggagacccccgcccagctgctcttcctgctgctcctgtggctgccggacaccacgggcgacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61699 - RNA, 906 nt, synthetic construct
  misc_feature 1..906: note = R4181
  source 1..906: mol_type = other RNA
gggagaaagcttaccatggagacccccgcccagctgctcttcctgctgctcctgtggctgccggacaccacgggcgacatccagctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61700 - protein, 213 aa, synthetic construct
  REGION 1..213: note = Protein (LC) w/o signal peptide encoded by mRNA R4182
DIVLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61701 - RNA, 639 nt, synthetic construct
  misc_feature 1..639: note = CDS (LC) w/o signal peptide encoded by mRNA R4182
  source 1..639: mol_type = other RNA
gacatcgtcctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgc

SEQ ID NO: 61702 - RNA, 639 nt, synthetic construct
  misc_feature 1..639: note = derived and/or modified sequence opt2 from CDS (LC) w/o signal peptide encoded by mRNA R4182
  source 1..639: mol_type = other RNA
gacatcgtcctcacccagtcccccgccatcatgtccgcctcccccggcgagaaggtcaccatgacctgctccgcctcctcctccgtcggctacatgcactggtaccagcagaagtcctccacctcccccaagctctggatctacgacacctccaagctcgcctccggcgtccccggccgcttctccggctccggctccggcaactcctactccctcaccatctcctccatccaggccgaggacgtcgccacctactactgcttccagggctccggctaccccttcaccttcggcggcggcaccaagctcgagatcaagcgcaccgtcgccgccccctccgtcttcatcttccccccctccgacgagcagctcaagtccggcaccgcctccgtcgtctgcctcctcaacaacttctacccccgcgaggccaaggtccagtggaaggtcgacaacgccctccagtccggcaactcccaggagtccgtcaccgagcaggactccaaggactccacctactccctctcctccaccctcaccctctccaaggccgactacgagaagcacaaggtctacgcctgcgaggtcacccaccagggcctctcctcccccgtcaccaagtccttcaaccgcggcgagtgc

SEQ ID NO: 61703 - RNA, 639 nt, synthetic construct
  misc_feature 1..639: note = derived and/or modified sequence opt3 from CDS (LC) w/o signal peptide encoded by mRNA R4182
  source 1..639: mol_type = other RNA
gacatcgtgctgacccagagccccgccattatgtccgcttctcctggcgagaaggtcacaatgacttgctcagcaagtagctccgttgggtacatgcactggtatcaacagaaatcttcgacgtcaccaaagctctggatatacgataccagcaaacttgccagtggagtgccgggtagattctccggctctgggagcggaaactcctattcactgacaatcagtagcattcaggcggaagacgtagctacttactattgttttcagggctctggttaccccttcacctttgggggaggcacaaagttggagatcaaaaggaccgtggccgcaccttccgtcttcatttttccaccctcagatgaacaattaaagagcggcactgccagtgtggtttgcctgctaaataacttctatcctcgggaggctaaggtgcagtggaaagtcgacaatgcactccagtctgggaactcccaggaaagcgtgacagagcaagattcgaaggactctacctactccctgtcaagtacgcttactctgagcaaagccgattacgagaagcataaagtatatgcttgtgaagttacccaccagggattgtcctctccagtgacaaagagctttaatcgcggtgagtgc

SEQ ID NO: 61704 - RNA, 639 nt, synthetic construct
  misc_feature 1..639: note = derived and/or modified sequence opt4 from CDS (LC) w/o signal peptide encoded by mRNA R4182
  source 1..639: mol_type = other RNA
gacatcgtgctgacccagagccccgccatcatgagcgccagccccggcgagaaggtgaccatgacctgcagcgccagcagcagcgtgggctacatgcactggtaccagcagaagagcagcaccagccccaagctgtggatctacgacaccagcaagctggccagcggcgtgcccggcagattcagcggcagcggcagcggcaacagctacagcctgaccatcagcagcatccaggccgaggacgtggccacctactactgcttccagggcagcggctaccccttcaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 61705 - RNA, 639 nt, synthetic construct
  misc_feature 1..639: note = derived and/or modified sequence opt5 from CDS (LC) w/o signal peptide encoded by mRNA R4182
  source 1..639: mol_type = other RNA
gacatcgtgctgacgcagagccccgccattatgtccgcttctcctggcgagaaggtcacaatgacgtgcagcgcctcctctagcgttgggtacatgcactggtatcaacagaaatcctctaccagcccgaagctctggatctacgatacatccaaactggcgagcggagtgcccggcagattctctgggtccggaagcggcaactcttattcccttaccattagctctatccaggctgaagacgtggccacatactattgttttcaggggtccggataccctttcacctttggcggcgggacaaagctggagattaaacggaccgtcgccgctcccagcgtgttcatctttcctccctccgatgaacaactcaagtctggaacggccagcgttgtgtgcctgcttaataacttctatcctcgcgaggctaaggtccagtggaaagtggacaatgccctgcagtccggcaacagccaggaatctgttaccgagcaagattccaaggacagcacatactctctcagctccaccctgacactgtctaaagcggattacgagaagcataaagtgtatgcctgtgaagtcacccaccaggggctcagctccccggtgaccaagagctttaatagaggagagtgc

SEQ ID NO: 61706 - RNA, 639 nt, synthetic construct
  misc_feature 1..639: note = derived and/or modified sequence opt6 from CDS (LC) w/o signal peptide encoded by mRNA R4182
  source 1..639: mol_type = other RNA
gacatagtcctaacacaatccccagccataatgtcagcatcaccaggagaaaaagttacaatgacatgctcagcatcatcatcagtaggatacatgcactggtaccaacaaaaatcatcaacatcaccaaaactatggatatacgacacatcaaaactagcatcaggagtaccaggacgattctcaggatcaggatcaggtaactcatactcactaacaatatcatcaatacaagcagaagatgtagcaacatattactgcttccaaggatcaggataccccttcacattcggaggaggaacaaaactagaaataaaaagaacagtagcagccccatcagtattcatattcccaccatcagacgaacaactaaaatcaggaaccgcatcagtagtatgcctactaaacaacttttacccaagagaagcaaaagtacaatggaaagtagacaatgcattacaatcaggaaactcacaagaatcagtaacagaacaagactcaaaagattccacatactccctatcatcaaccttaacactatcaaaagcagactacgaaaaacacaaagtatacgcatgcgaagtaacacaccaaggactatcttcaccagtaacaaaatcattcaatagaggagaatgc

SEQ ID NO: 61707 - RNA, 639 nt, synthetic construct
  misc_feature 1..639: note = derived and/or modified sequence opt11 from CDS (LC) w/o signal peptide encoded by mRNA R4182
  source 1..639: mol_type = other RNA
gacatcgtcctaacccaatcccccgccataatgtccgcctcacccggcgaaaaagtcaccatgacctgctccgcctcctcctcagtcggctacatgcactggtaccaacaaaaatcatccacctcccccaaactctggatctacgacacctccaaactcgcatcaggcgtccccggccgcttctccggctccggctccggaaactcctactccctcaccatctcctccatccaagccgaagacgtagccacctactactgcttccaaggctctggctaccccttcaccttcggaggcggaaccaaactcgaaatcaaacgcaccgtcgcagcaccctccgtattcatcttccccccctccgacgaacaactcaaatcaggcaccgcctccgtcgtctgcctcctcaacaacttctacccccgagaagccaaagtccaatggaaagtagacaacgccctccaatccggaaactcccaagaatccgtcaccgaacaagactccaaagactccacctactccctctcctcaaccctcaccctctccaaagccgactacgaaaaacacaaagtctacgcctgcgaagtcacccaccaaggcctctcctcacccgtcaccaagtcattcaaccgaggcgaatgc

SEQ ID NO: 61708 - protein, 233 aa, synthetic construct
  REGION 1..233: note = Protein (LC) encoded by mRNA R4182
METPAQLLFLLLLWLPDTTGDIVLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61709 - RNA, 702 nt, synthetic construct
  misc_feature 1..702: note = CDS (LC) encoded by mRNA R4182
  source 1..702: mol_type = other RNA
atggagacccccgcccagctgctcttcctgctgctcctgtggctgccggacaccacgggcgacatcgtcctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctga

SEQ ID NO: 61710 - RNA, 906 nt, synthetic construct
  misc_feature 1..906: note = R4182
  source 1..906: mol_type = other RNA
gggagaaagcttaccatggagacccccgcccagctgctcttcctgctgctcctgtggctgccggacaccacgggcgacatcgtcctgacccagagccccgccatcatgtccgccagcccgggcgagaaggtgaccatgacgtgctccgcgagctccagcgtcgggtacatgcactggtaccagcagaagtccagcacctcccccaagctctggatctacgacaccagcaagctggcctccggcgtgcccgggcgcttcagcggctccgggagcggcaactcctacagcctgaccatctccagcatccaggccgaggacgtggccacgtactactgcttccagggctccgggtaccccttcaccttcggcgggggcaccaagctcgagatcaagcgcaccgtggccgcccccagcgtcttcatcttcccgccctccgacgagcagctgaagagcggcaccgcgtccgtggtgtgcctcctgaacaacttctacccccgcgaggccaaggtccagtggaaggtggacaacgccctgcagagcgggaactcccaggagagcgtgacggagcaggactccaaggacagcacctactccctcagctccaccctgaccctgagcaaggccgactacgagaagcacaaggtctacgcctgcgaggtgacgcaccaggggctctccagccccgtgaccaagtccttcaaccggggcgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61711 - protein, 446 aa, synthetic construct
  REGION 1..446: note = Protein (HC) w/o signal peptide encoded by mRNA R3983, R4124
EVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSAETTAPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 61712 - RNA, 1338 nt, synthetic construct
  misc_feature 1..1338: note = CDS (HC) w/o signal peptide encoded by mRNA R3983, R4124
  source 1..1338: mol_type = other RNA
gaggtccagctcgtcgagaccggcggcggcctcgtccagcccggcaacagcctcaagctcagctgcgccaccagcggcttcatcttcagcaccacctggatgaactggatccggcagacccccggcaagcggctcgagtggctcgcccagatcgaggacaagagcaacaactacttcatcagctacagcgagagcgtcaagggccggttcaccatcagccgggacgacagcaagagcagcgtctacctccagatgaacaacctcaaggaggaggacaccgccatctactactgcagctggaagtaccggagcaactactacttcgactactggggccagggcgtcatggtcaccgtcagcgccgagaccaccgcccccagcgtgtacccgctggcgcccggcacggccctcaagtccaacagcatggtcaccctggggtgcctggtgaagggctacttccccgagcccgtgaccgtcacctggaactccggggccctcagctccggcgtgcacacgttccccgccgtgctgcagagcgggctgtacaccctcacctccagcgtcaccgtgccctccagcacgtggccctcccagaccgtgacctgcaacgtcgcccaccccgcgagctccaccaaggtggacaagaagatcgtgccgcgcaactgcggcggcgactgcaagccctgcatctgcacggggagcgaggtctccagcgtgttcatcttcccgcccaagccgaaggacgtgctgaccatcaccctgacccccaaggtcacgtgcgtggtggtcgacatctcccaggacgaccccgaggtgcacttcagctggttcgtggacgacgtcgaggtgcacaccgcccagacccggcccccggaggagcagttcaactccaccttccgcagcgtgagcgagctccccatcctgcaccaggactggctgaacggccggacgttccgctgcaaggtcacctccgccgccttccccagccccatcgagaagaccatctccaagccggaggggcggacccaggtgccccacgtctacacgatgagccccaccaaggaggagatgacccagaacgaggtgtccatcacctgcatggtgaagggcttctacccgcccgacatctacgtcgagtggcagatgaacgggcagccccaggagaactacaagaacacgccgcccaccatggacaccgacggcagctacttcctctactccaagctgaacgtgaagaaggagaagtggcagcagggcaacaccttcacgtgcagcgtgctgcacgaggggctccacaaccaccacaccgagaagtccctgagccactccccgggcaag

SEQ ID NO: 61713 - RNA, 1338 nt, synthetic construct
  misc_feature 1..1338: note = derived and/or modified sequence opt2 from CDS (HC) w/o signal peptide encoded by mRNA R3983, R4124
  source 1..1338: mol_type = other RNA
gaggtccagctcgtcgagaccggcggcggcctcgtccagcccggcaactccctcaagctctcctgcgccacctccggcttcatcttctccaccacctggatgaactggatccgccagacccccggcaagcgcctcgagtggctcgcccagatcgaggacaagtccaacaactacttcatctcctactccgagtccgtcaagggccgcttcaccatctcccgcgacgactccaagtcctccgtctacctccagatgaacaacctcaaggaggaggacaccgccatctactactgctcctggaagtaccgctccaactactacttcgactactggggccagggcgtcatggtcaccgtctccgccgagaccaccgccccctccgtctaccccctcgcccccggcaccgccctcaagtccaactccatggtcaccctcggctgcctcgtcaagggctacttccccgagcccgtcaccgtcacctggaactccggcgccctctcctccggcgtccacaccttccccgccgtcctccagtccggcctctacaccctcacctcctccgtcaccgtcccctcctccacctggccctcccagaccgtcacctgcaacgtcgcccaccccgcctcctccaccaaggtcgacaagaagatcgtcccccgcaactgcggcggcgactgcaagccctgcatctgcaccggctccgaggtctcctccgtcttcatcttcccccccaagcccaaggacgtcctcaccatcaccctcacccccaaggtcacctgcgtcgtcgtcgacatctcccaggacgaccccgaggtccacttctcctggttcgtcgacgacgtcgaggtccacaccgcccagacccgcccccccgaggagcagttcaactccaccttccgctccgtctccgagctccccatcctccaccaggactggctcaacggccgcaccttccgctgcaaggtcacctccgccgccttcccctcccccatcgagaagaccatctccaagcccgagggccgcacccaggtcccccacgtctacaccatgtcccccaccaaggaggagatgacccagaacgaggtctccatcacctgcatggtcaagggcttctacccccccgacatctacgtcgagtggcagatgaacggccagccccaggagaactacaagaacaccccccccaccatggacaccgacggctcctacttcctctactccaagctcaacgtcaagaaggagaagtggcagcagggcaacaccttcacctgctccgtcctccacgagggcctccacaaccaccacaccgagaagtccctctcccactcccccggcaag

SEQ ID NO: 61714 - RNA, 1338 nt, synthetic construct
  misc_feature 1..1338: note = derived and/or modified sequence opt3 from CDS (HC) w/o signal peptide encoded by mRNA R3983, R4124
  source 1..1338: mol_type = other RNA
gaggtgcagctggtcgaaaccggcgggggactcgttcaacccggtaacagccttaagctgtcctgcgccacatctggcttcatcttttcaactacgtggatgaattggattagacagacccctgggaaaaggttggagtggttagctcagatagaagacaagagtaacaattacttcatcagctattccgagtctgtgaaaggacggtttacaatttcgcgcgatgactcaaagagcagtgtatacctgcagatgaacaatctaaaagaagaggatactgcaatctattactgttcctggaagtatcgatctaactactatttcgactactggggccaaggtgtgatggtcaccgtgagcgccgagacaaccgcgccatccgtttacccgctcgctcccgggactgccctgaagtcaaatagtatggtgacacttggatgcctggtcaaaggctattttcctgaaccagtgaccgtaacgtggaacagcggcgcattgtcttccggggttcacactttccccgccgtgctccagtcaggactgtacaccctgacaagcagtgtcactgtgccttcttccacctggccaagccagacagtgacctgtaatgtcgctcatcccgcatcgtctacgaaggttgataaaaagattgtgcctcgtaactgcggtggcgactgtaaaccatgcatctgtactgggtccgaggtatcaagtgtgtttatattcccgcccaagcctaaggatgtcctcacaatcaccttaactccaaaagtgacatgcgttgtggtcgacattagccaggatgaccccgaagtgcacttttcctggttcgtagatgacgttgaggtgcataccgcccaaacgagacctccagaggaacagtttaattctaccttcaggagcgtctcagagctgcccatccttcaccaggattggttgaacggacggacatttcgctgtaaggtgaccagtgctgccttcccgtcccctattgagaaaactatcagcaagcccgaaggcagaacacaggtcccacatgtgtatactatgtctcctaccaaagaagagatgacacaaaatgaggtttcaataacctgcatggtgaagggtttctatcccccagacatttacgtagaatggcagatgaacgggcagccccaagagaattacaaaaacactcctccaacgatggacacagatggaagttattttctgtacagcaagctaaacgtcaagaaagaaaagtggcagcagggcaataccttcacttgttccgtgctccacgagggcctgcacaaccatcacaccgaaaaatctctttcgcatagcccggggaag

SEQ ID NO: 61715 - RNA, 1338 nt, synthetic construct
  misc_feature 1..1338: note = derived and/or modified sequence opt4 from CDS (HC) w/o signal peptide encoded by mRNA R3983, R4124
  source 1..1338: mol_type = other RNA
gaggtgcagctggtggagaccggcggcggcctggtgcagcccggcaacagcctgaagctgagctgcgccaccagcggcttcatcttcagcaccacctggatgaactggatcagacagacccccggcaagagactggagtggctggcccagatcgaggacaagagcaacaactacttcatcagctacagcgagagcgtgaagggcagattcaccatcagcagagacgacagcaagagcagcgtgtacctgcagatgaacaacctgaaggaggaggacaccgccatctactactgcagctggaagtacagaagcaactactacttcgactactggggccagggcgtgatggtgaccgtgagcgccgagaccaccgcccccagcgtgtaccccctggcccccggcaccgccctgaagagcaacagcatggtgaccctgggctgcctggtgaagggctacttccccgagcccgtgaccgtgacctggaacagcggcgccctgagcagcggcgtgcacaccttccccgccgtgctgcagagcggcctgtacaccctgaccagcagcgtgaccgtgcccagcagcacctggcccagccagaccgtgacctgcaacgtggcccaccccgccagcagcaccaaggtggacaagaagatcgtgcccagaaactgcggcggcgactgcaagccctgcatctgcaccggcagcgaggtgagcagcgtgttcatcttcccccccaagcccaaggacgtgctgaccatcaccctgacccccaaggtgacctgcgtggtggtggacatcagccaggacgaccccgaggtgcacttcagctggttcgtggacgacgtggaggtgcacaccgcccagaccagaccccccgaggagcagttcaacagcaccttcagaagcgtgagcgagctgcccatcctgcaccaggactggctgaacggcagaaccttcagatgcaaggtgaccagcgccgccttccccagccccatcgagaagaccatcagcaagcccgagggcagaacccaggtgccccacgtgtacaccatgagccccaccaaggaggagatgacccagaacgaggtgagcatcacctgcatggtgaagggcttctacccccccgacatctacgtggagtggcagatgaacggccagccccaggagaactacaagaacaccccccccaccatggacaccgacggcagctacttcctgtacagcaagctgaacgtgaagaaggagaagtggcagcagggcaacaccttcacctgcagcgtgctgcacgagggcctgcacaaccaccacaccgagaagagcctgagccacagccccggcaag

SEQ ID NO: 61716 - RNA, 1338 nt, synthetic construct
  misc_feature 1..1338: note = derived and/or modified sequence opt5 from CDS (HC) w/o signal peptide encoded by mRNA R3983, R4124
  source 1..1338: mol_type = other RNA
gaggtgcagctggtcgaaaccggcgggggactcgttcaacccggcaacagcctgaaactttcctgcgccacatctgggttcatctttagcacgacctggatgaattggattagacagacacctggaaaacggctggagtggctcgctcagatcgaagacaagtccaacaattacttcatttcttatagcgagtccgtgaaaggccgctttaccatctctagagatgacagcaagtccagcgtgtacctgcagatgaacaatcttaaagaagaggatacagccatttattactgttcttggaagtatcggtccaactactatttcgactactgggggcaaggagtcatggtgaccgttagcgcggagacaaccgctccgtctgtgtaccccctggcccctggcacggccctcaagtccaatagcatggtcaccctgggctgcctggtgaaagggtattttcccgaacctgttacagtgacctggaactctggagctctctccagcggcgtccacacattccccgccgtgctgcagtccgggctttacaccctgacgtctagcgtgacagtcccttccagcacctggccgtctcagacagttacctgtaatgtggctcatcccgcctccagcaccaaggtggataaaaagatcgtccctcgcaactgcggaggcgactgtaaaccctgcatctgtacagggtctgaggtgagctccgtttttattttccctcccaagccgaaggatgtgctcacgatcaccctgacacctaaagtgacctgcgtcgttgtggacatttctcaggatgaccccgaagtccactttagctggttcgtggatgacgtcgaggtgcatacagcgcaaaccagacctcccgaggaacagtttaattccacgttccggagcgtttctgagcttcccatcctgcaccaggattggctcaacggacgcacatttagatgtaaggtgacctccgccgctttccctagcccgattgaaaagaccatctctaagcccgagggccggacacaggtccctcatgtgtataccatgtcccccacaaaagaagagatgacgcaaaatgaggttagcattacctgcatggtgaagggcttctaccctcccgacatctatgtcgaatggcagatgaacgggcagccgcaagagaattacaaaaacacacctcccaccatggacacagatggatcctattttctgtactctaagctgaacgtgaagaaagaaaagtggcagcagggcaataccttcacgtgtagcgtgctccacgaggggctgcacaaccatcacaccgaaaaatccctttctcatagccctggaaag

SEQ ID NO: 61717 - RNA, 1338 nt, synthetic construct
  misc_feature 1..1338: note = derived and/or modified sequence opt6 from CDS (HC) w/o signal peptide encoded by mRNA R3983, R4124
  source 1..1338: mol_type = other RNA
gaagtacaattagtagaaactggaggaggattagtacaacctggaaattcactaaaactatcatgcgcaacctcaggattcatattctcaacaacatggatgaattggatccgacaaacaccaggaaaaagactcgaatggttagcacaaatagaagacaaatcaaataactactttatttcatactcagaatcagttaaaggaagatttacaatatcacgagacgactccaaatcatcagtctacctacaaatgaacaacttaaaagaagaagacacagccatctattattgctcatggaaatacagatctaattactactttgactactggggacaaggcgtaatggtaacagtctccgcagaaacaactgccccttccgtatatccactagcaccaggaacagcactaaaatctaactcaatggtaacacttggctgcctagtaaaaggctatttccctgaaccagtaacagtaacttggaactcaggagcattatcatcaggagtccacacattcccagccgtattacaatcaggattatacacactaacatcctctgtaacagttccctcatcaacatggccatctcaaaccgtaacatgtaatgtagcacatccagcctcctctaccaaagtagacaaaaaaatcgtcccacgaaactgcggaggtgactgcaaaccatgtatctgtacaggctcagaagtatcatcagtatttatcttcccaccaaaacctaaagatgtcttaaccataacacttactccaaaagtaacatgtgtcgttgttgacatatcccaagatgacccagaagtccacttctcctggttcgtagacgatgtagaagttcatacagctcaaacacgaccaccagaagaacaattcaactccacctttaggtcagtatccgaattacccatactccaccaagactggctaaacggccgaacattcagatgtaaagtaacaagtgcagcatttccttctccaatcgaaaaaactatatcaaaacccgaaggacgaacccaagtcccacacgtatatacaatgtcaccaaccaaagaagaaatgacacaaaacgaagtatctataacatgcatggtaaaaggcttctatccaccagacatatatgtagaatggcaaatgaatggacaacctcaagaaaattataaaaatacaccaccaactatggacacagacggatcatacttcctatactcaaaactaaacgtaaaaaaagaaaaatggcaacaaggcaacactttcacatgttcagtactacacgaaggcttacataaccatcacacagaaaaatcactctcccattcaccaggcaaa

SEQ ID NO: 61718 - RNA, 1338 nt, synthetic construct
  misc_feature 1..1338: note = derived and/or modified sequence opt11 from CDS (HC) w/o signal peptide encoded by mRNA R3983, R4124
  source 1..1338: mol_type = other RNA
gaagtccaactcgtagaaaccggcggcggacttgtccaacccggcaactccctcaaactatcatgtgcaacctcaggcttcatattctccaccacatggatgaactggatccgccaaacacccggaaaacgcctagaatggctcgcacaaatcgaagataaatccaacaactacttcatctcgtactccgaatccgtcaaaggacgattcacaatctcccgcgacgactccaaatcatcagtctacttacaaatgaacaacctcaaagaagaagacacagcaatatactactgctcctggaaataccgctccaactactacttcgactactggggccagggcgtcatggtcaccgtctccgcagaaaccacagccccctccgtctaccctctcgcccccggcacagctctcaagtccaactccatggtcacactaggctgcctcgtcaaaggatacttccccgaacccgtaacagtaacatggaactccggtgccctatcaagcggcgtccacacattccccgccgtcctccaatccggcctctacaccctaacaagctccgtaaccgtaccctcctccacctggccttcacaaacagtcacctgcaacgtcgcccaccccgcatcatcaacgaaagtcgacaaaaaaattgtacctcgcaactgcggaggcgactgcaaaccatgcatctgcaccggctccgaagtttcctcagtattcatcttcccacccaaacccaaagacgtacttacaatcacactcacacccaaagtaacatgcgtcgtcgtcgacatttcccaggacgacccagaagtacacttctcgtggttcgtagacgacgtcgaagtccacacagcccaaaccagaccccccgaagaacaattcaactctacctttcgctccgtttccgaactcccaatacttcaccaagactggctaaacggacgaacgttccgctgcaaagtcacctccgcagccttcccaagccccatcgaaaaaaccatctccaaacccgaaggccgcacccaagtaccccacgtctacaccatgtccccaaccaaagaagaaatgacccaaaacgaagtttcgatcacttgcatggtcaaaggcttctaccccccagacatctacgtcgaatggcaaatgaacggccaaccccaagaaaactataaaaacaccccccccacaatggacaccgacggctcatacttcctatactcaaaactaaacgtcaaaaaagaaaaatggcaacaaggaaacacgttcacatgctccgtcctgcacgaaggactccacaaccaccacaccgaaaaatccctatcccactccccaggaaaa

SEQ ID NO: 61719 - protein, 471 aa, synthetic construct
  REGION 1..471: note = Protein (HC) encoded by mRNA R3983, R4124
MAVMAPRTLVLLLSGALALTQTWAGEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSAETTAPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 61720 - RNA, 1416 nt, synthetic construct
  misc_feature 1..1416: note = CDS (HC) encoded by mRNA R3983, R4124
  source 1..1416: mol_type = other RNA
atggccgtgatggccccgcggaccctggtcctcctgctgagcggcgcgctcgccctgacccagacgtgggccggggaggtccagctcgtcgagaccggcggcggcctcgtccagcccggcaacagcctcaagctcagctgcgccaccagcggcttcatcttcagcaccacctggatgaactggatccggcagacccccggcaagcggctcgagtggctcgcccagatcgaggacaagagcaacaactacttcatcagctacagcgagagcgtcaagggccggttcaccatcagccgggacgacagcaagagcagcgtctacctccagatgaacaacctcaaggaggaggacaccgccatctactactgcagctggaagtaccggagcaactactacttcgactactggggccagggcgtcatggtcaccgtcagcgccgagaccaccgcccccagcgtgtacccgctggcgcccggcacggccctcaagtccaacagcatggtcaccctggggtgcctggtgaagggctacttccccgagcccgtgaccgtcacctggaactccggggccctcagctccggcgtgcacacgttccccgccgtgctgcagagcgggctgtacaccctcacctccagcgtcaccgtgccctccagcacgtggccctcccagaccgtgacctgcaacgtcgcccaccccgcgagctccaccaaggtggacaagaagatcgtgccgcgcaactgcggcggcgactgcaagccctgcatctgcacggggagcgaggtctccagcgtgttcatcttcccgcccaagccgaaggacgtgctgaccatcaccctgacccccaaggtcacgtgcgtggtggtcgacatctcccaggacgaccccgaggtgcacttcagctggttcgtggacgacgtcgaggtgcacaccgcccagacccggcccccggaggagcagttcaactccaccttccgcagcgtgagcgagctccccatcctgcaccaggactggctgaacggccggacgttccgctgcaaggtcacctccgccgccttccccagccccatcgagaagaccatctccaagccggaggggcggacccaggtgccccacgtctacacgatgagccccaccaaggaggagatgacccagaacgaggtgtccatcacctgcatggtgaagggcttctacccgcccgacatctacgtcgagtggcagatgaacgggcagccccaggagaactacaagaacacgccgcccaccatggacaccgacggcagctacttcctctactccaagctgaacgtgaagaaggagaagtggcagcagggcaacaccttcacgtgcagcgtgctgcacgaggggctccacaaccaccacaccgagaagtccctgagccactccccgggcaagtga

SEQ ID NO: 61721 - RNA, 1620 nt, synthetic construct
  misc_feature 1..1620: note = R4124
  source 1..1620: mol_type = other RNA
gggagaaagcttaccatggccgtgatggccccgcggaccctggtcctcctgctgagcggcgcgctcgccctgacccagacgtgggccggggaggtccagctcgtcgagaccggcggcggcctcgtccagcccggcaacagcctcaagctcagctgcgccaccagcggcttcatcttcagcaccacctggatgaactggatccggcagacccccggcaagcggctcgagtggctcgcccagatcgaggacaagagcaacaactacttcatcagctacagcgagagcgtcaagggccggttcaccatcagccgggacgacagcaagagcagcgtctacctccagatgaacaacctcaaggaggaggacaccgccatctactactgcagctggaagtaccggagcaactactacttcgactactggggccagggcgtcatggtcaccgtcagcgccgagaccaccgcccccagcgtgtacccgctggcgcccggcacggccctcaagtccaacagcatggtcaccctggggtgcctggtgaagggctacttccccgagcccgtgaccgtcacctggaactccggggccctcagctccggcgtgcacacgttccccgccgtgctgcagagcgggctgtacaccctcacctccagcgtcaccgtgccctccagcacgtggccctcccagaccgtgacctgcaacgtcgcccaccccgcgagctccaccaaggtggacaagaagatcgtgccgcgcaactgcggcggcgactgcaagccctgcatctgcacggggagcgaggtctccagcgtgttcatcttcccgcccaagccgaaggacgtgctgaccatcaccctgacccccaaggtcacgtgcgtggtggtcgacatctcccaggacgaccccgaggtgcacttcagctggttcgtggacgacgtcgaggtgcacaccgcccagacccggcccccggaggagcagttcaactccaccttccgcagcgtgagcgagctccccatcctgcaccaggactggctgaacggccggacgttccgctgcaaggtcacctccgccgccttccccagccccatcgagaagaccatctccaagccggaggggcggacccaggtgccccacgtctacacgatgagccccaccaaggaggagatgacccagaacgaggtgtccatcacctgcatggtgaagggcttctacccgcccgacatctacgtcgagtggcagatgaacgggcagccccaggagaactacaagaacacgccgcccaccatggacaccgacggcagctacttcctctactccaagctgaacgtgaagaaggagaagtggcagcagggcaacaccttcacgtgcagcgtgctgcacgaggggctccacaaccaccacaccgagaagtccctgagccactccccgggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61722 - protein, 217 aa, synthetic construct
  REGION 1..217: note = Protein (LC) w/o signal peptide encoded by mRNA R3983, R4125
DIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKRADAAPTVSIFPPSTEQLATGGASVVCLMNNFYPRDISVKWKIDGTERRDGVLDSVTDQDSKDSTYSMSSTLSLTKADYESHNLYTCEVVHKTSSSPVVKSFNRNEC

SEQ ID NO: 61723 - RNA, 651 nt, synthetic construct
  misc_feature 1..651: note = CDS (LC) w/o signal peptide encoded by mRNA R3983, R4125
  source 1..651: mol_type = other RNA
gacatcgtgctgacccagagccccgccctcgccgtctccctggagcagcgcgcgaccatcagctgcaagacgtcccagaacgtggactactacggcatcagctacctgcactggtaccagcagaagccggggcagcagcccaagctcctgatctacgagggctccaacctggccagcgggatccccgcccggttctccggcagcgggtccggcaccgacttcaccctcaccatcgaccccgtggaggccgacgacatcgtcacgtactactgccagcagagcaaggactacccgtacaccttcggcgccgggaccaagctggagctgaagcgcgccgacgcggcccccaccgtgagcatcttcccgcccagcaccgagcagctcgccacgggcggggcctccgtcgtgtgcctgatgaacaacttctacccgcgggacatcagcgtgaagtggaagatcgacggcaccgagcgccgggacggcgtcctggactccgtgaccgaccaggacagcaaggactccacctacagcatgtccagcacgctctccctgaccaaggcggactacgagagccacaacctgtacacctgcgaggtggtccacaagacctccagctcccccgtggtgaagagcttcaaccgcaacgagtgc

SEQ ID NO: 61724 - RNA, 651 nt, synthetic construct
  misc_feature 1..651: note = derived and/or modified sequence opt2 from CDS (LC) w/o signal peptide encoded by mRNA R3983, R4125
  source 1..651: mol_type = other RNA
gacatcgtcctcacccagtcccccgccctcgccgtctccctcgagcagcgcgccaccatctcctgcaagacctcccagaacgtcgactactacggcatctcctacctccactggtaccagcagaagcccggccagcagcccaagctcctcatctacgagggctccaacctcgcctccggcatccccgcccgcttctccggctccggctccggcaccgacttcaccctcaccatcgaccccgtcgaggccgacgacatcgtcacctactactgccagcagtccaaggactacccctacaccttcggcgccggcaccaagctcgagctcaagcgcgccgacgccgcccccaccgtctccatcttccccccctccaccgagcagctcgccaccggcggcgcctccgtcgtctgcctcatgaacaacttctacccccgcgacatctccgtcaagtggaagatcgacggcaccgagcgccgcgacggcgtcctcgactccgtcaccgaccaggactccaaggactccacctactccatgtcctccaccctctccctcaccaaggccgactacgagtcccacaacctctacacctgcgaggtcgtccacaagacctcctcctcccccgtcgtcaagtccttcaaccgcaacgagtgc

SEQ ID NO: 61725 - RNA, 651 nt, synthetic construct
  misc_feature 1..651: note = derived and/or modified sequence opt3 from CDS (LC) w/o signal peptide encoded by mRNA R3983, R4125
  source 1..651: mol_type = other RNA
gacatcgtgctgacccagagccccgccctcgctgtgtcccttgagcaaagagcaacaatttcttgcaagacttcacagaacgttgattactatggcataagttacctgcactggtatcagcagaaacctgggcaacagccaaagttgttaatctacgaaggaagcaatctggcctccggtattccggcgaggttctctggctcggggtcaggaacggactttaccctaacaatcgatcccgtggaggctgacgatattgtaacttattactgtcagcagagcaaagactatccttacaccttcggcgccggtacaaagctcgaactgaaacgggcagatgccgctccaaccgtgagtatctttcccccttccactgagcaacttgcaacagggggagcctctgtcgtgtgcctgatgaacaatttctacccacgcgacataagcgttaagtggaagatcgatggcaccgaacgacgtgacggcgtgttggattccgtcacggaccaggattcaaaagacagtacttatagcatgtcttccaccctctcactgacaaaggctgactacgagagccataacctgtatacttgtgaggtggtacacaaaaccagttcttcccccgttgtcaagagctttaatagaaacgaatgc

SEQ ID NO: 61726 - RNA, 651 nt, synthetic construct
  misc_feature 1..651: note = derived and/or modified sequence opt4 from CDS (LC) w/o signal peptide encoded by mRNA R3983, R4125
  source 1..651: mol_type = other RNA
gacatcgtgctgacccagagccccgccctggccgtgagcctggagcagagagccaccatcagctgcaagaccagccagaacgtggactactacggcatcagctacctgcactggtaccagcagaagcccggccagcagcccaagctgctgatctacgagggcagcaacctggccagcggcatccccgccagattcagcggcagcggcagcggcaccgacttcaccctgaccatcgaccccgtggaggccgacgacatcgtgacctactactgccagcagagcaaggactacccctacaccttcggcgccggcaccaagctggagctgaagagagccgacgccgcccccaccgtgagcatcttcccccccagcaccgagcagctggccaccggcggcgccagcgtggtgtgcctgatgaacaacttctaccccagagacatcagcgtgaagtggaagatcgacggcaccgagagaagagacggcgtgctggacagcgtgaccgaccaggacagcaaggacagcacctacagcatgagcagcaccctgagcctgaccaaggccgactacgagagccacaacctgtacacctgcgaggtggtgcacaagaccagcagcagccccgtggtgaagagcttcaacagaaacgagtgc

SEQ ID NO: 61727 - RNA, 651 nt, synthetic construct
  misc_feature 1..651: note = derived and/or modified sequence opt5 from CDS (LC) w/o signal peptide encoded by mRNA R3983, R4125
  source 1..651: mol_type = other RNA
gacatcgtgctgacccagagccccgccctcgctgtctccctggagcaaagagccacaatttcttgcaagacgagccagaacgttgattactatggcatctcctaccttcactggtatcagcagaaacctgggcaacagccgaagctgctcatttacgaaggatctaatctggcgagcggcatccccgctcggttctccgggtctggaagcggcaccgactttacacttaccattgatcctgtggaggccgacgatatcgtgacatattactgtcagcagtccaaagactatccctacaccttcggggccggaacaaagctggaactcaaacgcgctgatgccgctcctaccgtcagcatctttcccccttctacggagcaactggccaccggcggcgcgtccgtggtttgcctgatgaacaatttctacccgagagacattagcgtgaagtggaagatcgatgggacagaacggcgcgacggagtcctcgattctgtgaccgaccaggattccaaagacagcacatattctatgtccagcaccctgtcccttacgaaggccgactacgagtctcataacctgtatacatgtgaggttgtgcacaaaaccagctccagccccgtcgtgaagtcttttaatagaaacgaatgc

SEQ ID NO: 61728 - RNA, 651 nt, synthetic construct
  misc_feature 1..651: note = derived and/or modified sequence opt6 from CDS (LC) w/o signal peptide encoded by mRNA R3983, R4125
  source 1..651: mol_type = other RNA
gacatagtattaacacaatcaccagcactagcagtatcactagaacaaagagcaacaatatcctgcaaaacatcccaaaacgtagactactacggaatatcttacctacactggtaccaacaaaaaccaggacaacaaccaaaactactaatctacgaaggatcaaacctagcatcaggaataccagcaagattctcaggatcaggatccggaacagacttcacactaacaatagacccagtagaagcagacgatatagtaacatactactgccaacaatcaaaagactacccatacacattcggagcaggaactaaattagaattaaaaagagccgacgcagcaccaacagtatcaatattcccaccatcaacagaacaattagccacaggaggagcatcagtagtctgcctaatgaacaacttctacccccgagacatttcagtaaaatggaaaatagacggaacagaaagaagagacggagtactagactctgtaacagaccaagactcaaaagactcaacctactcaatgtcttcaaccctatcactaacaaaagcagactacgaatcccacaatctatacacatgcgaagtagtacacaaaacatcatcctcaccagtagtaaaatcattcaacagaaacgaatgc

SEQ ID NO: 61729 - RNA, 651 nt, synthetic construct
  misc_feature 1..651: note = derived and/or modified sequence opt11 from CDS (LC) w/o signal peptide encoded by mRNA R3983, R4125
  source 1..651: mol_type = other RNA
gacatcgtcctcacccaatcccccgccctcgccgtctctctcgaacaacgcgccaccatctcctgcaaaacctcacaaaacgtcgactactacggcatctcctacctccactggtaccaacaaaaacccggccaacaacccaaactcctaatctacgaaggcagcaatctagcctccggcatacccgcccgcttttcaggttcaggctctggcaccgacttcaccctcaccatagaccccgtcgaagccgacgacatagtcacctactactgccaacaatccaaagactacccctacaccttcggcgccggcaccaaactcgaactcaaacgcgccgacgccgcccccaccgtctccatcttcccaccctccaccgaacaactagcaaccggcggcgcctcagtcgtctgcctcatgaacaacttctacccccgcgacatctccgtcaaatggaaaatcgacggcacagaacgccgtgacggcgtccttgactccgtcacagaccaagactccaaagactccacctactccatgtcctccaccctatccctaaccaaagccgactacgaatcccacaacctctacacatgcgaagtcgtccacaaaacctcctcatcacccgtcgtcaaatccttcaaccgcaacgaatgc

SEQ ID NO: 61730 - protein, 242 aa, synthetic construct
  REGION 1..242: note = Protein (LC) encoded by mRNA R3983, R4125
MAVMAPRTLVLLLSGALALTQTWAGDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKRADAAPTVSIFPPSTEQLATGGASVVCLMNNFYPRDISVKWKIDGTERRDGVLDSVTDQDSKDSTYSMSSTLSLTKADYESHNLYTCEVVHKTSSSPVVKSFNRNEC

SEQ ID NO: 61731 - RNA, 729 nt, synthetic construct
  misc_feature 1..729: note = CDS (LC) encoded by mRNA R3983, R4125
  source 1..729: mol_type = other RNA
atggccgtgatggccccgcggaccctggtcctcctgctgagcggcgcgctcgccctgacccagacgtgggccggggacatcgtgctgacccagagccccgccctcgccgtctccctggagcagcgcgcgaccatcagctgcaagacgtcccagaacgtggactactacggcatcagctacctgcactggtaccagcagaagccggggcagcagcccaagctcctgatctacgagggctccaacctggccagcgggatccccgcccggttctccggcagcgggtccggcaccgacttcaccctcaccatcgaccccgtggaggccgacgacatcgtcacgtactactgccagcagagcaaggactacccgtacaccttcggcgccgggaccaagctggagctgaagcgcgccgacgcggcccccaccgtgagcatcttcccgcccagcaccgagcagctcgccacgggcggggcctccgtcgtgtgcctgatgaacaacttctacccgcgggacatcagcgtgaagtggaagatcgacggcaccgagcgccgggacggcgtcctggactccgtgaccgaccaggacagcaaggactccacctacagcatgtccagcacgctctccctgaccaaggcggactacgagagccacaacctgtacacctgcgaggtggtccacaagacctccagctcccccgtggtgaagagcttcaaccgcaacgagtgctga

SEQ ID NO: 61732 - RNA, 933 nt, synthetic construct
  misc_feature 1..933: note = R4125
  source 1..933: mol_type = other RNA
gggagaaagcttaccatggccgtgatggccccgcggaccctggtcctcctgctgagcggcgcgctcgccctgacccagacgtgggccggggacatcgtgctgacccagagccccgccctcgccgtctccctggagcagcgcgcgaccatcagctgcaagacgtcccagaacgtggactactacggcatcagctacctgcactggtaccagcagaagccggggcagcagcccaagctcctgatctacgagggctccaacctggccagcgggatccccgcccggttctccggcagcgggtccggcaccgacttcaccctcaccatcgaccccgtggaggccgacgacatcgtcacgtactactgccagcagagcaaggactacccgtacaccttcggcgccgggaccaagctggagctgaagcgcgccgacgcggcccccaccgtgagcatcttcccgcccagcaccgagcagctcgccacgggcggggcctccgtcgtgtgcctgatgaacaacttctacccgcgggacatcagcgtgaagtggaagatcgacggcaccgagcgccgggacggcgtcctggactccgtgaccgaccaggacagcaaggactccacctacagcatgtccagcacgctctccctgaccaaggcggactacgagagccacaacctgtacacctgcgaggtggtccacaagacctccagctcccccgtggtgaagagcttcaaccgcaacgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctagacaattggaatt

SEQ ID NO: 61733 - RNA, 2822 nt, synthetic construct
  misc_feature 1..2822: note = CDS (HC)-IRES-CDS (LC) as RNA from mRNA R3983
  source 1..2822: mol_type = other RNA
atggccgtgatggccccgcggaccctggtcctcctgctgagcggcgcgctcgccctgacccagacgtgggccggggaggtccagctcgtcgagaccggcggcggcctcgtccagcccggcaacagcctcaagctcagctgcgccaccagcggcttcatcttcagcaccacctggatgaactggatccggcagacccccggcaagcggctcgagtggctcgcccagatcgaggacaagagcaacaactacttcatcagctacagcgagagcgtcaagggccggttcaccatcagccgggacgacagcaagagcagcgtctacctccagatgaacaacctcaaggaggaggacaccgccatctactactgcagctggaagtaccggagcaactactacttcgactactggggccagggcgtcatggtcaccgtcagcgccgagaccaccgcccccagcgtgtacccgctggcgcccggcacggccctcaagtccaacagcatggtcaccctggggtgcctggtgaagggctacttccccgagcccgtgaccgtcacctggaactccggggccctcagctccggcgtgcacacgttccccgccgtgctgcagagcgggctgtacaccctcacctccagcgtcaccgtgccctccagcacgtggccctcccagaccgtgacctgcaacgtcgcccaccccgcgagctccaccaaggtggacaagaagatcgtgccgcgcaactgcggcggcgactgcaagccctgcatctgcacggggagcgaggtctccagcgtgttcatcttcccgcccaagccgaaggacgtgctgaccatcaccctgacccccaaggtcacgtgcgtggtggtcgacatctcccaggacgaccccgaggtgcacttcagctggttcgtggacgacgtcgaggtgcacaccgcccagacccggcccccggaggagcagttcaactccaccttccgcagcgtgagcgagctccccatcctgcaccaggactggctgaacggccggacgttccgctgcaaggtcacctccgccgccttccccagccccatcgagaagaccatctccaagccggaggggcggacccaggtgccccacgtctacacgatgagccccaccaaggaggagatgacccagaacgaggtgtccatcacctgcatggtgaagggcttctacccgcccgacatctacgtcgagtggcagatgaacgggcagccccaggagaactacaagaacacgccgcccaccatggacaccgacggcagctacttcctctactccaagctgaacgtgaagaaggagaagtggcagcagggcaacaccttcacgtgcagcgtgctgcacgaggggctccacaaccaccacaccgagaagtccctgagccactccccgggcaagtgaatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggacatcgtgctgacccagagccccgccctcgccgtctccctggagcagcgcgcgaccatcagctgcaagacgtcccagaacgtggactactacggcatcagctacctgcactggtaccagcagaagccggggcagcagcccaagctcctgatctacgagggctccaacctggccagcgggatccccgcccggttctccggcagcgggtccggcaccgacttcaccctcaccatcgaccccgtggaggccgacgacatcgtcacgtactactgccagcagagcaaggactacccgtacaccttcggcgccgggaccaagctggagctgaagcgcgccgacgcggcccccaccgtgagcatcttcccgcccagcaccgagcagctcgccacgggcggggcctccgtcgtgtgcctgatgaacaacttctacccgcgggacatcagcgtgaagtggaagatcgacggcaccgagcgccgggacggcgtcctggactccgtgaccgaccaggacagcaaggactccacctacagcatgtccagcacgctctccctgaccaaggcggactacgagagccacaacctgtacacctgcgaggtggtccacaagacctccagctcccccgtggtgaagagcttcaaccgcaacgagtgctga

SEQ ID NO: 61734 - RNA, 3014 nt, synthetic construct
  misc_feature 1..3014: note = R3983
  source 1..3014: mol_type = other RNA
gggagaaagcttaccatggccgtgatggccccgcggaccctggtcctcctgctgagcggcgcgctcgccctgacccagacgtgggccggggaggtccagctcgtcgagaccggcggcggcctcgtccagcccggcaacagcctcaagctcagctgcgccaccagcggcttcatcttcagcaccacctggatgaactggatccggcagacccccggcaagcggctcgagtggctcgcccagatcgaggacaagagcaacaactacttcatcagctacagcgagagcgtcaagggccggttcaccatcagccgggacgacagcaagagcagcgtctacctccagatgaacaacctcaaggaggaggacaccgccatctactactgcagctggaagtaccggagcaactactacttcgactactggggccagggcgtcatggtcaccgtcagcgccgagaccaccgcccccagcgtgtacccgctggcgcccggcacggccctcaagtccaacagcatggtcaccctggggtgcctggtgaagggctacttccccgagcccgtgaccgtcacctggaactccggggccctcagctccggcgtgcacacgttccccgccgtgctgcagagcgggctgtacaccctcacctccagcgtcaccgtgccctccagcacgtggccctcccagaccgtgacctgcaacgtcgcccaccccgcgagctccaccaaggtggacaagaagatcgtgccgcgcaactgcggcggcgactgcaagccctgcatctgcacggggagcgaggtctccagcgtgttcatcttcccgcccaagccgaaggacgtgctgaccatcaccctgacccccaaggtcacgtgcgtggtggtcgacatctcccaggacgaccccgaggtgcacttcagctggttcgtggacgacgtcgaggtgcacaccgcccagacccggcccccggaggagcagttcaactccaccttccgcagcgtgagcgagctccccatcctgcaccaggactggctgaacggccggacgttccgctgcaaggtcacctccgccgccttccccagccccatcgagaagaccatctccaagccggaggggcggacccaggtgccccacgtctacacgatgagccccaccaaggaggagatgacccagaacgaggtgtccatcacctgcatggtgaagggcttctacccgcccgacatctacgtcgagtggcagatgaacgggcagccccaggagaactacaagaacacgccgcccaccatggacaccgacggcagctacttcctctactccaagctgaacgtgaagaaggagaagtggcagcagggcaacaccttcacgtgcagcgtgctgcacgaggggctccacaaccaccacaccgagaagtccctgagccactccccgggcaagtgaatgcatttgaaagccgggggtgggagatccggattgccagtctgctcgatatcgcaggctgggtccgtgactacccactccccctttaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacgtgtgtttagtcgaggttaaaaaacgtctaggccccccgaaccacggggacgtggttttcctttgaaaaacacgatgataatagatctaccatggccgtgatggccccgcggaccctggtcctcctgctgagcggcgcgctcgccctgacccagacgtgggccggggacatcgtgctgacccagagccccgccctcgccgtctccctggagcagcgcgcgaccatcagctgcaagacgtcccagaacgtggactactacggcatcagctacctgcactggtaccagcagaagccggggcagcagcccaagctcctgatctacgagggctccaacctggccagcgggatccccgcccggttctccggcagcgggtccggcaccgacttcaccctcaccatcgaccccgtggaggccgacgacatcgtcacgtactactgccagcagagcaaggactacccgtacaccttcggcgccgggaccaagctggagctgaagcgcgccgacgcggcccccaccgtgagcatcttcccgcccagcaccgagcagctcgccacgggcggggcctccgtcgtgtgcctgatgaacaacttctacccgcgggacatcagcgtgaagtggaagatcgacggcaccgagcgccgggacggcgtcctggactccgtgaccgaccaggacagcaaggactccacctacagcatgtccagcacgctctccctgaccaaggcggactacgagagccacaacctgtacacctgcgaggtggtccacaagacctccagctcccccgtggtgaagagcttcaaccgcaacgagtgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatattcccccccccccccccccccccccccccccctctag
